United States Patent 7,745,391 (HUMAN THROMBOSPONDIN POLYPEPTIDE) - sequence listing, part 101

SEQ ID NO: 312487 - DNA, 1455 bp, Homo sapiens
cgcgctggagaggcgcggggtcaagacgtccggcctcgggggcccgggctgggccgccgagtcccctgggcggcgctgagcgggcgggaggcgggggcccgcggctcggggcaaccgaggccgggtcgcgggatcggccgccatcgccgccgccgctgcactgggagcccgcggggatggagcgggaggcgttgccgtggggcctcgagccccaggatgtgcagagttctgacgaaatgaggagccccgaagggtacctcagaggcaacatgagtgagaatgaggaagaggaaatttctcagcaagaaggcagtggggactatgaagtcgaagagataccatttgggcttgaaccccagagccctgggtttgagccacaaagcccagagtttgaaccccaaagccccagatttgagcctgaaagcccggggtttgagtcccgaagccctgggcttgtgcccccaagccctgagtttgcacccagaagccctgaatcagattctcagagccctgagtttgaatcccagagccctaggtatgaaccccaaagccctggctatgaacctcggagccccgggtatgaaccccggagccctggctatgaatctgagagctctagatatgaatcccagaacactgagctcaaaacccaaagcccagaatttgaagctcaaagttccaaattccaggaaggtgcggagatgcttctgaaccccgacgaaaagagtcctttgaatatctccgtaggagttcaccccctggactccttcactcaggggtttggggagcagcccacaggggacctgcccatagggccaccttttgagatgcccacaggggccctgctgtctacaccgcagtttgagatgcttcagaatcccctgggtctcacaggagcccttcgaggtccaggtcggcggggtggccgggccaggggtgggcagggccctcggcctaacatctgcggcatctgcgggaagagcttcgggcggggctccaccctgatccagcaccagcgcatccacaccggtgagaagccctacaaatgtgaggtctgcagcaaggccttctcccagagctctgacctcatcaaacaccagcgcacccacactggcgagcggccctacaaatgtccccgttgcggcaaggccttcgccgacagctcttacctgcttcgccaccagcgcactcactctggccagaagccctacaagtgcccacattgtggcaaggccttcggcgacagctcctacctcctgcgacaccagcgcacccacagccacgagcggccctacagctgcaccgagtgcggcaagtgctatagccagaactcgtccctgcgcagccatcagagggtgcacaccggtcagaggcccttcagctgtggcatctgcggcctggcaagtgggtacgggcatggatggccagcaccgagctctggccaaagccgcttgg

SEQ ID NO: 312488 - DNA, 1397 bp, Homo sapiens
cgcgctggagaggcgcggggtcaagacgtccggcctcgggggcccgggctgggccgccgagtcccctgggcggcgctgagcgggcgggaggcgggggcccgcggctcggggcaaccgaggccgggtcgcgggatcggccgccatcgccgccgccgctgcactgggagcccgcggggatggagcgggaggcgttgccgtggggcctcgagccccaggatgtgcagagttctgacgaaatgaggagccccgaagggtacctcagaggcaacatgagtgagaatgaggaagaggaaatttctcagcaagaaggcagtggggactatgaagtcgaagagataccatttgggcttgaaccccagagccctgggtttgagccacaaagcccagagtttgaaccccaaagccccagatttgagcctgaaagcccggggtttgagtcccgaagccctgggcttgtgcccccaagccctgagtttgcacccagaagccctgaatcagattctcagagccctgagtttgaatcccagagccctaggtatgaaccccaaagccctggctatgaacctcggagccccgggtatgaaccccggagccctggctatgaatctgagagctctagatatgaatcccagaacactgagctcaaaacccaaagcccagaatttgaagctcaaagttccaaattccaggaaggtgcggagatgcttctgaaccccgacgaaaagagtcctttgaatatctccgtaggagttcaccccctggactccttcactcaggggtttggggagcagcccacaggggacctgcccatagggccaccttttgagatgcccacaggggccctgctgtctacaccgcagtttgagatgcttcagaatcccctgggtctcacaggagcccttcgaggtccaggtcggcggggtggccgggccaggggtgggcagggccctcggcctaacatctgcggcatctgcgggaagagcttcgggcggggctccacctctcatccagcaccagcgctcccacacgggcgagcggccctacaggtgcgccgtgtgcggcaagggcttctgccgctcctccacgcttctgcagcatcaccgggtccacagtggcgagcggccttacaagtgcgatgactgcggaaaggccttctcccagagctccgacctcatccgccaccagcggacccacgcggcgggccggcgctgacctggggccccagcaggggtgggaggtgtgggcagaagataaggggccagggagctagaggaacctttagggagtggggccccggggtggggcctgggcctctgcgtgcaaaccccagcctccctcttcttcctcaggctttggagcccctgagtttgagttcaataaaaactttatgtggtaaa

SEQ ID NO: 312489 - DNA, 2507 bp, Homo sapiens
cgcgctggagaggcgcggggtcaagacgtccggcctcgggggcccgggctgggccgccgagtcccctgggcggcgctgagcgggcgggaggcgggggcccgcggctcggggcaaccgaggccgggtcgcgggatcggccgccatcgccgccgccgctgcactgggagcccgcggggatggagcgggaggcgttgccgtggggcctcgagccccaggatgtgcagagttctgacgaaatgaggagccccgaagggtacctcagaggcaacatgagtgagaatgaggaagaggaaatttctcagcaagaaggcagtggggactatgaagtcgaagagataccatttgggcttgaaccccagagccctgggtttgagccacaaagcccagagtttgaaccccaaagccccagatttgagcctgaaagcccggggtttgagtcccgaagccctgggcttgtgcccccaagccctgagtttgcacccagaagccctgaatcagattctcagagccctgagtttgaatcccagagccctaggtatgaaccccaaagccctggctatgaacctcggagccccgggtatgaaccccggagccctggctatgaatctgagagctctagatatgaatcccagaacactgagctcaaaacccaaagcccagaatttgaagctcaaagttccaaattccaggaaggtgcggagatgcttctgaaccccgacgaaaagagtcctttgaatatctccgtaggagttcaccccctggactccttcactcaggggtttggggagcagcccacaggggacctgcccatagggccaccttttgagatgcccacaggggccctgctgtctacaccgcagtttgagatgcttcagaatcccctgggtctcacaggagcccttcgaggtccaggtcggcggggtggccgggccaggggtgggcagggccctcggcctaacatctgcggcatctgcgggaagagcttcgggcggggctccaccctgatccagcaccagcgcatccacaccggtgagaagccctacaaatgtgaggtctgcagcaaggccttctcccagagctctgacctcatcaaacaccagcgcacccacactggcgagcggccctacaaatgtccccgttgcggcaaggccttcgccgacagctcttacctgcttcgccaccagcgcactcactctggccagaagccctacaagtgcccacattgtggcaaggccttcggcgacagctcctacctcctgcgacaccagcgcacccacagccacgagcggccctacagctgcaccgagtgcggcaagtgctatagccagaactcgtccctgcgcagccatcagagggtgcacaccggtcagaggcccttcagctgtggcatctgcggcaagagcttctcccagcggtcggcccttatcccccatgcccgcagccacgcccgggagaagcccttcaagtgccctgagtgcggcaagcgctttggccagagctcggtgctggccatccacgcccgcacccacctgccaggccgcacctacagctgccccgactgcggcaagaccttcaatcgctcctccactctcatccagcaccagcgctcccacacgggcgagcggccctacaggtgcgccgtgtgcggcaagggcttctgccgctcctccacgcttctgcagcatcaccgggtccacagtggcgagcggccttacaagtgcgatgactgcggaaaggccttctcccagagctccgacctcatccgccaccagcggacccacgcggcgggccggcgctgacctggggccccagcaggggtgggaggtgtgggcagaagataaggggccagggagctagaggaacctttagggaggatagtggagaagccgcaggagaatggaggagctgaggatgctggaagaagagaaccagggtggaggaagtgacatgccctggagacttgtgggaagtgggttggagggaggccaggccggcagcgggaggccctgggagaaatggagagaggtcagcggagggctggcctcagccgcggctccttggtgggtgcctggcttggcaactgctagagcagggaggggggagggcaggggattacctaattagagtgggttagcttagattggtagctgctgaaactctcgttgagtcaggagcgggtaaaaggtaggtggggtggggagtggggccccggggtggggcctgggcctctgcgtgcaaaccccagcctccctcttcttcctcaggctttggagcccctgagtttgagttcaataaaaactttatgtggtaaaaaaaaaaataactaataaaaaaaaccaacacaaaaaaacaatcccgagagaacacaagcgggcacggaacacaacgcggccaaacacgggccacaggccacagaagggaccagagcaccagacattcgccacaagggcaaaacagcagcccccacaaggacacacaaacacgaaaccccggtacaccgcgcagac

SEQ ID NO: 312490 - DNA, 1725 bp, Homo sapiens
cgcgctggagaggcgcggggtcaagacgtccggcctcgggggcccgggctgggccgccgagtcccctgggcggcgctgagcgggcgggaggcgggggcccgcggctcggggcaaccgaggccgggtcgcgggatcggccgccatcgccgccgccgctgcactgggagcccgcggggatggagcgggaggcgttgccgtggggcctcgagccccaggatgtgcagagttctgacgaaatgaggagccccgaagggtacctcagaggcaacatgagtgagaatgaggaagaggaaatttctcagcaagaaggcagtggggactatgaagtcgaagagataccatttgggcttgaaccccagagccctgggtttgagccacaaagcccagagtttgaaccccaaagccccagatttgagcctgaaagcccggggtttgagtcccgaagccctgggcttgtgcccccaagccctgagtttgcacccagaagccctgaatcagattctcagagccctgagtttgaatcccagagccctaggtatgaaccccaaagccctggctatgaacctcggagccccgggtatgaaccccggagccctggctatgaatctgagagctctagatatgaatcccagaacactgagctcaaaacccaaagcccagaatttgaagctcaaagttccaaattccaggaaggtgcggagatgcttctgaaccccgacgaaaagagtcctttgaatatctccgtaggagttcaccccctggactccttcactcaggggtttggggagcagcccacaggggacctgcccatagggccaccttttgagatgcccacaggggccctgctgtctacaccgcagtttgagatgcttcagaatcccctgggtctcacaggagcccttcgaggtccaggtcggcggggtggccgggccaggggtgggcagggccctcggcctaacatctgcggcatctgcgggaagagcttcgggcggggctccacctctcatccagcaccagcgctcccacacgggcgagcggccctacaggtgcgccgtgtgcggcaagggcttctgccgctcctccacgcttctgcagcatcaccgggtccacagtggcgagcggccttacaagtgcgatgactgcggaaaggccttctcccagagctccgacctcatccgccaccagcggacccacgcggcgggccggcgctgacctggggccccagcaggggtgggaggtgtgggcagaagataaggggccagggagctagaggaacctttagggaggatagtggagaagccgcaggagaatggaggagctgaggatgctggaagaagagaaccagggtggaggaagtgacatgccctggagacttgtgggaagtgggttggagggaggccaggccggcagcgggaggccctgggagaaatggagagaggtcagcggagggctggcctcagccgcggctccttggtgggtgcctggcttggcaactgctagagcagggaggggggagggcaggggattacctaattagagtgggttagcttagattggtagctgctgaaactctcgttgagtcaggagcgggtaaaaggtaggtggggtggggagtggggccccggggtggggcctgggcctctgcgtgcaaaccccagcctccctcttcttcctcaggctttggagcccctgagtttgagttcaataaaaactttatgtggtaaa

SEQ ID NO: 312491 - DNA, 297 bp, Homo sapiens
ctccctggttcaagcatttctcctgcctcagcctcccgagtagctgggattactggttaatttttgtatttttagtagagatggggtttcaccttgttggccaggttggtctcaaactcctgacctcaagtgatccacccacctcggcctcccaaagtgctgggattacaggtgtgagccaccatgcctggtgaagattttttttttctttacctttgattttctacagtttgaatatgatactctttggtgtagtttttttctggcatttatttggcttggcattctctgagcttc

SEQ ID NO: 312492 - DNA, 561 bp, Homo sapiens
atccctcccttcctctaaaaagtaatcactattcctggcttttatagttatcattttcttgagcttttaaacttgttttatcatccaagtatgcatctgtagtcgtcttgctactaatatgactgaatacaaatggcaaaccttgcttttttgcagaattactgttttaaaaaaacttcctacaataaaaacaccagaatctttaaaaaatgtttaatctgaattaatcaaatcatcagacaaatctacaaagtgcctttataaagtacatgaaatggtctgacctattcaaatcaaagtcaatgtcatgaaaaccaaaaaaacacactgtagaggcaaaacaatcaattttaatgtgttgtccttgactggattccgaatttaaacaatagacccattaaccttgaagaaatctgaatatggactgtactgtatatatatttagatgtatatatgtgaatgtatctgtgtcttagtatctgtatacacacacacacacacagaaagagagtgaaagctaagcactcacatatatgcttcatattgcagagttcaaagatc

SEQ ID NO: 312493 - DNA, 3334 bp, Homo sapiens
gcggccgctgcgactccggagccggcggggggctccggtccttccctgcgccaccgcacaggacatctctctggctggggagcggcggtgagacccgccgagggcgtctgtgtccctcctcccccgcggtcctcggtgcgtccgcacgcccctcctcctcggctccctccttcttctctccgcgcctctccgccccctccccgtctccgcaggccgagtggtgcggcccgcctccagctgaccggcctggaatcccggctccgagccccggactcgcgcccgcccgcgcgcccgctccttccccctccccccgccccgagccccccgacgccgccgccaccgcctcctcagagcggggcccgggcccagccgccgccaccgctgccgccgccgagctccgccgccgccgagcaccatgggagacgctgggagcgagcgcagcaaagcgcccagcctgccgcctcgctgtccctgcggcttctgggggtccagcaagactatgaatctctgttccaaatgctttgctgattttcaaaagaaacagccagacgatgattccgctccaagtacaagtaacagccaatcagatttgttttccgaagagaccaccagtgacaacaacaatacctcgataaccacgccaactcttagtcccagccagcagccgcttccgacagaactgaatgtaacttcaccgagtaaagaggagtgtgggccatgcacagacacagctcatgtctcattaatcacaccaacaaaaagatcctgtggtacagattcacagtctgagaatgaggcttcaccagtaaaacggccacgactacttgagaatacggaacggtccgaggaaaccagtcgatctaaacagaagagtcgacgtcggtgcttccagtgccaaaccaaactggagctggtgcagcaggaattgggatcgtgtcgctgcggttatgtgttctgtatgttacatcgcctccccgagcagcacgactgcacattcgaccacatgggccgtggccgggaggaagccatcatgaaaatggtgaagctggaccggaaagtggggcgctcctgccagcgcatcggggaggggtgctcctgaaggccaggcatggccaccacgtgacgctgttcttagttcactaatgttagccttatttaggacaaagtcagccagacaccttgtactgggcacgcgtcagactgcagccagtccgtttcctttctttagccagccatcctggtactgtagtttaggggttgatggtggttgaaattgatttctggctggttactaaggtgcctgctagccattgtataaaattaaaacatgaagaatattttttttttgagcatggctagtggatttaaaacaacacatacctgtcactgctggagtcaaacttataaaaagccttaagtggaaagtgttccagacggagactctgagttaatagaggagtagaagctggtgttaaagttcccacgacgcacatggctttgccagaaactctgtttaatgatcggcctttcacctcttcacttatccttagtcccagtagccaggatacctgatggccacgtgtgccttggccacgggaggctgctgagattggccacgtggctgggctgggtggtggcctcactctcccacagagctggaaatggggggtgggggacagattcttacggaaatttttttacctgacttgctatgaaaaaactcatcacacaagaagagaaacagtaacctcactttgaaaattagctccactcaagactagtccacgaacgagacccgccttttctacacaggatccaaggtcacgagaagcagccagagtgccccgcctccgccggctctggtctgccattcgccagtgcagggatctggcacggaccagatgtggcgaatggcagcacagcgcggtggctgggtctgcacactggcctctgcagccagatttctatattgggagttttttaaaaagacatttcatagccaacaagaatcagtagaagtgctgggagcagcagctggggaagctgccgcccacgggctctgccccttccagctggagccgcccgtgcctccaggggccaagaggatgatgtcgtggcctccattctcgtttctatgcagccccatagtccaaggacacccagtccacatctaccatatagcaagtttagtaagggaaggcagcatacgtcccagggacagtgggtttggatctgtctagaacagcggtttgtggctgtggcccagctccgagagtgatatttgctctggtaggtgagggcctgagggtacatttctccacctgtgccccctcatgttcacagaggatttcagcagctgcaactgcgcacgccaggtggggaagggtgggggtgggcctggttgccccatgttaggaaatcactaccagtcaggtggggctggggctgggtggacaggatcaggattcccttgaaagcccaggcagggtgagcagtcccagtggtcctagtgccgcatcagatccaggtgggtgagggcaggaggcccctgcggaggcagcgtggatctgcccacacataggctactggaatagtttaacccagcaactttcctttttataaaacaacaaatggttcaactctgtctgcaaattaacagctgaacacctgcaactgcaaatgttttttgatccgacgtactgaaataggaagtcatgctcttcccaccctccacccaccagagtggaacccgctgcaaaatccccagccttaattcttgcttcaggacccagaccggtgtcttgctctagggcaacccagggcagaggggccaggtctgcccagcgtttaccactgctgtcaagccacagcccttggccaccatacgggccatcctcagtgaggcagccccccataggcttccgccaagctctggtcccgaagaggctgtgcgagcccttcccggccctccccagggccccccgccccctcctctgcctgctgcgtggaggcagccatgggaaggagcccaggggagctggcctgggggagcgaagcccatgttcgcttcctgacttagagctggggggggtggggggtggggcttgttcccctgcagtatctgttctgtgaagtttgttaaatgtaaggaaagcttaaattcttgtatctttaaaagagaaaatcttatttaacccttttgtgttctagatttacttacacacatagcctagagctcagttttagttttaacattgtgaaaatattaaaagaatcttgtaactttattcttttttctcctgctgaaaaaaaaaattaaaccaatcgtatgaaa

SEQ ID NO: 312494 - DNA, 3268 bp, Homo sapiens
gcggccgctgcgactccggagccggcggggggctccggtccttccctgcgccaccgcacaggacatctctctggctggggagcggcggtgagacccgccgagggcgtctgtgtccctcctcccccgcggtcctcggtgcgtccgcacgcccctcctcctcggctccctccttcttctctccgcgcctctccgccccctccccgtctccgcaggccgagtggtgcggcccgcctccagctgaccggcctggaatcccggctccgagccccggactcgcgcccgcccgcgcgcccgctccttccccctccccccgccccgagccccccgacgccgccgccaccgcctcctcagagcggggcccgggcccagccgccgccaccgctgccgccgccgagctccgccgccgccgagcaccatgggagacgctgggagcgagcgcagcaaagcgcccagcctgccgcctcgctgtccctgcggcttctgggggtccagcaagactatgaatctctgttccaaatgctttgctgattttcaaaagaaacagccagacgatgattccgctccaagtacaagtaacagccaatcagatttgttttccgaagagaccaccagtgacaacaacaatacctcgataaccacgccaactcttagtcccagccagcagccgcttccgacagaactgaatgtaacttcaccgagtaaagaggagtattcacagtctgagaatgaggcttcaccagtaaaacggccacgactacttgagaatacggaacggtccgaggaaaccagtcgatctaaacagaagagtcgacgtcggtgcttccagtgccaaaccaaactggagctggtgcagcaggaattgggatcgtgtcgctgcggttatgtgttctgtatgttacatcgcctccccgagcagcacgactgcacattcgaccacatgggccgtggccgggaggaagccatcatgaaaatggtgaagctggaccggaaagtggggcgctcctgccagcgcatcggggaggggtgctcctgaaggccaggcatggccaccacgtgacgctgttcttagttcactaatgttagccttatttaggacaaagtcagccagacaccttgtactgggcacgcgtcagactgcagccagtccgtttcctttctttagccagccatcctggtactgtagtttaggggttgatggtggttgaaattgatttctggctggttactaaggtgcctgctagccattgtataaaattaaaacatgaagaatattttttttttgagcatggctagtggatttaaaacaacacatacctgtcactgctggagtcaaacttataaaaagccttaagtggaaagtgttccagacggagactctgagttaatagaggagtagaagctggtgttaaagttcccacgacgcacatggctttgccagaaactctgtttaatgatcggcctttcacctcttcacttatccttagtcccagtagccaggatacctgatggccacgtgtgccttggccacgggaggctgctgagattggccacgtggctgggctgggtggtggcctcactctcccacagagctggaaatggggggtgggggacagattcttacggaaatttttttacctgacttgctatgaaaaaactcatcacacaagaagagaaacagtaacctcactttgaaaattagctccactcaagactagtccacgaacgagacccgccttttctacacaggatccaaggtcacgagaagcagccagagtgccccgcctccgccggctctggtctgccattcgccagtgcagggatctggcacggaccagatgtggcgaatggcagcacagcgcggtggctgggtctgcacactggcctctgcagccagatttctatattgggagttttttaaaaagacatttcatagccaacaagaatcagtagaagtgctgggagcagcagctggggaagctgccgcccacgggctctgccccttccagctggagccgcccgtgcctccaggggccaagaggatgatgtcgtggcctccattctcgtttctatgcagccccatagtccaaggacacccagtccacatctaccatatagcaagtttagtaagggaaggcagcatacgtcccagggacagtgggtttggatctgtctagaacagcggtttgtggctgtggcccagctccgagagtgatatttgctctggtaggtgagggcctgagggtacatttctccacctgtgccccctcatgttcacagaggatttcagcagctgcaactgcgcacgccaggtggggaagggtgggggtgggcctggttgccccatgttaggaaatcactaccagtcaggtggggctggggctgggtggacaggatcaggattcccttgaaagcccaggcagggtgagcagtcccagtggtcctagtgccgcatcagatccaggtgggtgagggcaggaggcccctgcggaggcagcgtggatctgcccacacataggctactggaatagtttaacccagcaactttcctttttataaaacaacaaatggttcaactctgtctgcaaattaacagctgaacacctgcaactgcaaatgttttttgatccgacgtactgaaataggaagtcatgctcttcccaccctccacccaccagagtggaacccgctgcaaaatccccagccttaattcttgcttcaggacccagaccggtgtcttgctctagggcaacccagggcagaggggccaggtctgcccagcgtttaccactgctgtcaagccacagcccttggccaccatacgggccatcctcagtgaggcagccccccataggcttccgccaagctctggtcccgaagaggctgtgcgagcccttcccggccctccccagggccccccgccccctcctctgcctgctgcgtggaggcagccatgggaaggagcccaggggagctggcctgggggagcgaagcccatgttcgcttcctgacttagagctggggggggtggggggtggggcttgttcccctgcagtatctgttctgtgaagtttgttaaatgtaaggaaagcttaaattcttgtatctttaaaagagaaaatcttatttaacccttttgtgttctagatttacttacacacatagcctagagctcagttttagttttaacattgtgaaaatattaaaagaatcttgtaactttattcttttttctcctgctgaaaaaaaaaattaaaccaatcgtatgaaa

SEQ ID NO: 312495 - DNA, 3305 bp, Homo sapiens
gcggccgctgcgactccggagccggcggggggctccggtccttccctgcgccaccgcacaggacatctctctggctggggagcggcggtgagacccgccgagggcgtctgtgtccctcctcccccgcggtcctcggtgcgtccgcacgcccctcctcctcggctccctccttcttctctccgcgcctctccgccccctccccgtctccgcaggccgagtggtgcggcccgcctccagctgaccggcctggaatcccggctccgagccccggactcgcgcccgcccgcgcgcccgctccttccccctccccccgccccgagccccccgacgccgccgccaccgcctcctcagagcggggcccgggcccagccgccgccaccgctgccgccgccgagctccgccgccgccgagcaccatgggagacgctgggagcgagcgcagcaaagcgcccagcctgccgcctcgctgtccctgcggcttctgggggtccagcaagactatgaatctctgttccaaatgctttgctgattttcaaaagaaacagccagacgatgattccgctccaagtacaagtaacagccaatcagatttgttttccgaagagaccaccagtgacaacaacaatacctcgataaccacgccaactcttagtcccagccagcagccgcttccgacagaactgaatgtaacttcaccgagtaaagaggagtgtgggccatgcacagacacagctcatgtctcattaatcacaccaacaaaaagatcctgtggtacagattcacagtctgagaatgaggcttcaccagtaaaacggccacgactacttgagaatacggaacggtccgaggaaaccagtcgatctaaacagaagagtcgacgtcggtgcttccagtgccaaaccaaactggagctggtgcagcaggaattgggatcgtgtcgctgcggttatgtgttctgtatgttacatcgcctccccgagcagcacgactgcacattcgaccacatgggccgtggccgggaggaagccatcatgaaaatggtgaagctggaccggaaagtggggcgctcctgccagcgcatcggggaggggtgctcctgaaggccaggcatggccaccacgtgacgctgttcttagttcactaatgttagccttatttaggacaaagtcagccagacaccttgtactgggcacgcgtcagactgcagccagtccgtttcctttctttagccagccatcctggtactgtagtttaggggttgatggtggttgaaattgatttctggctggttactaaggtgcctgctagccattgtataaaattaaaacatgaagaatattttttttttgagcatggctagtggatttaaaacaacacatacctgtcactgctggagtcaaacttataaaaagccttaagtggaaagtgttccagacggagactctgagttaatagaggagtagaagctggtgttaaagttcccacgacgcacatggctttgccagaaactctgtttaatgatcggcctttcacctcttcacttatccttagtcccagtagccaggatacctgatggccacgtgtgccttggccacgggaggctgctgagattggccacgtggctgggctgggtggtggcctcactctcccacagagctggaaatggggggtgggggacagattcttacggaaatttttttacctgacttgctatgaaaaaactcatcacacaagaagagaaacagtaacctcactttgaaaattagctccactcaagactagtccacgaacgagacccgccttttctacacaggatccaaggtcacgagaagcagccagagtgccccgcctccgccggctctggtctgccattcgccagtgcagggatctggcacggaccagatgtggcgaatggcagcacagcgcggtggctgggtctgcacactggcctctgcagccagatttctatattgggagttttttaaaaagacatttcatagccaacaagaatcagtagaagtgctgggagcagcagctggggaagctgccgcccacgggctctgccccttccagctggagccgcccgtgcctccaggggccaagaggatgatgtcgtggcctccattctcgtttctatgcagccccatagtccaaggacacccagtccacatctaccatatagcaagtttagtaagggaaggcagcatacgtcccagggacagtgggtttggatctgtctagaacagcggtttgtggctgtggcccagctccgagagtgatatttgctctggtaggtgagggcctgagggtacatttctccacctgtgccccctcatgttcacagaggatttcagcagctgcaactgcgcacgccaggtggggaagggtgggggtgggcctggttgccccatgttaggaaatcactaccagtcaggtggggctggggctgggtggacaggatcaggattcccttgaaagcccaggcagggtgagcagtcccagtggtcctagtgccgcatcagatccaggtgggtgagggcaggaggcccctgcggaggcagcgtggatctgcccacacataggctactggaatagtttaacccagcaactttcctttttataaaacaacaaatggttcaactctgtctgcaaattaacagctgaacacctgcaactgcaaatgttttttgatccgacgtactgaaataggaagtcatgctcttcccaccctccacccaccagagtggaacccgctgcaaaatccccagccttaattcttgcttcaggacccagaccggtgtcttgctctagggcaacccagggcagaggggccaggtctgcccagcgtttaccactgctgtcaagccacagcccttggccaccatacgggcttccgccaagctctggtcccgaagaggctgtgcgagcccttcccggccctccccagggccccccgccccctcctctgcctgctgcgtggaggcagccatgggaaggagcccaggggagctggcctgggggagcgaagcccatgttcgcttcctgacttagagctggggggggtggggggtggggcttgttcccctgcagtatctgttctgtgaagtttgttaaatgtaaggaaagcttaaattcttgtatctttaaaagagaaaatcttatttaacccttttgtgttctagatttacttacacacatagcctagagctcagttttagttttaacattgtgaaaatattaaaagaatcttgtaactttattcttttttctcctgctgaaaaaaaaaattaaaccaatcgtatgaaa

SEQ ID NO: 312496 - DNA, 2495 bp, Homo sapiens
gcggccgctgcgactccggagccggcggggggctccggtccttccctgcgccaccgcacaggacatctctctggctggggagcggcggtgagacccgccgagggcgtctgtgtccctcctcccccgcggtcctcggtgcgtccgcacgcccctcctcctcggctccctccttcttctctccgcgcctctccgccccctccccgtctccgcaggccgagtggtgcggcccgcctccagctgaccggcctggaatcccggctccgagccccggactcgcgcccgcccgcgcgcccgctccttccccctccccccgccccgagccccccgacgccgccgccaccgcctcctcagagcggggcccgggcccagccgccgccaccgctgccgccgccgagctccgccgccgccgagcaccatgggagacgctgggagcgagcgcagcaaagcgcccagcctgccgcctcgctgtccctgcggcttctgggggtccagcaagactatgaatctctgttccaaatgctttgctgattttcaaaagaaacagccagacgatgattccgctccaagtacaagtaacagccaatcagatttgttttccgaagagaccaccagtgacaacaacaatacctcgataaccacgccaactcttagtcccagccagcagccgcttccgacagaactgaatgtaacttcaccgagtaaagaggagtgtgggccatgcacagacacagctcatgtctcattaatcacaccaacaaaaagatcctgtggtacagattcacagtctgagaatgaggcttcaccagtaaaacggccacgactacttgagaatacggaacggtccgaggaaaccagtcgatctaaacagaagagtcgacgtcggtgcttccagtgccaaaccaaactggagctggtgcagcaggaattgggatcgtgtcgctgcggttatgtgttctgtatgttacatcgcctccccgagcagcacgactgcacattcgaccacatgggccgtggccgggaggaagccatcatgaaaatggtgaagctggaccggaaagtggggcgctcctgccagcgcatcggggaggggtgctcctgaaggccaggcatggccaccacgtgacgctgttcttagttcactaatgttagccttatttaggacaaagtcagccagacaccttgtactgggcacgcgtcagactgcagccagtccgtttcctttctttagccagccatcctggtactgtagtttaggggttgatggtggttgaaattgatttctggctggttactaaggtgcctgctagccattgtataaaattaaaacatgaagaatattttttttttgagcatggctagtggatttaaaacaacacatacctgtcactgctggagtcaaacttataaaaagccttaagtggaaagtgttccagacggagactctgagttaatagaggagtagaagctggtgttaaagttcccacgacgcacatggctttgccagaaactctgtttaatgatcggcctttcacctcttcacttatccttagtcccagtagccaggatacctgatggccacgtgtgccttggccacgggaggctgctgagattggccacgtggctgggctgggtggtggcctcactctcccacagagctggaaatggggggtgggggacagattcttacggaaatttttttacctgacttgctatgaaaaaactcatcacacaagaagagaaacagtaacctcactttgaaaattagctccactcaagactagtccacgaacgagacccgccttttctacacaggatccaaggtcacgagaagcagccagagtgccccgcctccgccggctctggtctgccattcgccagtgcagggatctggcacggaccagatgtggcgaatggcagcacagcgcggtggctgggtctgcacactggcctctgcagccagatttctatattgggagttttttaaaaagacatttcatagccaacaagaatcagtagaagtgctgggagcagcagctggggaagctgccgcccacgggctctgccccttccagctggagccgcccgtgcctccaggggccaagaggatgatgtcgtggcctccattctcgtttctatgcagccccatagtccaaggacacccagtccacatctaccatatagcaagtttagtaagggaaggcagcatacgtcccagggacagtgggtttggatctgtctagaacagcggtttgtggctgtggcccagctccgagagtgatatttgctctggtaggtgagggcctgagggtacatttctccacctgtgccccctcatgttcacagaggatttcagcagctgcaactgcgcacgccaggtggggaagggtggggggttatatatttttatttcttactataacttttttttcgtttgtactgttattatattggaatttctaaatgttattcttttcctcattttcattcttttgttt

SEQ ID NO: 312497 - DNA, 1777 bp, Homo sapiens
gcggccgctgcgactccggagccggcggggggctccggtccttccctgcgccaccgcacaggacatctctctggctggggagcggcggtgagacccgccgagggcgtctgtgtccctcctcccccgcggtcctcggtgcgtccgcacgcccctcctcctcggctccctccttcttctctccgcgcctctccgccccctccccgtctccgcaggccgagtggtgcggcccgcctccagctgaccggcctggaatcccggctccgagccccggactcgcgcccgcccgcgcgcccgctccttccccctccccccgccccgagccccccgacgccgccgccaccgcctcctcagagcggggcccgggcccagccgccgccaccgctgccgccgccgagctccgccgccgccgagcaccatgggagacgctgggagcgagcgcagcaaagcgcccagcctgccgcctcgctgtccctgcggcttctgggggtccagcaagactatgaatctctgttccaaatgctttgctgattttcaaaagaaacagccagacgatgattccgctccaagtacaagtaacagccaatcagatttgttttccgaagagaccaccagtgacaacaacaatacctcgataaccacgccaactcttagtcccagccagcagccgcttccgacagaactgaatgtaacttcaccgagtaaagaggagtgtgggccatgcacagacacagctcatgtctcattaatcacaccaacaaaaagatcctgtggtacagattcacagtctgagaatgaggcttcaccagtaaaacggccacgactacttgagaatacggaacggtccgaggaaaccagtcgatctaaacagaagagtcgacgtcggtgcttccagtgccaaaccaaactggagctggtgcagcaggaattgggatcgtgtcgctgcggttatgtgttctgtatgttacatcgcctccccgagcagcacgactgcacattcgaccacatgggccgtggccgggaggaagccatcatgaaaatggtgaagctggaccggaaagtggggcgctcctgccagcgcatcggggaggggtgctcctgaaggccaggcatggccaccacgtgacgctgttcttagttcactaatgttagccttatttaggacaaagtcagccagacaccttgtactgggcacgcgtcagactgcagccagtccgtttcctttctttagccagccatcctggtactgtagtttaggggttgatggtggttgaaattgatttctggctggttactaaggtgcctgctagccattgtataaaattaaaacatgaagaatattttttttttgagcatggctagtggatttaaaacaacacatacctgtcactgctggagtcaaacttataaaaagccttaagtggaaagtgttccagacggagactctgagttaatagaggagtagaagctggtgttaaagttcccacgacgcacatggctttgccagaaactctgtttaatgatcggcctttcacctcttcacttatccttagtcccagtagccaggatacctgatggccacgtgtgccttggccacgggaggctgctgagattggccacgtggctgggctgggtggtggcctcactctcccgctattgaaacttctaaaactaggagttttagaagtttcaatagcacattgctgtcctgggggggtgtgctcggcgctcgaggtcttctttgtgctattgatctttcttgtgatttgggggtatcgag

SEQ ID NO: 312498 - DNA, 990 bp, Homo sapiens
gcggccgctgcgactccggagccggcggggggctccggtccttccctgcgccaccgcacaggacatctctctggctggggagcggcggtgagacccgccgagggcgtctgtgtccctcctcccccgcggtcctcggtgcgtccgcacgcccctcctcctcggctccctccttcttctctccgcgcctctccgccccctccccgtctccgcaggccgagtggtgcggcccgcctccagctgaccggcctggaatcccggctccgagccccggactcgcgcccgcccgcgcgcccgctccttccccctccccccgccccgagccccccgacgccgccgccaccgcctcctcagagcggggcccgggcccagccgccgccaccgctgccgccgccgagctccgccgccgccgagcaccatgggagacgctgggagcgagcgcagcaaagcgcccagcctgccgcctcgctgtccctgcggcttctgggggtccagcaagactatgaatctctgttccaaatgctttgctgattttcaaaagaaacagccagacgatgattccgctccaagtacaagtaacagccaatcagatttgttttccgaagagaccaccagtgacaacaacaatacctcgataaccacgccaactcttagtcccagccagcagccgcttccgacagaactgaatgtaacttcaccgagtaaagaggagtgtgggccatgcacagacacagctcatgtctcattaatcacaccaacaaaaagatcctgtggtacagattcacagtctgagaatgaggcttcaccagtaaaacggccacgactacttgagaatacggaacggtccgaggaaaccagtcgatctaaacagaagagtcgacgtcggtgcttccagtgccaaaccaaactggagctggtgcagcaggaattgggatcgtgtcgctgcgtatgtgttctgtatgttacatcgtctgccgctggggtcgcgagctc

SEQ ID NO: 312499 - DNA, 1085 bp, Homo sapiens
gcggccgctgcgactccggagccggcggggggctccggtccttccctgcgccaccgcacaggacatctctctggctggggagcggcggtgagacccgccgagggcgtctgtgtccctcctcccccgcggtcctcggtgcgtccgcacgcccctcctcctcggctccctccttcttctctccgcgcctctccgccccctccccgtctccgcaggccgagtggtgcggcccgcctccagctgaccggcctggaatcccggctccgagccccggactcgcgcccgcccgcgcgcccgctccttccccctccccccgccccgagccccccgacgccgccgccaccgcctcctcagagcggggcccgggcccagccgccgccaccgctgccgccgccgagctccgccgccgccgagcaccatgggagacgctgggagcgagcgcagcaaagcgcccagcctgccgcctcgctgtccctgcggcttctgggggtccagcaagactatgaatctctgttccaaatgctttgctgattttcaaaagaaacagccagacgatgattccgctccaagtacaagtaacagccaatcagatttgttttccgaagagaccaccagtgacaacaacaatacctcgataaccacgccaactcttagtcccagccagcagccgcttccgacagaactgaatgtaacttcaccgagtaaagaggagtgtgggccatgcacagacacagctcatgtctcattaatcacaccaacaaaaagatcctgtggtacagattcacagtctgagaatgaggcttcaccagtaaaacggccacgactacttgagaatacggaacggtccgaggaaaccagtcgatctaaacagaagagtcgacgtcggtgcttccagtgccaaaccaaactggagctggtgcagcaggaattgggatcgtgtcgctgcggtaagcatctcccccagtggcgtgatggagactatatccttaacaccttggcccagctttggaaatttaagtggctgaagtctttcgttcttcttctgagtactgtaagtttgctacagtagtgcatgcgatataggtttg

SEQ ID NO: 312500 - DNA, 2601 bp, Homo sapiens
taaaaatcaaagccgttgaactcatggacataaaaagtagaagattcacagtctgagaatgaggcttcaccagtaaaacggccacgactacttgagaatacggaacggtccgaggaaaccagtcgatctaaacagaagagtcgacgtcggtgcttccagtgccaaaccaaactggagctggtgcagcaggaattgggatcgtgtcgctgcggttatgtgttctgtatgttacatcgcctccccgagcagcacgactgcacattcgaccacatgggccgtggccgggaggaagccatcatgaaaatggtgaagctggaccggaaagtggggcgctcctgccagcgcatcggggaggggtgctcctgaaggccaggcatggccaccacgtgacgctgttcttagttcactaatgttagccttatttaggacaaagtcagccagacaccttgtactgggcacgcgtcagactgcagccagtccgtttcctttctttagccagccatcctggtactgtagtttaggggttgatggtggttgaaattgatttctggctggttactaaggtgcctgctagccattgtataaaattaaaacatgaagaatattttttttttgagcatggctagtggatttaaaacaacacatacctgtcactgctggagtcaaacttataaaaagccttaagtggaaagtgttccagacggagactctgagttaatagaggagtagaagctggtgttaaagttcccacgacgcacatggctttgccagaaactctgtttaatgatcggcctttcacctcttcacttatccttagtcccagtagccaggatacctgatggccacgtgtgccttggccacgggaggctgctgagattggccacgtggctgggctgggtggtggcctcactctcccacagagctggaaatggggggtgggggacagattcttacggaaatttttttacctgacttgctatgaaaaaactcatcacacaagaagagaaacagtaacctcactttgaaaattagctccactcaagactagtccacgaacgagacccgccttttctacacaggatccaaggtcacgagaagcagccagagtgccccgcctccgccggctctggtctgccattcgccagtgcagggatctggcacggaccagatgtggcgaatggcagcacagcgcggtggctgggtctgcacactggcctctgcagccagatttctatattgggagttttttaaaaagacatttcatagccaacaagaatcagtagaagtgctgggagcagcagctggggaagctgccgcccacgggctctgccccttccagctggagccgcccgtgcctccaggggccaagaggatgatgtcgtggcctccattctcgtttctatgcagccccatagtccaaggacacccagtccacatctaccatatagcaagtttagtaagggaaggcagcatacgtcccagggacagtgggtttggatctgtctagaacagcggtttgtggctgtggcccagctccgagagtgatatttgctctggtaggtgagggcctgagggtacatttctccacctgtgccccctcatgttcacagaggatttcagcagctgcaactgcgcacgccaggtggggaagggtgggggtgggcctggttgccccatgttaggaaatcactaccagtcaggtggggctggggctgggtggacaggatcaggattcccttgaaagcccaggcagggtgagcagtcccagtggtcctagtgccgcatcagatccaggtgggtgagggcaggaggcccctgcggaggcagcgtggatctgcccacacataggctactggaatagtttaacccagcaactttcctttttataaaacaacaaatggttcaactctgtctgcaaattaacagctgaacacctgcaactgcaaatgttttttgatccgacgtactgaaataggaagtcatgctcttcccaccctccacccaccagagtggaacccgctgcaaaatccccagccttaattcttgcttcaggacccagaccggtgtcttgctctagggcaacccagggcagaggggccaggtctgcccagcgtttaccactgctgtcaagccacagcccttggccaccatacgggccatcctcagtgaggcagccccccataggcttccgccaagctctggtcccgaagaggctgtgcgagcccttcccggccctccccagggccccccgccccctcctctgcctgctgcgtggaggcagccatgggaaggagcccaggggagctggcctgggggagcgaagcccatgttcgcttcctgacttagagctggggggggtggggggtggggcttgttcccctgcagtatctgttctgtgaagtttgttaaatgtaaggaaagcttaaattcttgtatctttaaaagagaaaatcttatttaacccttttgtgttctagatttacttacacacatagcctagagctcagttttagttttaacattgtgaaaatattaaaagaatcttgtaactttattcttttttctcctgctgaaaaaaaaaattaaaccaatcgtatgaaa

SEQ ID NO: 312501 - DNA, 3145 bp, Homo sapiens
gcggccgctgcgactccggagccggcggggggctccggtccttccctgcgccaccgcacaggacatctctctggctggggagcggcggtgagacccgccgagggcgtctgtgtccctcctcccccgcggtcctcggtgcgtccgcacgcccctcctcctcggctccctccttcttctctccgcgcctctccgccccctccccgtctccgcaggccgagtggtgcggcccgcctccagctgaccggcctggaatcccggctccgagccccggactcgcgcccgcccgcgcgcccgctccttccccctccccccgccccgagccccccgacgccgccgccaccgcctcctcagagcggggcccgggcccagccgccgccaccgctgccgccgccgagctccgccgccgccgagcaccatgggagacgctgggagcgagcgcagcaaagcgcccagcctgccgcctcgctgtccctgcggcttctgggggtccagcaagactatgaatctctgttccaaatgctttgctgattttcaaaagaaacagccagacgatgattccgctccaagtacaagtaacagccaatcagatttgttttccgaagagaccaccagtgacaacaacaatacctcgataaccacgccaactcttagtcccagccagcagccgcttccgacagaactgaatgtaacttcaccgagtaaagaggagtgtgggccatgcacagacacagctcatgtctcattaatcacaccaacaaaaagatcctgtggtacagattcacagtctgagaatgaggcttcaccagtaaaacggccacgactacttgagaatacggaacggtccgaggaaaccagtcgatctaaacagaagagtcgacgtcggtgcttccagtgccaaaccaaactggagctggtgcagcaggaattgggatcgtgtcgctgcggttatgtgttctgtatgttacatcgcctccccgagcagcacgactgcacattcgaccacatgggccgtggccgggaggaagccatcatgaaaatggtgaagctggaccggaaagtggggcgctcctgccagcgcatcggggaggggtgctcctgaaggccaggcatggccaccacgtgacgctgttcttagttcactaatgttagccttatttaggacaaagtcagccagacaccttgtactgggcacgcgtcagactgcagccagtccgtttcctttctttagccagccatcctggtactgtagtttaggggttgatggtggttgaaattgatttctggctggttactaaggtgcctgctagccattgtataaaattaaaacatgaagaatattttttttttgagcatggctagtggatttaaaacaacacatacctgtcactgctggagtcaaacttataaaaagccttaagtggaaagtgttccagacggagactctgagttaatagaggagtagaagctggtgttaaagttcccacgacgcacatggctttgccagaaactctgtttaatgatcggcctttcacctcttcacttatccttagtcccagtagccaggatacctgatggccacgtgtgccttggccacgggaggctgctgagattggccacgtggctgggctgggtggtggcctcactctcccacagagctggaaatggggggtgggggacagattcttacggaaatttttttacctgacttgctatgaaaaaactcatcacacaagaagagaaacagtaacctcactttgaaaattagctccactcaagactagtccacgaacgagacccgccttttctacacaggatccaaggtcacgagaagcagccagagtgccccgcctccgccggctctggtctgccattcgccagtgcagggatctggcacggaccagatgtggcgaatggcagcacagcgcggtggctgggtctgcacactggcctctgcagccagatttctatattgggagttttttaaaaagacatttcatagccaacaagaatcagtagaagtgctgggagcagcagctggggaagctgccgcccacgggctctgccccttccagctggagccgcccgtgcctccaggggccaagaggatgatgtcgtggcctccattctcgtttctatgcagccccatagtccaaggacacccagtccacatctaccatatagcaagtttagtaagggaaggcagcatacgtcccagggacagtgggtttggatctgtctagaacagcggtttgtggctgtggcccagctccgagagtgatatttgctctggtaggtgagggcctgagggtacatttctccacctgtgccccctcatgttcacagaggatttcagcagctgcaactgcgcacgccaggtggggaagggtgggggtgggcctggttgccccatgttaggaaatcactaccagtcaggtggggctggggctgggtggacaggatcaggattcccttgaaagcccaggcagggtgagcagtcccagtggtcctagtgccgcatcagatccaggtgggtgagggcaggaggcccctgcggaggcagcgtggatctgcccacacataggctactggaatagtttaacccagcaactttcctttttataaaacaacaaatggttcaactctgtctgcaaattaacagctgaacacctgcaactgcaaatgttttttgatccgacgtactgaaataggaagtcatgctcttcccaccctccacccaccagagtggaacccgctgcaaaatccccagccttaattcttgcttcaagggccccccgccccctcctctgcctgctgcgtggaggcagccatgggaaggagcccaggggagctggcctgggggagcgaagcccatgttcgcttcctgacttagagctggggggggtggggggtggggcttgttcccctgcagtatctgttctgtgaagtttgttaaatgtaaggaaagcttaaattcttgtatctttaaaagagaaaatcttatttaacccttttgtgttctagatttacttacacacatagcctagagctcagttttagttttaacattgtgaaaatattaaaagaatcttgtaactttattcttttttctcctgctgaaaaaaaaaattaaaccaatcgtatgaaa

SEQ ID NO: 312502 - DNA, 2477 bp, Homo sapiens
gcggccgctgcgactccggagccggcggggggctccggtccttccctgcgccaccgcacaggacatctctctggctggggagcggcggtgagacccgccgagggcgtctgtgtccctcctcccccgcggtcctcggtgcgtccgcacgcccctcctcctcggctccctccttcttctctccgcgcctctccgccccctccccgtctccgcaggccgagtggtgcggcccgcctccagctgaccggcctggaatcccggctccgagccccggactcgcgcccgcccgcgcgcccgctccttccccctccccccgccccgagccccccgacgccgccgccaccgcctcctcagagcggggcccgggcccagccgccgccaccgctgccgccgccgagctccgccgccgccgagcaccatgggagacgctgggagcgagcgcagcaaagcgcccagcctgccgcctcgctgtccctgcggcttctgggggtccagcaagactatgaatctctgttccaaatgctttgctgattttcaaaagaaacagccagacgatgattccgctccaagtacaagtaacagccaatcagatttgttttccgaagagaccaccagtgacaacaacaatacctcgataaccacgccaactcttagtcccagccagcagccgcttccgacagaactgaatgtaacttcaccgagtaaagaggagtgtgggccatgcacagacacagctcatgtctcattaatcacaccaacaaaaagatcctgtggtacagattcacagtctgagaatgaggcttcaccagtaaaacggccacgactacttgagaatacggaacggtccgaggaaaccagtcgatctaaacagaagagtcgacgtcggtgcttccagtgccaaaccaaactggagctggtgcagcaggaattgggatcgtgtcgctgcggttatgtgttctgtatgttacatcgcctccccgagcagcacgactgcacattcgaccacatgggccgtggccgggaggaagccatcatgaaaatggtgaagctggaccggaaagtggggcgctcctgccagcgcatcggggaggggtgctcctgaaggccaggcatggccaccacgtgacgctgttcttagttcactaatgttagccttatttaggacaaagtcagccagacaccttgtactgggcacgcgtcagactgcagccagtccgtttcctttctttagccagccatcctggtactgtagtttaggggttgatggtggttgaaattgatttctggctggttactaaggtgcctgctagccattgtataaaattaaaacatgaagaatattttttttttgagcatggctagtggatttaaaacaacacatacctgtcactgctggagtcaaacttataaaaagccttaagtggaaagtgttccagacggagactctgagttaatagaggagtagaagctggtgttaaagttcccacgacgcacatggctttgccagaaactctgtttaatgatcggcctttcacctcttcacttatccttagtcccagtagccaggatacctgatggccacgtgtgccttggccacgggaggctgctgagattggccacgtggctgggctgggtggtggcctcactctcccacagagctggaaatggggggtgggggacagattcttacggaaatttttttacctgacttgctatgaaaaaactcatcacacaagaagagaaacagtaacctcactttgaaaattagctccactcaagactagtccacgaacgagacccgccttttctacacaggatccaaggtcacgagaagcagccagagtgccccgcctccgccggctctggtctgccattcgccagtgcagggatctggcacggaccagatgtggcgaatggcagcacagcgcggtggctgggtctgcacactggcctctgcagccagatttctatattgggagttttttaaaaagacatttcatagccaacaagaatcagtagaagtgctgggagcagcagctggggaagctgccgcccacgggctctgccccttccagctggagccgcccgtgcctccaggggccaagaggatgatgtcgtggcctccattctcgtttctatgcagccccatagtccaaggacacccagtccacatctaccatatagcaagtttagtaagggaaggcagcatacgtcccagggacagtgggtttggatctgtctagaacagcggtttgtggctgtggcccagctccgagagtgatatttgctctggtaggtgagggcctgagggtacatttctccacctgtgccccctcatgttcacagaggatttcagcagctgcaactgcgcacgccaggtggggaagggtgggggtatttttatttttatttaacttttatattttttttcataaatttttattatgttttttttatattatatactacatgtattattt

SEQ ID NO: 312503 - DNA, 1020 bp, Homo sapiens
gcggccgctgcgactccggagccggcggggggctccggtccttccctgcgccaccgcacaggacatctctctggctggggagcggcggtgagacccgccgagggcgtctgtgtccctcctcccccgcggtcctcggtgcgtccgcacgcccctcctcctcggctccctccttcttctctccgcgcctctccgccccctccccgtctccgcaggccgagtggtgcggcccgcctccagctgaccggcctggaatcccggctccgagccccggactcgcgcccgcccgcgcgcccgctccttccccctccccccgccccgagccccccgacgccgccgccaccgcctcctcagagcggggcccgggcccagccgccgccaccgctgccgccgccgagctccgccgccgccgagcaccatgggagacgctgggagcgagcgcagcaaagcgcccagcctgccgcctcgctgtccctgcggcttctgggggtccagcaagactatgaatctctgttccaaatgctttgctgattttcaaaagaaacagccagacgatgattccgctccaagtacaagtaacagccaatcagatttgttttccgaagagaccaccagtgacaacaacaatacctcgataaccacgccaactcttagtcccagccagcagccgcttccgacagaactgaatgtaacttcaccgagtaaagaggagtgtgggccatgcacagacacagctcatgtctcattaatcacaccaacaaaaagatcctgtggtacagattcacagtctgagaatgaggcttcaccagtaaaacggccacgactacttgagaatacggaacggtccgaggaaaccagtcgatctaaacagaagagtcgacgtcggtgcttccagtgccaaaccaaactggagctggtgcagcaggaattgggatcgtgtcgctgcggtgtttctctggagagagatgtgtggcatttatagtctgatgccccctgaccacgttgccactcggacattctgtg

SEQ ID NO: 312504 - DNA, 2312 bp, Homo sapiens
  misc_feature (95)..(95): n is a, c, g, or t
  misc_feature (97)..(98): n is a, c, g, or t
  misc_feature (102)..(102): n is a, c, g, or t
  misc_feature (136)..(136): n is a, c, g, or t
taaggctggtactggcccggggttatgggatctggggctgggccgaggcccggtggcggatccagtgtctggagtcttggcggggcggggcgggnannggcnggagcggggggcggggctgggactcgatgcgacncaaagaacccgcgccatcccccggagcctccccagagctggccgcgcaggatgggcgccctcaggcccacgctgctgccgccttcgctgccgctgctgctgctgctaatgctaggaatgggatgctgggcccgggaggtgctggtccccgaggggcccttgtaccgcgtggctggcacagctgtctccatctcctgcaatgtgaccggctatgagggccctgcccagcagaacttcgagtggttcctgtataggcccgaggccccagatactgcactgggcattgtcagtaccaaggatacccagttctcctatgctgtcttcaagtcccgagtggtggcgggtgaggtgcaggtgcagcgcctacaaggtgatgccgtggtgctcaagattgcccgcctgcaggcccaggatgccggcatttatgagtgccacaccccctccactgatacccgctacctgggcagctacagcggcaaggtggagctgagagttcttccagatgtcctccaggtgtctgctgcccccccagggccccgaggccgccaggccccaacctcacccccacgcatgacggtgcatgaggggcaggagctggcactgggctgcctggcgaggacaagcacacagaagcacacacacctggcagtgtcctttgggcgatctgtgcccgaggcaccagttgggcggtcaactctgcaggaagtggtgggaatccggtcagacttggccgtggaggctggagctccctatgctgagcgattggctgcaggggagcttcgtctgggcaaggaagggaccgatcggtaccgcatggtagtagggggtgcccaggcaggggacgcaggcacctaccactgcactgccgctgagtggattcaggatcctgatggcagctgggcccagattgcagagaaaagggccgtcctggcccacgtggatgtgcagacgctgtccagccagctggcagtgacagtggggcctggtgaacgtcggatcggcccaggggagcccttggaactgctgtgcaatgtgtcaggggcacttcccccagcaggccgtcatgctgcatactctgtaggttgggagatggcacctgcgggggcacctgggcccggccgcctggtagcccagctggacacagagggtgtgggcagcctgggccctggctatgagggccgacacattgccatggagaaggtggcatccagaacataccggctacggctagaggctgccaggcctggtgatgcgggcacctaccgctgcctcgccaaagcctatgttcgagggtctgggacccggcttcgtgaagcagccagtgcccgttcccggcctctccctgtacatgtgcgggaggaaggtgtggtgctggaggctgtggcatggctagcaggaggcacagtgtaccgcggggagactgcctccctgctgtgcaacatctctgtgcggggtggccccccaggactgcggctggccgccagctggtgggtggagcgaccagaggacggagagctcagctctgtccctgcccagctggtgggtggcgtaggccaggatggtgtggcagagctgggagtccggcctggaggaggccctgtcagcgtagagctggtggggccccgaagccatcggctgagactacacagcttggggcccgaggatgaaggcgtgtaccactgtgcccccagcgcctgggtgcagcatgccgactacagctggtaccaggcgggcagtgcccgctcagggcctgttacagtctacccctacatgcatgccctggacaccctatttgtgcctctgctggtgggtacaggggtggccctagtcactggtgccactgtccttggtaccatcacttgctgcttcatgaagaggcttcgaaaacggtgatcccttactccccaggtcttgcaggtgtcgactgtcttccggcccagctccaagccctcctctggttgcctggacaccctctccctctgtccactcttcctttaatttatttgacctcccactacccagaatgggagacgtgcctccccttccccactccttccctcccaagcccctccctctggccttctgttcttgatctcttagggatcctatagggaggccatttcctgtcctggaattagtttttctaaaatgtgaataaacttgttttataaaaagca

SEQ ID NO: 312505 - DNA, 2235 bp, Homo sapiens
aataactcagtggctgatgtgggactcaaacccagagttcctcacccaggccagtgctcatcttatcatattaagacccctcctgggagaagaaatgtccttaagttgtccagtccactttccattcccaagaacgaagaagactgttgggttgaatagcctctactcctggacagtacaggacccagatctgggaaagagagtagagttagggaaggagttagaccatgtgacattctcactctcttaagtttctttgtcttctgagaagaaagagccgcttttctcagtatttcaaacagaggtcagtctcaaacataagggtgagtaggcgatgggctggttctatgaaattctacaagtatttattgagcgcctgtgctgtgcccagtactgcccttggcaccactgagttacagaagaaataatacaacatgcgatctttgccctctgggagctcacagtttatttagggagataggctatacacaggaaacagtaacaagggctgccagctcccagccctccctcactccagctgttctctccagttcttccagatgtcctccaggtgtctgctgcccccccagggccccgaggccgccaggccccaacctcacccccacgcatgacggtgcatgaggggcaggagctggcactgggctgcctggcgaggacaagcacacagaagcacacacacctggcagtgtcctttgggcgatctgtgcccgaggcaccagttgggcggtcaactctgcaggaagtggtgggaatccggtcagacttggccgtggaggctggagctccctatgctgagcgattggctgcaggggagcttcgtctgggcaaggaagggaccgatcggtaccgcatggtagtagggggtgcccaggcaggggacgcaggcacctaccactgcactgccgctgagtggattcaggatcctgatggcagctgggcccagattgcagagaaaagggccgtcctggcccacgtggatgtgcagacgctgtccagccagctggcagtgacagtggggcctggtgaacgtcggatcggcccaggggagcccttggaactgctgtgcaatgtgtcaggggcacttcccccagcaggccgtcatgctgcatactctgtaggttgggagatggcacctgcgggggcacctgggcccggccgcctggtagcccagctggacacagagggtgtgggcagcctgggccctggctatgagggccgacacattgccatggagaaggtggcatccagaacataccggctacggctagaggctgccaggcctggtgatgcgggcacctaccgctgcctcgccaaagcctatgttcgagggtctgggacccggcttcgtgaagcagccagtgcccgttcccggcctctccctgtacatgtgcgggaggaaggtgtggtgctggaggctgtggcatggctagcaggaggcacagtgtaccgcggggagactgcctccctgctgtgcaacatctctgtgcggggtggccccccaggactgcggctggccgccagctggtgggtggagcgaccagaggacggagagctcagctctgtccctgcccagctggtgggtggcgtaggccaggatggtgtggcagagctgggagtccggcctggaggaggccctgtcagcgtagagctggtggggccccgaagccatcggctgagactacacagcttggggcccgaggatgaaggcgtgtaccactgtgcccccagcgcctgggtgcagcatgccgactacagctggtaccaggcgggcagtgcccgctcagggcctgttacagtctacccctacatgcatgccctggacaccctatttgtgcctctgctggtgggtacaggggtggccctagtcactggtgccactgtccttggtaccatcacttgctgcttcatgaagaggcttcgaaaacggtgatcccttactccccaggtcttgcaggtgtcgactgtcttccggcccagctccaagccctcctctggttgcctggacaccctctccctctgtccactcttcctttaatttatttgacctcccactacccagaatgggagacgtgcctccccttccccactccttccctcccaagcccctccctctggccttctgttcttgatctcttagggatcctatagggaggccatttcctgtcctggaattagtttttctaaaatgtgaataaacttgttttataaaaagca

SEQ ID NO: 312506 - DNA, 2527 bp, Homo sapiens
agcagcgggaggggcggagggaggggattcggcagctccagttcagctcgctcggcgcacccacgcctcgctgccccgcttcctgccctcaacctgggcatgcgccccccacccttccggccccccagaacccgcgccatcccccggagcctccccagagctggccgcgcaggatgggcgccctcaggcccacgctgctgccgccttcgctgccgctgctgctgctgctaatgctaggaatgggatgctgggcccgggaggtgctggtccccgaggggcccttgtaccgcgtggctggcacagctgtctccatctcctgcaatgtgaccggctatgagggccctgcccagcagaacttcgagtggttcctgtataggcccgaggccccagatactgcactgggcattgtcagtaccaaggatacccagttctcctatgctgtcttcaagtcccgagtggtggcgggtgaggtgcaggtgcagcgcctacaaggtgatgccgtggtgctcaagattgcccgcctgcaggcccaggatgccggcatttatgagtgccacaccccctccactgatacccgctacctgggcagctacagcggcaaggtggagctgagagttcttccagatgtcctccaggtgtctgctgcccccccagggccccgaggccgccaggccccaacctcacccccacgcatgacggtgcatgaggggcaggagctggcactgggctgcctggcgaggacaagcacacagaagcacacacacctggcagtgtcctttgggcgatctgtgcccgaggcaccagttgggcggtcaactctgcaggaagtggtgggaatccggtcagacttggccgtggaggctggagctccctatgctgagcgattggctgcaggggagcttcgtctgggcaaggaagggaccgatcggtaccgcatggtagtagggggtgcccaggcaggggacgcaggcacctaccactgcactgccgctgagtggattcaggatcctgatggcagctgggcccagattgcagagaaaagggccgtcctggcccacgtggatgtgcagacgctgtccagccagctggcagtgacagtggggcctggtgaacgtcggatcggcccaggggagcccttggaactgctgtgcaatgtgtcaggggcacttcccccagcaggccgtcatgctgcatactctgtaggttgggagatggcacctgcgggggcacctgggcccggccgcctggtagcccagctggacacagagggtgtgggcagcctgggccctggctatgagggccgacacattgccatggagaaggtggcatccagaacataccggctacggctagaggctgccaggcctggtgatgcgggcacctaccgctgcctcgccaaagcctatgttcgagggtctgggacccggcttcgtgaagcagccagtgcccgttcccggcctctccctgtacatgtgcgggaggaaggtgagagggggctgggccctggacggggttcgaggattgtcaaccccttttccttctgtttccatgacccctccctctccgtcagctgtttgcaggccacagcctcacgctcctcttctaccaagattgtgggaataccctgagtttcctggggcggtgcttggcggcagccctaaccccatgctccctggccctgcaccctctgaccccatgtcctttgttctgcaggtgtggtgctggaggctgtggcatggctagcaggaggcacagtgtaccgcggggagactgcctccctgctgtgcaacatctctgtgcggggtggccccccaggactgcggctggccgccagctggtgggtggagcgaccagaggacggagagctcagctctgtccctgcccagctggtgggtggcgtaggccaggatggtgtggcagagctgggagtccggcctggaggaggccctgtcagcgtagagctggtggggccccgaagccatcggctgagactacacagcttggggcccgaggatgaaggcgtgtaccactgtgcccccagcgcctgggtgcagcatgccgactacagctggtaccaggcgggcagtgcccgctcagggcctgttacagtctacccctacatgcatgccctggacaccctatttgtgcctctgctggtgggtacaggggtggccctagtcactggtgccactgtccttggtaccatcacttgctgcttcatgaagaggcttcgaaaacggtgatcccttactccccaggtcttgcaggtgtcgactgtcttccggcccagctccaagccctcctctggttgcctggacaccctctccctctgtccactcttcctttaatttatttgacctcccactacccagaatgggagacgtgcctccccttccccactccttccctcccaagcccctccctctggccttctgttcttgatctcttagggatcctatagggaggccatttcctgtcctggaattagtttttctaaaatgtgaataaacttgttttataaaaagca

SEQ ID NO: 312507 - DNA, 2573 bp, Homo sapiens
agcagcgggaggggcggagggaggggattcggcagctccagttcagctcgctcggcgcacccacgcctcgctgccccgcttcctgccctcaacctgggcatgcgccccccacccttccggccccccagaacccgcgccatcccccggagcctccccagagctggccgcgcaggatgggcgccctcaggcccacgctgctgccgccttcgctgccgctgctgctgctgctaatgctaggaatgggatgctgggcccgggaggtgctggtccccgaggggcccttgtaccgcgtggctggcacagctgtctccatctcctgcaatgtgaccggctatgagggccctgcccagcagaacttcgagtggttcctgtataggcccgaggccccagatactgcactgggcattgtcagtaccaaggatacccagttctcctatgctgtcttcaagtcccgagtggtggcgggtgaggtgcaggtgcagcgcctacaaggtgatgccgtggtgctcaagattgcccgcctgcaggcccaggatgccggcatttatgagtgccacaccccctccactgatacccgctacctgggcagctacagcggcaaggtggagctgagagttcttccagatgtcctccaggtgtctgctgcccccccagggccccgaggccgccaggccccaacctcacccccacgcatgacggtgcatgaggggcaggagctggcactgggctgcctggcgaggacaagcacacagaagcacacacacctggcagtgtcctttgggcgatctgtgcccgaggcaccagttgggcggtcaactctgcaggaagtggtgggaatccggtcagacttggccgtggaggctggagctccctatgctgagcgattggctgcaggggagcttcgtctgggcaaggaagggaccgatcggtaccgcatggtagtagggggtgcccaggcaggggacgcaggcacctaccactgcactgccgctgagtggattcaggatcctgatggcagctgggcccagattgcagagaaaagggccgtcctggcccacgtggatgtgcagacgctgtccagccagctggcagtgacagtggggcctggtgaacgtcggatcggcccaggggagcccttggaactgctgtgcaatgtgtcaggggcacttcccccagcaggccgtcatgctgcatactctgtaggttgggagatggcacctgcgggggcacctgggcccggccgcctggtagcccagctggacacagagggtgtgggcagcctgggccctggctatgagggccgacacattgccatggagaaggtggcatccagaacataccggctacggctagaggctgccaggcctggtgatgcgggcacctaccgctgcctcgccaaagcctatgttcgagggtctgggacccggcttcgtgaagcagccagtgcccgttcccggcctctccctgtacatgtgcgggaggaaggtgtggtgctggaggctgtggcatggctagcaggaggcacagtgtaccgcggggagactgcctccctgctgtgcaacatctctgtgcggggtggccccccaggactgcggctggccgccagctggtgggtggagcgaccagaggacggagagctcagctctgtccctgcccagctggtgggtggcgtaggccaggatggtgtggcagagctgggagtccggcctggaggaggccctgtcagcgtagagctggtggggccccgaagccatcggctgagactacacagcttggggcccgaggatgaaggcgtgtaccactgtgcccccagcgcctgggtgcagcatgccgactacagctggtaccaggcgggcagtgcccgctcagggcctgttacagtctacccctacatgcatgccctggacaccctatttgtgcctctgctggtgggtacaggggtggccctagtcactggtgccactgtccttggtaccatcacttgctgcttcatgaagaggcttcgaaaacggtgatcccttactccccaggtcttgcaggtgtcgactgtcttccggcccagctccaagccctcctctggttgcctggacaccctctccctctgtccactcttcctttaatttatttgacctcccactacccagaatgggagacgtgcctccccttccccactccttccctcccaagcccctccctctggccttctgttcttgatctcttagggatcctatagggaggccatttcctgtcctggaattagtttttctaaaaaaaaaaaaaaaaaaaaaaaaaaaaaaaaaaaaaaaaggggggcgggcgcgcgccggggccccgggaaagagtttaaaaaacatccgtagtgggggacggggcccaaaagggaacgggaaaggggcaaaacacggggaaccaagagaaaacggggacagaaaaagggaggggattcacaacaaaaaaaaaaacgcccggggggaaacacaaagggtccgaacacaccgaaggggaaacagggggagacaaggggcacacaaaagggagcccaagaagcacagataaaataaccccgccagggg

SEQ ID NO: 312508 - DNA, 2642 bp, Homo sapiens
agcagcgggaggggcggagggaggggattcggcagctccagttcagctcgctcggcgcacccacgcctcgctgccccgcttcctgccctcaacctgggcatgcgccccccacccttccggccccccagaacccgcgccatcccccggagcctccccagagctggccgcgcaggatgggcgccctcaggcccacgctgctgccgccttcgctgccgctgctgctgctgctaatgctaggaatgggatgctgggcccgggaggtgctggtccccgaggggcccttgtaccgcgtggctggcacagctgtctccatctcctgcaatgtgaccggctatgagggccctgcccagcagaacttcgagtggttcctgtataggcccgaggccccagatactgcactgggcattgtcagtaccaaggatacccagttctcctatgctgtcttcaagtcccgagtggtggcgggtgaggtgcaggtgcagcgcctacaaggtgatgccgtggtgctcaagattgcccgcctgcaggcccaggatgccggcatttatgagtgccacaccccctccactgatacccgctacctgggcagctacagcggcaaggtggagctgagagttcttccagatgtcctccaggtgtctgctgcccccccagggccccgaggccgccaggccccaacctcacccccacgcatgacggtgcatgaggggcaggagctggcactgggctgcctggcgaggacaagcacacagaagcacacacacctggcagtgtcctttgggcgatctgtgcccgaggcaccagttgggcggtcaactctgcaggaagtggtgggaatccggtcagacttggccgtggaggctggagctccctatgctgagcgattggctgcaggggagcttcgtctgggcaaggaagggaccgatcggtaccgcatggtagtagggggtgcccaggcaggggacgcaggcacctaccactgcactgccgctgagtggattcaggatcctgatggcagctgggcccagattgcagagaaaagggccgtcctggcccacgtggatgtgcagacgctgtccagccagctggcagtgacagtggggcctggtgaacgtcggatcggcccaggggagcccttggaactgctgtgcaatgtgtcaggggcacttcccccagcaggccgtcatgctgcatactctgtaggttgggagatggcacctgcgggggcacctgggcccggccgcctggtagcccagctggacacagagggtgtgggcagcctgggccctggctatgagggccgacacattgccatggagaaggtggcatccagaacataccggctacggctagaggctgccaggcctggtgatgcgggcacctaccgctgcctcgccaaagcctatgttcgagggtctgggacccggcttcgtgaagcagccagtgcccgttcccggcctctccctgtacatgtgcgggaggaaggtgtggtgctggaggctgtggcatggctagcaggaggcacagtgtaccgcggggagactgcctccctgctgtgcaacatctctgtgcggggtggccccccaggactgcggctggccgccagctggtgggtggagcgaccagaggacggagagctcagctctgtccctgcccagctggtgggtggcgtaggccaggatggtgtggcagagctgggagtccggcctggaggaggccctgtcagcgtagagctggtggggccccgaagccatcggctgagactacacagcttggggcccgaggatgaaggcgtgtaccactgtgcccccagcgcctgggtgcagcatgccgactacagctggtaccaggcgggcagtgcccgctcagggcctgttacagtctacccctacatgcatggtgagtgacaccccctccaccctcctcactctgccttcctcctggcctctgccactggccttcccttcccatcttctgaccctcctgctactatctctctcctccacattatgtcacatgaagtctcaaaaaatccaacttccagccctgcagtgcccacctgcacggggtcctctgtggttgatgctgacttgcatgctgagggggcaggctgtgggcagggatgggggtgtctgtgaatggagaaggtgggttcagagaacttgatggggaaagcgcagaggcaagtgtatgggtggaggatgatggcatcctctctgaacagtcatcctctctcccccagccctggacaccctatttgtgcctctgctggtgggtacaggggtggccctagtcactggtgccactgtccttggtaccatcacttgctgcttcatgaagaggcttcgaaaacggtgatcccttactccccaggtcttgcaggtgtcgactgtcttccggcccagctccaagccctcctctggttgcctggacaccctctccctctgtccactcttcctttaatttatttgacctcccactacccagaatgggagacgtgcctccccttccccactccttccctcccaagcccctccctctggccttctgttcttgatctcttagggatcctatagggaggccatttcctgtcctggaattagtttttctaaaatgtgaataaacttgttttataaaaagca

SEQ ID NO: 312509 - DNA, 2498 bp, Homo sapiens
agcagcgggaggggcggagggaggggattcggcagctccagttcagctcgctcggcgcacccacgcctcgctgccccgcttcctgccctcaacctgggcatgcgccccccacccttccggccccccagaacccgcgccatcccccggagcctccccagagctggccgcgcaggatgggcgccctcaggcccacgctgctgccgccttcgctgccgctgctgctgctgctaatgctaggaatgggatgctgggcccgggaggtgctggtccccgaggggcccttgtaccgcgtggctggcacagctgtctccatctcctgcaatgtgaccggctatgagggccctgcccagcagaacttcgagtggttcctgtataggcccgaggccccagatactgcactgggcattgtcagtaccaaggatacccagttctcctatgctgtcttcaagtcccgagtggtggcgggtgaggtgcaggtgcagcgcctacaaggtgatgccgtggtgctcaagattgcccgcctgcaggcccaggatgccggcatttatgagtgccacaccccctccactgatacccgctacctgggcagctacagcggcaaggtggagctgagagttcttccagatgtcctccaggtgtctgctgcccccccagggccccgaggccgccaggccccaacctcacccccacgcatgacggtgcatgaggggcaggagctggcactgggctgcctggcgaggacaagcacacagaagcacacacacctggcagtgtcctttgggcgatctgtgcccgaggcaccagttgggcggtcaactctgcaggaagtggtgggaatccggtcagacttggccgtggaggctggagctccctatgctgagcgattggctgcaggggagcttcgtctgggcaaggaagggaccgatcggtaccgcatggtagtagggggtgcccaggcaggggacgcaggcacctaccactgcactgccgctgagtggattcaggatcctgatggcagctgggcccagattgcagagaaaagggccgtcctggcccacgtggatgtgcagacgctgtccagccagctggcagtgacagtggggcctggtgaacgtcggatcggcccaggggagcccttggaactgctgtgcaatgtgtcaggggcacttcccccagcaggccgtcatgctgcatactctgtaggttgggagatggcacctgcgggggcacctgggcccggccgcctggtagcccagctggacacagagggtgtgggcagcctgggccctggctatgagggccgacacattgccatggagaaggtggcatccagaacataccggctacggctagaggctgccaggcctggtgatgcgggcacctaccgctgcctcgccaaagcctatgttcgagggtctgggacccggcttcgtgaagcagccagtgcccgttcccggcctctccctgtacatgtgcgggaggaaggtgtggtgctggaggctgtggcatggctagcaggaggcacagtgtaccgcggggagactgcctccctgctgtgcaacatctctgtgcggggtggccccccaggactgcggctggccgccagctggtgggtggagcgaccagaggacggagagctcagctctgtccctgcccagctggtgggtggcgtaggccaggatggtgtggcagagctgggagtccggcctggaggaggccctgtcagcgtagagctggtggggccccgaagccatcggctgagactacacagcttggggcccgaggatgaaggcgtgtaccactgtgcccccagcgcctgggtgcagcatgccgactacagctggtaccaggcgggcagtgcccgctcagggcctgttacagtctacccctacatgcatgccctggacaccctatttgtgcctctgctggtgggtacaggggtggccctagtcactggtgccactgtccttggtaccatcacttgctgcttcatgaagaggcttcgaaaacggtgatcccttactccccaggtgagggaaaagaaccccccaaccttgttttcattgggcttcccacccccaagtcctgaaccaagctgctccctcccaggccccacctggaggaggagtaggcagctcagatccacagggccctgttaaggggtggaggccgcgagggagccccactcagggctctctgtccttagcccacaccgggcacccttttcaggtcttgcaggtgtcgactgtcttccggcccagctccaagccctcctctggttgcctggacaccctctccctctgtccactcttcctttaatttatttgacctcccactacccagaatgggagacgtgcctccccttccccactccttccctcccaagcccctccctctggccttctgttcttgatctcttagggatcctatagggaggccatttcctgtcctggaattagtttttctaaaatgtgaataaacttgttttataaaaagca

SEQ ID NO: 312510 - DNA, 2841 bp, Homo sapiens
agcagcgggaggggcggagggaggggattcggcagctccagttcagctcgctcggcgcacccacgcctcgctgccccgcttcctgccctcaacctgggcatgcgccccccacccttccggccccccagaacccgcgccatcccccggagcctccccagagctggccgcgcaggatgggcgccctcaggcccacgctgctgccgccttcgctgccgctgctgctgctgctaatgctaggaatgggatgctgggcccgggaggtgctggtccccgaggggcccttgtaccgcgtggctggcacagctgtctccatctcctgcaatgtgaccggctatgagggccctgcccagcagaacttcgagtggttcctgtataggcccgaggccccagatactgcactgggcattgtcagtaccaaggatacccagttctcctatgctgtcttcaagtcccgagtggtggcgggtgaggtgcaggtgcagcgcctacaaggtgatgccgtggtgctcaagattgcccgcctgcaggcccaggatgccggcatttatgagtgccacaccccctccactgatacccgctacctgggcagctacagcggcaaggtggagctgagagttcttccagatgtcctccaggtgtctgctgcccccccagggccccgaggccgccaggccccaacctcacccccacgcatgacggtgcatgaggggcaggagctggcactgggctgcctggcgaggacaagcacacagaagcacacacacctggcagtgtcctttgggcgatctgtgcccgaggcaccagttgggcggtcaactctgcaggaagtggtgggaatccggtcagacttggccgtggaggctggagctccctatgctgagcgattggctgcaggggagcttcgtctgggcaaggaagggaccgatcggtaccgcatggtagtagggggtgcccaggcaggggacgcaggcacctaccactgcactgccgctgagtggattcaggatcctgatggcagctgggcccagattgcagagaaaagggccgtcctggcccacgtggatgtgcagacgctgtccagccagctggcagtgacagtggggcctggtgaacgtcggatcggcccaggggagcccttggaactgctgtgcaatgtgtcaggggcacttcccccagcaggccgtcatgctgcatactctgtaggttgggagatggcacctgcgggggcacctgggcccggccgcctggtagcccagctggacacagagggtgtgggcagcctgggccctggctatgagggccgacacattgccatggagaaggtggcatccagaacataccggctacggctagaggctgccaggcctggtgatgcgggcacctaccgctgcctcgccaaagcctatgttcgagggtctgggacccggcttcgtgaagcagccagtgcccgttcccggcctctccctgtacatgtgcgggaggaaggtgtggtgctggaggctgtggcatggctagcaggaggcacagtgtaccgcggggagactgcctccctgctgtgcaacatctctgtgcggggtggccccccaggactgcggctggccgccagctggtgggtggagcgaccagaggacggagagctcagctctgtccctgcccagctggtgggtggcgtaggccaggatggtgtggcagagctgggagtccggcctggaggaggccctgtcagcgtagagctggtggggccccgaagccatcggctgagactacacagcttggggcccgaggatgaaggcgtgtaccactgtgcccccagcgcctgggtgcagcatgccgactacagctggtaccaggcgggcagtgcccgctcagggcctgttacagtctacccctacatgcatggtgagtgacaccccctccaccctcctcactctgccttcctcctggcctctgccactggccttcccttcccatcttctgaccctcctgctactatctctctcctccacattatgtcacatgaagtctcaaaaaatccaacttccagccctgcagtgcccacctgcacggggtcctctgtggttgatgctgacttgcatgctgagggggcaggctgtgggcagggatgggggtgtctgtgaatggagaaggtgggttcagagaacttgatggggaaagcgcagaggcaagtgtatgggtggaggatgatggcatcctctctgaacagtcatcctctctcccccagccctggacaccctatttgtgcctctgctggtgggtacaggggtggccctagtcactggtgccactgtccttggtaccatcacttgctgcttcatgaagaggcttcgaaaacggtgatcccttactccccaggtgagggaaaagaaccccccaaccttgttttcattgggcttcccacccccaagtcctgaaccaagctgctccctcccaggccccacctggaggaggagtaggcagctcagatccacagggccctgttaaggggtggaggccgcgagggagccccactcagggctctctgtccttagcccacaccgggcacccttttcaggtcttgcaggtgtcgactgtcttccggcccagctccaagccctcctctggttgcctggacaccctctccctctgtccactcttcctttaatttatttgacctcccactacccagaatgggagacgtgcctccccttccccactccttccctcccaagcccctccctctggccttctgttcttgatctcttagggatcctatagggaggccatttcctgtcctggaattagtttttctaaaatgtgaataaacttgttttataaaaagca

SEQ ID NO: 312511 - DNA, 1396 bp, Homo sapiens
agcagcgggaggggcggagggaggggattcggcagctccagttcagctcgctcggcgcacccacgcctcgctgccccgcttcctgccctcaacctgggcatgcgccccccacccttccggccccccagaacccgcgccatcccccggagcctccccagagctggccgcgcaggatgggcgccctcaggcccacgctgctgccgccttcgctgccgctgctgctgctgctaatgctaggaatgggatgctgggcccgggaggtgctggtccccgaggggcccttgtaccgcgtggctggcacagctgtctccatctcctgcaatgtgaccggctatgagggccctgcccagcagaacttcgagtggttcctgtataggcccgaggccccagatactgcactgggcattgtcagtaccaaggatacccagttctcctatgctgtcttcaagtcccgagtggtggcgggtgaggtgcaggtgcagcgcctacaaggtgatgccgtggtgctcaagattgcccgcctgcaggcccaggatgccggcatttatgagtgccacaccccctccactgatacccgctacctgggcagctacagcggcaaggtggagctgagagttcttccagatgtcctccaggtgtctgctgcccccccagggccccgaggccgccaggccccaacctcacccccacgcatgacggtgcatgaggggcaggagctggcactgggctgcctggcgaggacaagcacacagaagcacacacacctggcagtgtcctttgggcgatctgtgcccgaggcaccagttgggcggtcaactctgcaggaagtggtgggaatccggtcagacttggccgtggaggctggagctccctatgctgagcgattggctgcaggggagcttcgtctgggcaaggaagggaccgatcggtaccgcatggtagtagggggtgcccaggcaggggacgcaggcacctaccactgcactgccgctgagtggattcaggatcctgatggcagctgggcccagattgcagagaaaagggccgtcctggcccacgtggatgtgcagacgctgtgtaagtgccacttatacatcccactgtgggagctgggagggacagtatcctggtgggcactgtggccacagggggtaccagatagccatcatctgactccaaggaactcatcttccacagagtgagcagccttgctagcatttctctcccccggcccttgatgggttttctctgctcagaaattgggtatagagataggaggcccatgctgaggggtgagattcaagcccctaaatagaaagatggtcatacctagtgagggggagacaggaggttttgaagttgctgctgtcaagtaggaaacaggaagttggggaat

SEQ ID NO: 312512 - DNA, 745 bp, Homo sapiens
gcccgctctccgacggggtggggtgaggacaggacaagagatctgggtgtggaaggatggccgggtttctgcagcagcaggaggaaagggtgggagcacacaggcacagaacactgtgagcaggactgccaggccagtgtcacaagcgctaccatctgggtgtagacagacctgagctgacaaagctgggggagcaaggccaacggctttaaacacaagctcaggggcttggggtttatcccgagggcacagggcaccccgcctgggtgcagcatgccgactacagctggtaccaggcgggcagtgcccgctcagggcctgttacagtctacccctacatgcatgccctggacaccctatttgtgcctctgctggtgggtacaggggtggccctagtcactggtgccactgtccttggtaccatcacttgctgcttcatgaagaggcttcgaaaacggtgatcccttactccccaggtcttgcaggtgtcgactgtcttccggcccagctccaagccctcctctggttgcctggacaccctctccctctgtccactcttcctttaatttatttgacctcccactacccagaatgggagacgtgcctccccttccccactccttccctcccaagcccctccctctggccttctgttcttgatctcttagggatcctatagggaggccatttcctgtcctggaattagtttttctaaaatgtgaataaacttgttttataaaaagca

SEQ ID NO: 312513 - DNA, 731 bp, Homo sapiens
agcagcgggaggggcggagggaggggattcggcagctccagttcagctcgctcggcgcacccacgcctcgctgccccgcttcctgccctcaacctgggcatgcgccccccacccttccggccccccagaacccgcgccatcccccggagcctccccagagctggccgcgcaggatgggcgccctcaggcccacgctgctgccgccttcgctgccgctgctgctgctgctaatgctaggaatgggatgctgggcccgggaggtgctggtccccgaggggcccttgtaccgcgtggctggcacagctgtctccatctcctgcaatgtgaccggctatgagggccctgcccagcagaacttcgagtggttcctgtataggcccgaggccccagatactgcactgggcattgtcagtaccaaggatacccagttctcctatgctgtcttcaagtcccgagtggtggcgggtgaggtgcaggtgcagcgcctacaaggtgatgccgtggtgctcaagattgcccgcctgcaggcccaggatgccggcatttatgagtgccacaccccctccactgatacccgctacctgggcagctacagcggcaaggtggagctgagaggtactgggccctgggacggggtggagccacacaccctctcaaggcagaaagtcaaggccacaagtgacctatctagttgccccttaggttttgtagccaaggaacttgaggcccaa

SEQ ID NO: 312514 - DNA, 2299 bp, Homo sapiens
agcagcgggaggggcggagggaggggattcggcagctccagttcagctcgctcggcgcacccacgcctcgctgccccgcttcctgccctcaacctgggcatgcgccccccacccttccggccccccagaacccgcgccatcccccggagcctccccagagctggccgcgcaggatgggcgccctcaggcccacgctgctgccgccttcgctgccgctgctgctgctgctaatgctaggaatgggatgctgggcccgggaggtgctggtccccgaggggcccttgtaccgcgtggctggcacagctgtctccatctcctgcaatgtgaccggctatgagggccctgcccagcagaacttcgagtggttcctgtataggcccgaggccccagatactgcactgggcattgtcagtaccaaggatacccagttctcctatgctgtcttcaagtcccgagtggtggcgggtgaggtgcaggtgcagcgcctacaaggtgatgccgtggtgctcaagattgcccgcctgcaggcccaggatgccggcatttatgagtgccacaccccctccactgatacccgctacctgggcagctacagcggcaaggtggagctgagagttcttccagatgtcctccaggtgtctgctgcccccccagggccccgaggccgccaggccccaacctcacccccacgcatgacggtgcatgaggggcaggagctggcactgggctgcctggcgaggacaagcacacagaagcacacacacctggcagtgtcctttgggcgatctgtgcccgaggcaccagttgggcggtcaactctgcaggaagtggtgggaatccggtcagacttggccgtggaggctggagctccctatgctgagcgattggctgcaggggagcttcgtctgggcaaggaagggaccgatcggtaccgcatggtagtagggggtgcccaggcaggggacgcaggcacctaccactgcactgccgctgagtggattcaggatcctgatggcagctgggcccagattgcagagaaaagggccgtcctggcccacgtggatgtgcagacgctgtccagccagctggcagtgacagtggggcctggtgaacgtcggatcggcccaggggagcccttggaactgctgtgcaatgtgtcaggggcacttcccccagcaggccgtcatgctgcatactctgtaggttgggagatggcacctgcgggggcacctgggcccggccgcctggtagcccagctggacacagagggtgtgggcagcctgggccctggctatgagggccgacacattgccatggagaaggtggcatccagaacataccggctacggctagaggctgccaggcctggtgatgcgggcacctaccgctgcctcgccaaagcctatgttcgagggtctgggacccggcttcgtgaagcagccagtgcccgttcccggcctctccctgtacatgtgcgggaggaaggtgtggtgctggaggctgtggcatggctagcaggaggcacagtgtaccgcggggagactgcctccctgctgtgcaacatctctgtgcggggtggccccccaggactgcggctggccgccagctggtgggtggagcgaccagaggacggagagctcagctctgtccctgcccagctggtgggtggcgtaggccaggatggtgtggcagagctgggagtccggcctggaggaggccctgtcagcgtagagctggtggggccccgaagccatcggctgagactacacagcttggggcccgaggatgaaggcgtgtaccactgtgcccccagcgcctgggtgcagcatgccgactacagctggtaccaggcgggcagtgcccgctcagggcctgttacagtctacccctacatgcatgccctggacaccctatttgtgcctctgctggtgggtacaggggtggccctagtcactggtgccactgtccttggtaccatcacttgctgcttcatgaagaggcttcgaaaacggtgatcccttactccccaggtcttgcaggtgtcgactgtcttccggcccagctccaagccctcctctggttgcctggacaccctctccctctgtccactcttcctttaatttatttgacctcccactacccagaatgggagacgtgcctccccttccccactccttccctcccaagcccctccctctggccttctgttcttgatctcttagggatcctatagggaggccatttcctgtcctggaattagtttttctaaaatgtgaataaacttgttttataaaaagca

SEQ ID NO: 312515 - DNA, 2168 bp, Homo sapiens
ggtctcctttccttttgtaggcagagatcaagaatggtgcttgtggcggcagagggcatggaatgaggaaccaggcatctccaactccttctgcctttccctacaggaatgggatgctgggcccgggaggtgctggtccccgaggggcccttgtaccgcgtggctggcacagctgtctccatctcctgcaatgtgaccggctatgagggccctgcccagcagaacttcgagtggttcctgtataggcccgaggccccagatactgcactgggcattgtcagtaccaaggatacccagttctcctatgctgtcttcaagtcccgagtggtggcgggtgaggtgcaggtgcagcgcctacaaggtgatgccgtggtgctcaagattgcccgcctgcaggcccaggatgccggcatttatgagtgccacaccccctccactgatacccgctacctgggcagctacagcggcaaggtggagctgagagttcttccagatgtcctccaggtgtctgctgcccccccagggccccgaggccgccaggccccaacctcacccccacgcatgacggtgcatgaggggcaggagctggcactgggctgcctggcgaggacaagcacacagaagcacacacacctggcagtgtcctttgggcgatctgtgcccgaggcaccagttgggcggtcaactctgcaggaagtggtgggaatccggtcagacttggccgtggaggctggagctccctatgctgagcgattggctgcaggggagcttcgtctgggcaaggaagggaccgatcggtaccgcatggtagtagggggtgcccaggcaggggacgcaggcacctaccactgcactgccgctgagtggattcaggatcctgatggcagctgggcccagattgcagagaaaagggccgtcctggcccacgtggatgtgcagacgctgtccagccagctggcagtgacagtggggcctggtgaacgtcggatcggcccaggggagcccttggaactgctgtgcaatgtgtcaggggcacttcccccagcaggccgtcatgctgcatactctgtaggttgggagatggcacctgcgggggcacctgggcccggccgcctggtagcccagctggacacagagggtgtgggcagcctgggccctggctatgagggccgacacattgccatggagaaggtggcatccagaacataccggctacggctagaggctgccaggcctggtgatgcgggcacctaccgctgcctcgccaaagcctatgttcgagggtctgggacccggcttcgtgaagcagccagtgcccgttcccggcctctccctgtacatgtgcgggaggaaggtgtggtgctggaggctgtggcatggctagcaggaggcacagtgtaccgcggggagactgcctccctgctgtgcaacatctctgtgcggggtggccccccaggactgcggctggccgccagctggtgggtggagcgaccagaggacggagagctcagctctgtccctgcccagctggtgggtggcgtaggccaggatggtgtggcagagctgggagtccggcctggaggaggccctgtcagcgtagagctggtggggccccgaagccatcggctgagactacacagcttggggcccgaggatgaaggcgtgtaccactgtgcccccagcgcctgggtgcagcatgccgactacagctggtaccaggcgggcagtgcccgctcagggcctgttacagtctacccctacatgcatgccctggacaccctatttgtgcctctgctggtgggtacaggggtggccctagtcactggtgccactgtccttggtaccatcacttgctgcttcatgaagaggcttcgaaaacggtgatcccttactccccaggtcttgcaggtgtcgactgtcttccggcccagctccaagccctcctctggttgcctggacaccctctccctctgtccactcttcctttaatttatttgacctcccactacccagaatgggagacgtgcctccccttccccactccttccctcccaagcccctccctctggccttctgttcttgatctcttagggatcctatagggaggccatttcctgtcctggaattagtttttctaaaatgtgaataaacttgttttataaaaagca

SEQ ID NO: 312516 - DNA, 2238 bp, Homo sapiens
ccacagctcatgaggagggatgctccctagtttgtgtccctccacaacaaaacaagagggtggtcgtcgctcctactcacaatgagctgaacgacaggatgagtttgctgtgtgttgcctccactccggagtctgcttgattatatgaaacctaccccgccgcggcgcgcgcgtttcttatataatataacctaccactccagccatacgctagacgacccctccttcttctcttacatataaacaaagttggtggcgtcgtagataagtatcaccaccccccccacgtgaggataaataatatgagcccccccccctttttttttttttttttttttttttttttttttttttttttttttttttttttttttttttttttttttttttttttttttttttttttttttttttttttttttttttttttttttttttttttttctttgccctctgggagctcacagtttatttagggagataggctatacacaggaaacagtaacaagggctgccagctcccagccctccctcactccagctgttctctccagttcttccagatgtcctccaggtgtctgctgcccccccagggccccgaggccgccaggccccaacctcacccccacgcatgacggtgcatgaggggcaggagctggcactgggctgcctggcgaggacaagcacacagaagcacacacacctggcagtgtcctttgggcgatctgtgcccgaggcaccagttgggcggtcaactctgcaggaagtggtgggaatccggtcagacttggccgtggaggctggagctccctatgctgagcgattggctgcaggggagcttcgtctgggcaaggaagggaccgatcggtaccgcatggtagtagggggtgcccaggcaggggacgcaggcacctaccactgcactgccgctgagtggattcaggatcctgatggcagctgggcccagattgcagagaaaagggccgtcctggcccacgtggatgtgcagacgctgtccagccagctggcagtgacagtggggcctggtgaacgtcggatcggcccaggggagcccttggaactgctgtgcaatgtgtcaggggcacttcccccagcaggccgtcatgctgcatactctgtaggttgggagatggcacctgcgggggcacctgggcccggccgcctggtagcccagctggacacagagggtgtgggcagcctgggccctggctatgagggccgacacattgccatggagaaggtggcatccagaacataccggctacggctagaggctgccaggcctggtgatgcgggcacctaccgctgcctcgccaaagcctatgttcgagggtctgggacccggcttcgtgaagcagccagtgcccgttcccggcctctccctgtacatgtgcgggaggaaggtgtggtgctggaggctgtggcatggctagcaggaggcacagtgtaccgcggggagactgcctccctgctgtgcaacatctctgtgcggggtggccccccaggactgcggctggccgccagctggtgggtggagcgaccagaggacggagagctcagctctgtccctgcccagctggtgggtggcgtaggccaggatggtgtggcagagctgggagtccggcctggaggaggccctgtcagcgtagagctggtggggccccgaagccatcggctgagactacacagcttggggcccgaggatgaaggcgtgtaccactgtgcccccagcgcctgggtgcagcatgccgactacagctggtaccaggcgggcagtgcccgctcagggcctgttacagtctacccctacatgcatgccctggacaccctatttgtgcctctgctggtgggtacaggggtggccctagtcactggtgccactgtccttggtaccatcacttgctgcttcatgaagaggcttcgaaaacggtgatcccttactccccaggtcttgcaggtgtcgactgtcttccggcccagctccaagccctcctctggttgcctggacaccctctccctctgtccactcttcctttaatttatttgacctcccactacccagaatgggagacgtgcctccccttccccactccttccctcccaagcccctccctctggccttctgttcttgatctcttagggatcctatagggaggccatttcctgtcctggaattagtttttctaaaatgtgaataaacttgttttataaaaagca

SEQ ID NO: 312517 - DNA, 2601 bp, Homo sapiens
agcagcgggaggggcggagggaggggattcggcagctccagttcagctcgctcggcgcacccacgcctcgctgccccgcttcctgccctcaacctgggcatgcgccccccacccttccggccccccagaacccgcgccatcccccggagcctccccagagctggccgcgcaggatgggcgccctcaggcccacgctgctgccgccttcgctgccgctgctgctgctgctaatgctaggaatgggatgctgggcccgggaggtgctggtccccgaggggcccttgtaccgcgtggctggcacagctgtctccatctcctgcaatgtgaccggctatgagggccctgcccagcagaacttcgagtggttcctgtataggcccgaggccccagatactgcactgggcattgtcagtaccaaggatacccagttctcctatgctgtcttcaagtcccgagtggtggcgggtgaggtgcaggtgcagcgcctacaaggtgatgccgtggtgctcaagattgcccgcctgcaggcccaggatgccggcatttatgagtgccacaccccctccactgatacccgctacctgggcagctacagcggcaaggtggagctgagagttcttccagatgtcctccaggtgtctgctgcccccccagggccccgaggccgccaggccccaacctcacccccacgcatgacggtgcatgaggggcaggagctggcactgggctgcctggcgaggacaagcacacagaagcacacacacctggcagtgtcctttgggcgatctgtgcccgaggcaccagttgggcggtcaactctgcaggaagtggtgggaatccggtcagacttggccgtggaggctggagctccctatgctgagcgattggctgcaggggagcttcgtctgggcaaggaagggaccgatcggtaccgcatggtagtagggggtgcccaggcaggggacgcaggcacctaccactgcactgccgctgagtggattcaggatcctgatggcagctgggcccagattgcagagaaaagggccgtcctggcccacgtggatgtgcagacgctgtccagccagctggcagtgacagtggggcctggtgaacgtcggatcggcccaggggagcccttggaactgctgtgcaatgtgtcaggggcacttcccccagcaggccgtcatgctgcatactctgtaggttgggagatggcacctgcgggggcacctgggcccggccgcctggtagcccagctggacacagagggtgtgggcagcctgggccctggctatgagggccgacacattgccatggagaaggtggcatccagaacataccggctacggctagaggctgccaggcctggtgatgcgggcacctaccgctgcctcgccaaagcctatgttcgagggtctgggacccggcttcgtgaagcagccagtgcccgttcccggcctctccctgtacatgtgcgggaggaaggtgtggtgctggaggctgtggcatggctagcaggaggcacagtgtaccgcggggagactgcctccctgctgtgcaacatctctgtgcggggtggccccccaggactgcggctggccgccagctggtgggtggagcgaccagaggacggagagctcagctctgtccctgcccagctggtgggtggcgtaggccaggatggtgtggcagagctgggagtccggcctggaggaggccctgtcagcgtagagctggtggggccccgaagccatcggctgagactacacagcttggggcccgaggatgaaggcgtgtaccactgtgcccccagcgcctgggtgcagcatgccgactacagctggtaccaggcgggcagtgcccgctcagggcctgttacagtctacccctacatgcatgccctggacaccctatttgtgcctctgctggtgggtacaggggtggccctagtcactggtgccactgtccttggtaccatcacttgctgcttcatgaagaggcttcgaaaacggtgatcccttactccccaggtcttgcaggtgtcgactgtcttccggcccagctccaagccctcctctggttgcctggacaccctctccctctgtccactcttcctttaatttatttgacctcccactacccagaatgggagacgtgcctccccttccccactccttccctcccaagcccctccctctggccttctgttcttgatctcttagggatcctatagggaggccatttcctgtcctggaattagtttttctaaaatgtgaataaacttgttttataaaaagcaaaaaaaaaaaaaaaaaaaaaaaaaaaaaaaaaaaaaggggggcgggcgcgcgccggggccccgggaaagagtttaaaaaacatccgtagtgggggacggggcccaaaagggaacgggaaaggggcaaaacacggggaaccaagagaaaacggggacagaaaaagggaggggattcacaacaaaaaaaaaaacgcccggggggaaacacaaagggtccgaacacaccgaaggggaaacagggggagacaaggggcacacaaaagggagcccaagaagcacagataaaataaccccgccagggg

SEQ ID NO: 312518 - DNA, 2352 bp, Homo sapiens
agcagcgggaggggcggagggaggggattcggcagctccagttcagctcgctcggcgcacccacgcctcgctgccccgcttcctgccctcaacctgggcatgcgccccccacccttccggccccccagaacccgcgccatcccccggagcctccccagagctggccgcgcaggatgggcgccctcaggcccacgctgctgccgccttcgctgccgctgctgctgctgctaatgctaggaatgggatgctgggcccgggaggtgctggtccccgaggggcccttgtaccgcgtggctggcacagctgtctccatctcctgcaatgtgaccggctatgagggccctgcccagcagaacttcgagtggttcctgtataggcccgaggccccagatactgcactgggcattgtcagtaccaaggatacccagttctcctatgctgtcttcaagtcccgagtggtggcgggtgaggtgcaggtgcagcgcctacaaggtgatgccgtggtgctcaagattgcccgcctgcaggcccaggatgccggcatttatgagtgccacaccccctccactgatacccgctacctgggcagctacagcggcaaggtggagctgagagttcttccagatgtcctccaggtgtctgctgcccccccagggccccgaggccgccaggccccaacctcacccccacgcatgacggtgcatgaggggcaggagctggcactgggctgcctggcgaggacaagcacacagaagcacacacacctggcagtgtcctttgggcgatctgtgcccgaggcaccagttgggcggtcaactctgcaggaagtggtgggaatccggtcagacttggccgtggaggctggagctccctatgctgagcgattggctgcaggggagcttcgtctgggcaaggaagggaccgatcggtaccgcatggtagtagggggtgcccaggcaggggacgcaggcacctaccactgcactgccgctgagtggattcaggatcctgatggcagctgggcccagattgcagagaaaagggccgtcctggcccacgtggatgtgcagacgctgtccagctggacacagagggtgtgggcagcctgggccctggctatgagggccgacacattgccatggagaaggtggcatccagaacataccggctacggctagaggctgccaggcctggtgatgcgggcacctaccgctgcctcgccaaagcctatgttcgagggtctgggacccggcttcgtgaagcagccagtgcccgttcccggcctctccctgtacatgtgcgggaggaaggtgagagggggctgggccctggacggggttcgaggattgtcaaccccttttccttctgtttccatgacccctccctctccgtcagctgtttgcaggccacagcctcacgctcctcttctaccaagattgtgggaataccctgagtttcctggggcggtgcttggcggcagccctaaccccatgctccctggccctgcaccctctgaccccatgtcctttgttctgcaggtgtggtgctggaggctgtggcatggctagcaggaggcacagtgtaccgcggggagactgcctccctgctgtgcaacatctctgtgcggggtggccccccaggactgcggctggccgccagctggtgggtggagcgaccagaggacggagagctcagctctgtccctgcccagctggtgggtggcgtaggccaggatggtgtggcagagctgggagtccggcctggaggaggccctgtcagcgtagagctggtggggccccgaagccatcggctgagactacacagcttggggcccgaggatgaaggcgtgtaccactgtgcccccagcgcctgggtgcagcatgccgactacagctggtaccaggcgggcagtgcccgctcagggcctgttacagtctacccctacatgcatgccctggacaccctatttgtgcctctgctggtgggtacaggggtggccctagtcactggtgccactgtccttggtaccatcacttgctgcttcatgaagaggcttcgaaaacggtgatcccttactccccaggtcttgcaggtgtcgactgtcttccggcccagctccaagccctcctctggttgcctggacaccctctccctctgtccactcttcctttaatttatttgacctcccactacccagaatgggagacgtgcctccccttccccactccttccctcccaagcccctccctctggccttctgttcttgatctcttagggatcctatagggaggccatttcctgtcctggaattagtttttctaaaatgtgaataaacttgttttataaaaagca

SEQ ID NO: 312519 - DNA, 2322 bp, Homo sapiens
agcagcgggaggggcggagggaggggattcggcagctccagttcagctcgctcggcgcacccacgcctcgctgccccgcttcctgccctcaacctgggcatgcgccccccacccttccggccccccagaacccgcgccatcccccggagcctccccagagctggccgcgcaggatgggcgccctcaggcccacgctgctgccgccttcgctgccgctgctgctgctgctaatgctaggaatgggatgctgggcccgggaggtgctggtccccgaggggcccttgtaccgcgtggctggcacagctgtctccatctcctgcaatgtgaccggctatgagggccctgcccagcagaacttcgagtggttcctgtataggcccgaggccccagatactgcactgggcattgtcagtaccaaggatacccagttctcctatgctgtcttcaagtcccgagtggtggcgggtgaggtgcaggtgcagcgcctacaaggtgatgccgtggtgctcaagattgcccgcctgcaggcccaggatgccggcatttatgagtgccacaccccctccactgatacccgctacctgggcagctacagcggcaaggtggagctgagagttcttccagatgtcctccaggtgtctgctgcccccccagggccccgaggccgccaggccccaacctcacccccacgcatgacggtgcatgaggggcaggagctggcactgggctgcctggcgaggacaagcacacagaagcacacacacctggcagtgtcctttgggcgatctgtgcccgaggcaccagttgggcggtcaactctgcaggaagtggtgggaatccggtcagacttggccgtggaggctggagctccctatgctgagcgattggctgcaggggagcttcgtctgggcaaggaagggaccgatcggtaccgcatggtagtagggggtgcccaggcaggggacgcaggcacctaccactgcactgccgctgagtggattcaggatcctgatggcagctgggcccagattgcagagaaaagggccgtcctggcccacgtggatgtgcagacgctgtccagccagctggcagtgacagtggggcctggtgaacgtcggatcggcccaggggagcccttggaactgctgtgcaatgtgtcaggggcacttcccccagcaggccgtcatgctgcatactctgtaggttgggagatggcacctgcgggggcacctgggcccggccgcctggtagcccagctggacacagagggtgtgggcagcctgggccctggctatgagggccgacacattgccatggagaaggtggcatccagaacataccggctacggctagaggctgccaggcctggtgatgcgggcacctaccgctgcctcgccaaagcctatgttcgagggtctgggacccggcttcgtgaagcagccagtgcccgttcccggcctctccctgtacatgtgcgggaggaaggtgtggtgctggaggctgtggcatggctagcaggaggcacagtgtaccgcggggagactgcctccctgctgtgcaacatctctgtgcggggtggccccccaggactgcggctggccgccagctggtgggtggagcgaccagaggacggagagctcagctctgtccctgcccagctggtgggtggcgtaggccaggatggtgtggcagagctgggagtccggcctggaggaggccctgtcagcgtagagctggtggggccccgaagccatcggctgagactacacagcttggggcccgaggatgaaggcgtgtaccactgtgcccccagcgcctgggtgcagcatgccgactacagctggtaccaggcgggcagtgcccgctcagggcctgttacagtctacccctacatgcatgccctggacaccctatttgtgcctctgctggtgggtacaggggtggccctagtcactggtgccactgtccttggtaccatcacttgctgcttcatgaagaggcttcgaaaacggtgatcccttactccccagcccacaccgggcacccttttcaggtcttgcaggtgtcgactgtcttccggcccagctccaagccctcctctggttgcctggacaccctctccctctgtccactcttcctttaatttatttgacctcccactacccagaatgggagacgtgcctccccttccccactccttccctcccaagcccctccctctggccttctgttcttgatctcttagggatcctatagggaggccatttcctgtcctggaattagtttttctaaaatgtgaataaacttgttttataaaaagca

SEQ ID NO: 312520 - DNA, 2081 bp, Homo sapiens
agcagcgggaggggcggagggaggggattcggcagctccagttcagctcgctcggcgcacccacgcctcgctgccccgcttcctgccctcaacctgggcatgcgccccccacccttccggccccccagaacccgcgccatcccccggagcctccccagagctggccgcgcaggatgggcgccctcaggcccacgctgctgccgccttcgctgccgctgctgctgctgctaatgctaggaatgggatgctgggcccgggaggtgctggtccccgaggggcccttgtaccgcgtggctggcacagctgtctccatctcctgcaatgtgaccggctatgagggccctgcccagcagaacttcgagtggttcctgtataggcccgaggccccagatactgcactgggcattgtcagtaccaaggatacccagttctcctatgctgtcttcaagtcccgagtggtggcgggtgaggtgcaggtgcagcgcctacaaggtgatgccgtggtgctcaagattgcccgcctgcaggcccaggatgccggcatttatgagtgccacaccccctccactgatacccgctacctgggcagctacagcggcaaggtggagctgagagttcttccagatgtcctccaggtgtctgctgcccccccagggccccgaggccgccaggccccaacctcacccccacgcatgacggtgcatgaggggcaggagctggcactgggctgcctggcgaggacaagcacacagaagcacacacacctggcagtgtcctttgggcgatctgtgcccgaggcaccagttgggcggtcaactctgcaggaagtggtgggaatccggtcagacttggccgtggaggctggagctccctatgctgagcgattggctgcaggggagcttcgtctgggcaaggaagggaccgatcggtaccgcatggtagtagggggtgcccaggcaggggacgcaggcacctaccactgcactgccgctgagtggattcaggatcctgatggcagctgggcccagattgcagagaaaagggccgtcctggcccacgtggatgtgcagacgctgtccagccagctggcagtgacagtggggcctggtgaacgtcggatcggcccaggggagcccttggaactgctgtgcaatgtgtcaggggcacttcccccagcaggccgtcatgctgcatactctgtaggttgggagatggcacctgcgggggcacctgggcccggccgcctggtagcccagctggacacagagggtgtgggcagcctgggccctggctatgagggccgacacattgccatggagaaggtggcatccagaacataccggctacggctagaggctgccaggcctggtgatgcgggcacctaccgctgcctcgccaaagcctatgttcgagggtctgggacccggcttcgtgaagcagccagtgcccgttcccggcctctccctgtacatgtgcgggaggaaggtgtggtgctggaggctgtggcatggctagcaggaggcacagtgtaccgcggggagactgcctccctgctgtgcaacatctctgtgcggggtggccccccaggactgcggctggccgccagctggtgggtggagcgaccagaggacggagagctcagctctgtccctgcccagctggtgggtggcgtaggccaggatggtgtggcagagctgggagtccggcctggaggaggccctgtcagcgtagagctggtggggccccgaagccatcggctgagactacacagcttggggcccgaggatgaaggcgtgtaccactgtgcccccagcgcctgggtgcagcatgccgactacagctggtaccaggcgggcagtgcccgctcagggcctgttacagtctacccctacatgcatgccctggacaccctatttgtgcctctgctggtgggtacaggggtggccctagtcactggtgccactgtccttggtaccatcacttgctgcttcatgaagaggcttcgaaaacggtgatcccttactccccagcttgcaggtgtcgactgtctacccctacatgcatgcctgacacccctcgtg

SEQ ID NO: 312521 - DNA, 610 bp, Homo sapiens
gcggccgctccaacatcaggggtggccctagtcactggtgccactgtccttggtaccatcacttgctgcttcatgaagaggcttcgaaaacggtgatcccttactccccaggtcttgcaggtgtcgactgcctcagctctgtccctgcccagctggtgggtggcgtaggccaggatggtgtggcagagctgggagtccggcctggaggaggccctgtcagcgtagagctggtggggccccgaagccatcggctgagactacacagcttggggcccgaggatgaaggcgtgtaccactgtgcccccagcgcctgggtgcagcatgccgactacagctggtaccaggcgggcagtgcccgctcagggcctgttacagtctacccctacatgcatggcctggacaccctctccctctgtccactcttcctttaatttatttgacctcccactacccagaatgggagacgtgcctccccttccccactccttccctcccaagcccctccctctggccttctgttcttgatctcttagggatcctatagggaggccatttcctgtcctggaattagtttttctaaaatgtgaataaacttgttttataaaaagca

SEQ ID NO: 312522 - DNA, 347 bp, Homo sapiens
gtctcccatttgtgggtgggtttgctgcagctggctggatcccgtccttactcctaaggtggggaggggcgttctcaccctaggggctactcacctggtggatgggagtggacagtgtggagcctgtttgccctgccccgtgagaaagatgacttcatccagacacatgtggaactggctccatagacccaaagcaagcttagtccaaacaatgtctgaaattgtccatctaaaatagaaaccacatgttacatctcgagtcctttctctcgagcctttcttcagtcggggcagaggcccagactcattggagacggagagccctgggcagggggggcagcaccagg

SEQ ID NO: 312523 - DNA, 1639 bp, Homo sapiens
tcgcccaggttggaatgcagtggcacaatctcgggtcactgcaacctccacttcctgagttctagcaattctcctgcctcagcctcctgagtagctgggattacaggtgcccaccaccacgcccagctaatttttgtatttttagtaaaatggggtttcactatgttagccaggcttatctcagactcctggcctcaggtgatccccctgccttggcttcccatagtgctgggattacaggtgttagccaccacgcccagcctatatgtattttttgagacagggtcttgctctattgcccaggctgaagtgcagtggcatgatcacagctcacaaatgccttgatctcctgggctcaagctatctcctcccacctcagcctcttaagtagctggagctacaggttatctgccaccacactcagctaatttttaattttttagaaagacggggtcttcctgtgttccccaggctggccccaaactcctgggctcaagcaatcctgccttacctcccaaagtgctgggattacaggtgtgagccaccacatctggcccaagtcacccaaattttttacagcttggtttggaaggcaatgtagtatattaaaattatgggccctggagtcagaaagatccaggtttgaatacagagtccgtcatttattagctttatgaatttgagcaatttcgtctcacttgtaaatatagggaatagctcctacctctcaggtatgttgcaaaaaactatataaaagcacttagcatagtggccatgacagagtaagcactcagtaaatcatgccatttatctcatctataaggcatgaaagtagaattttacaagttgtacagaaatagaaggcttggagtggacactacattaaaaggataaaaaaatggagccaggcagaggcaggcatctatagtcccagctattgaggaggcctgaggctggaggatcccttgaacctaggagtttgaggccagcctggacaacaatgtgagattgtggctccaaaaaaataataaaaaataggctgctctgcctatggagtagccattcttttattcctttacttttttaataaacttgcttttactttatggaaaaaataaatttttaaatgactagatgagaaacttgaatatcaatctgagaaataaaatctgattaggaatgtaattgggataacctgaagttttggtaagagtgacctaaagaaaacagcacttagataagctactttgttttcctttttcactttactatttttctgatatatatttgttcatatttatggggtacttgtgatattctgagacatgcatagaatgtataatgatcaagtcaggatatttatgttattcattatctcaaacatttatcatttgtttgtgttgggaacatttcaaatcttctagccattttgaaacttacattaagtatagtcaccgtactatgctatcaagcattaaaacttattccttctatctaactgtatgtttgtatctacccattaacctaccttccttcatcgccccaccctgtacacccactacccagcctctggtaactatcattctactctctacctccatgaaataaattttttagctcacatgagtaagaacatgca

SEQ ID NO: 312524 - DNA, 16433 bp, Homo sapiens
aaagacagaaccccagagaaaaacgctgccaattcgttgctttattgttccctgcctggggacctcaatagccttttccattaaccttcccttcttacgcaacggttaatgacttttggggttgttttgctttctgtttctgctgagtcactaaattttgcctctttgtccccaggtgctgctcagcataaaagttaaaagtgcaattcaggaagtactgggattctgtgtagagccgaggaaaccatttccctaagagaagctctgttccttggcttgtccttccttcccgggaaggaagcttccgaggaacgaagggagaagctttgttttgcctgcagaagcagccctgtgctcggctgagggttctcagctggctgtgaactgcggagcattgtaggcgcctggctggctcaggccaatgcagaagtctctcccttctccaaagacccaaatccccacagaaccagcttcgagttactttcccttcaaggggattaaaataattgtgatttgtggcgctctccgttcgcggtggtattttcctgttgtgttaaatgcctcttattaagtaatagatgtgatttatgtgaacgacgaaggggtgtgtggtggattcggtgattaatcagtgaattcccatccgctggcatctctcactgcccctcttgcgtgatgtaagatcagacgtaccctgcattgaaaagtcaagacacacgggcgtctcgctcgcgctcacacacgctctgcctcctctctcccgcacgcgcgcatccctccaccttccacatcctgctccaggcaggagaaggctgactggctggactcattgagctgaagaatttccagtgacatttgtaaatgacgccgctcgattccaggctccaagcggccgctgccgccgccgccgccgccgggccgaaggtgccgccgagcagtctccagcgcaggcttccttaccgggcgaccacaatgtccgagtttctcctcgccttactcactctctcgggattattgccgattgccagggtgctgaccgtgggagccgaccgagatcagcagttgtgtgatcctggtgaatttctttgccacgatcacgtgacttgtgtctcccagagctggctgtgtgatggggaccctgactgccctgatgattcagacgagtctttagatacctgtcccgaggaggtagaaatcaagtgccccttgaatcacattgcttgccttggtaccaacaaatgtgttcatttatcccagctgtgcaatggtgtcttggactgcccagatgggtatgacgaaggagtacattgtcaggaactgttatccaattgccaacagctgaattgtcagtataaatgtacaatggtcagaaatagtacaagatgttactgtgaggatggattcgaaataacagaagatgggagaagctgtaaagatcaagatgaatgtgctgtttatggtacatgcagccagacctgcagaaacacacatggatcctacacttgcagttgtgtggaaggctacctaatgcagccagacaacagatcttgcaaggctaaaattgaacctacagatagaccacctatactattaattgcaaattttgaaacaattgaggttttctatcttaatggaagtaaaatggcaactctaagctcagtcaatggaaatgaaattcatactctggattttatttataatgaagatatgatttgttggattgaatcaagagaatcttcaaatcaactcaaatgtatccagataacaaaagcaggaggattaacagatgaatggacaatcaatattcttcaatccttccacaatgtgcaacaaatggcgattgactggctcactcgaaatctctattttgtggaccatgtcggtgaccggatctttgtttgtaattccaacggttctgtatgtgtcaccctgattgatctggagcttcacaatcctaaagcaatagcagtagatccaatagcaggaaaacttttctttactgactacgggaatgtcgccaaagtggagagatgtgacatggatgggatgaaccgaacaaggataattgattcaaagacagagcagccagctgcactggcactagacctagtcaacaaattggtttactgggtagatctttacttggactatgtgggagtagtggactatcaaggaaaaaatagacacactgtcattcaaggcagacaagtcagacatctttatggtataactgtgtttgaagattatttgtatgcaaccaattctgataactacaatatcgtaaggataaaccgatttaatgggactgatattcactcattaattaaaattgagaatgcttggggaatccgaatttatcaaaaaagaactcaaccaacagtcagaagccatgcatgtgaagtcgatccatatggaatgccagggggctgttcacacatctgtctactcagcagcagttacaaaactcggacttgtcgctgcaggactggcttcaacttgggaagtgatggcaggtcatgcaaaagaccaaagaatgagttgttcctcttttatgggaaaggacgcccaggaattgttagaggaatggacttgaataccaagatagctgatgaatacatgatccccatagaaaatctggtaaaccctcgtgctttagactttcacgcagaaaccaattacatctactttgctgacaccaccagtttcctaattggccggcagaagatagatggcacagagagagaaaccatcctgaaagatgatctggataatgtagagggcattgctgtggactggattggaaataatctttactggaccaatgatggccataggaaaaccattaatgtggccaggctggaaaaagcttctcagagtcggaagactcttttagagggtgaaatgtctcatcccagaggaattgtggtggatccagttaatggttggatgtattggacagactgggaggaagatgaaatagatgacagcgtgggaaggattgagaaggcctggatggatggattcaatcggcagatttttgtgacttcaaagatgctgtggccaaacggtttaactctggactttcacaccaacacattatactggtgtgatgcctattacgatcatattgaaaaagtatttttgaatgggactcacaggaagattgtttacagtgggagagagttgaaccaccctttcggactgtcgcatcatggaaattatgtgttctggactgattatatgaatggttccatttttcaactagatttgataacaagtgaggtgacattgctgaggcatgaaagaccacccctatttgggcttcagatttatgatccacgaaagcaacaaggtgacaatatgtgccgagtaaataatgggggctgtagtacactttgcttggctatcccaggaggccgggtgtgtgcttgtgccgataatcaacttttggatgaaaatgggacaacttgcacatttaatcctggagaagcactacctcacatatgtaaagctggagagtttcgctgcaaaaacagacactgtatccaagctcggtggaaatgtgatggcgacgatgactgcctagacggaagcgatgaggattcagtaaactgcttcaatcatagctgtcctgatgatcagtttaaatgccagaataatcgctgcatccccaagagatggctttgtgatggagctaatgactgtgggagcaatgaagatgaatccaatcaaacttgcacagccagaacatgccaggtagaccagttttcttgcggaaatgggcgttgcattcccagagcatggctgtgtgacagggaagacgactgtggtgaccagacagatgaaatggcatcttgtgaattcccaacttgtgagccactaacccaattcgtatgcaaaagtggaagatgcattagcagcaaatggcactgcgactctgatgacgactgtggggacgggagtgatgaggtgggctgtgttcactcttgctttgataatcagttcagatgttccagtggcagatgcatcccaggccactgggcctgtgatggtgacaatgactgtggggacttcagtgatgaagcccagatcaattgtactaaagaagagattcattctcctgctggttgtaacggaaatgaatttcagtgccaccctgatggtaattgcgttcctgatttgtggcgctgtgatggagaaaaagactgtgaagatggtagtgatgaaaaaggttgcaatggtaccatacgattgtgtgaccacaaaaccaagttttcctgttggagtacagggagatgcatcaacaaagcatgggtgtgtgatggagatattgattgcgaagatcagtcagatgaagatgactgtgacagtttcttgtgtggaccacccaagcatccttgtgctaatgacacctcagtctgcctgcagccagagaaactctgcaatgggaaaaaggattgtcctgatggctctgatgaaggctatctctgtgatgagtgttcgctgaacaatggaggctgtagcaaccactgttctgttgttcctggaagaggaattgtctgttcctgccctgaaggacttcaactcaacaaagacaataaaacatgtgaaattgtggattattgtagcaatcatctaaagtgcagccaagtatgtgagcagcacaagcacacagtcaagtgctcatgttatgaaggttggaagctggatgtagacggtgaaagttgtacaagtgttgatccttttgaagcattcatcatcttttctattcgtcatgagatcagaaggattgatcttcacaaaagagactatagtctacttgttcctggattgagaaacacaatagcacttgattttcacttcaatcaaagtttactttattggacagatgttgtagaagacagaatataccggggaaagctttctgaaagtggaggtgtcagtgccattgaagtggttgtggagcatggcctggctactccagaaggcctgacagtcgactggatagcaggaaacatatactggatagacagcaatctggaccaaatcgaagtggccaaactagatggctccctaagaactacactaatagcaggagccatggaacaccccagggccattgctttggacccaagatatggaattcttttctggacagactgggatgcaaattttcctcgcattgaatctgcctctatgagtggtgctgggagaaaaaccatctataaagacatgaaaactggggcttggcctaatggactaactgtggaccactttgagaaaaggatagtgtggacagacgccaggtcagatgctatttattcagccctctatgatggaacaaacatgatagaaatcatccgaggtcatgaatacctttcccatccctttgctgtgtctctatatgggagtgaagtctactggacagactggaggaccaacacattgtccaaagccaataagtggacagggcagaatgtcagtgtgattcagaaaaccagtgcacagccatttgaccttcagatataccatcccagtcgccagccacaggctcccaatccttgtgcagctaatgatggcaaaggcccctgctctcacatgtgtctaatcaatcacaataggagtgctgcctgtgcgtgcccccacttgatgaagctttcttcagacaagaagacctgctatgaaatgaaaaaatttcttctttatgcaagacgttctgaaatcagaggagtggatattgacaatccatactttaacttcatcacggcatttacagtccctgatattgatgacgttactgtgatagacttcgatgcatctgaggaacgtttatactggacagatattaaaacacaaaccattaaacgagcttttattaacggaactgggttagaaactgttatttcaagagatattcagagtatcagagggctagcagtggattgggtgtcacgtaatttatactggattagctcagaatttgatgaaacgcaaattaatgtggcaaggctagatggctctttgaaaacctcaattatccatggaatcgataagccacagtgtcttgcagctcacccagtcaggggaaaactctactggaccgatggaaacacaattaacatggcaaatatggatggcagtaatagcaagattctgtttcagaatcagaaggagccagttggtctatcgatagactatgtggaaaacaagctttattggatcagttcggggaatggaaccataaatagatgcaacctggatggtggtaatttagaagtaatcgagtcaatgaaagaagaattaacaaaagctacagccctaaccatcatggataagaaactgtggtgggcagaccaaaacttagcccagctaggaacctgcagcaaaagagacggaagaaaccccaccatcctacggaataagacttctggggtagttcatatgaaagtctatgataaagaagcacagcaaggcagcaattcctgccaactaaacaatggtggatgctctcaactttgtttaccaacatctgaaactacaaggacttgtatgtgtacagtgggatattatctccaaaagaaccgtatgtcatgtcaaggtatagaatcatttcttatgtactctgttcatgaaggaatcaggggaatacctcttgaaccaagtgacaaaatggatgctttgatgcctatatcaggaacttcatttgccgtgggaatagatttccatgcagaaaatgataccatctactggacagacatgggcttcaataaaattagcagagctaaaagagatcagacttggaaagaagatatcattaccaatggcttgggaagagtggaagggatagctgttgactggattgctggtaacatatattggacagatcatggtttcaacttaattgaagttgcaagactcaatggttctttccgttatgtaattatttcccaaggcctggatcaaccaagatctatagctgtgcacccagagaaaggcctcttgttctggactgaatggggacaaatgccctgtattggaaaggctcgcttggatggctcagagaaggttgtccttgtaagcatgggaatagcatggccgaatggcatctccatcgactatgaggaaaataaattgtactggtgtgatgctcgcacagacaagatagagagaatcgaccttgagactggagggaatcgcgagatggtgctgtcaggaagcaatgtggatatgttttcagttgcagtctttggggcttacatctactggtctgacagagcacatgcaaacgggtctgtcagaaggggccacaagaatgatgccacagaaacgataaccatgagaaccggccttggagtcaacctgaaggaggttaaaatatttaaccgagtaagagagaaagggaccaatgtttgtgccagggacaatggtggctgtaagcaactctgtctttatcgaggaaattcccggagaacttgtgcttgtgcccatggatatttggcagaagatggagttacttgcctgaggcatgaaggctatttactgtattcaggaagaacaatattaaaaagtatacatctttctgatgaaaccaatttaaattccccaataaggccatatgagaatccacgttatttcaagaatgtcatagccttggcttttgactataatcaaagaagaaaaggtaccaaccgaatcttttacagtgatgcacactttggaaatatacagcttattaaagacaactgggaagacagacaagtaattgttgaaaatgtgggttctgtggaaggacttgcctatcacagagcctgggatacactgtactggacaagctctaccacctcatccatcaccagacacactgtggaccagactcggcctggagcatttgacagggaagctgtcatcaccatgtcagaagatgaccatccacatgtgctagccttggatgaatgtcaaaatttaatgttttggaccaactggaatgaacaacatccaagtatcatgagatctactctgactgggaaaaatgctcaagtggtggtcagtacagacatactcactccaaatggacttactatcgactaccgtgcagagaagctgtatttctcagatggcagtctaggaaaaattgaaaggtgtgaatacgatggatcccagagacatgtgatagttaaatctgggccagggactttcctcagtttggctgtttatgacaattatatattctggtcggactggggaagaagagctatactgcggtccaacaagtacacaggaggagatacaaaaattcttcgttccgatattccacatcagccaatgggaatcatagctgttgccaatgacaccaatagctgtgaactttctccatgtgcattattgaatggaggctgccatgacttgtgccttttaactcccaatgggagagtgaattgttcctgcagaggggaccgaatattgctagaggacaacagatgtgtgactaaaaattcctcctgcaacgcttattcggagtttgaatgtggaaatggtgagtgcattgactaccagctcacctgtgatggcattcctcactgtaaagataaatcagatgaaaaactgctctactgtgaaaacagaagctgtcgaagaggcttcaagccatgctataatcgccgctgcattcctcatggcaagttatgtgatggagaaaatgactgcggagacaactctgatgaattagattgtaaagtttcaacctgtgccacggttgagttccgctgtgcagatgggacttgtattccaagatcagcacgatgcaaccagaacatagattgtgcagatgcttcagatgaaaagaactgcaataacacagactgcacacatttctataagcttggagtgaaaaccacagggttcataagatgtaattctacctcactgtgtgttctgccaacctggatatgcgacgggtctaatgactgtggagactattcagatgaattaaagtgcccagttcagaacaaacacaaatgtgaagaaaattattttagttgtcctagtggaagatgcattttgaatacctggatatgcgatggtcagaaagattgtgaggatggacgtgatgaattccactgtgattcttcttgctcttggaaccaatttgcttgttccgcacaaaaatgtatttctaagcattggatttgtgatggagaagatgactgtggggatgggttagatgaaagtgacagcatttgtggtgccataacctgtgctgctgacatgttcagctgccagggctctcgtgcctgcgtgccccgacattggctttgtgatggtgaaagggactgtccagatggaagcgatgagctttccacagcaggctgcgctcccaataatacatgtgatgaaaatgctttcatgtgccataataaagtatgcattcccaagcaatttgtttgtgaccatgatgacgactgtggagatggctctgatgagtcaccgcagtgtggataccgacagtgtggtacagaagaatttagttgtgctgatgggcggtgtcttctaaatactcaatggcagtgtgatggagactttgactgtcctgaccattctgatgaagcacctttaaacccaaagtgtaaaagtgcagaacagtcatgcaacagttcattttttatgtgcaaaaatggcaggtgcattcccagtggaggtctttgtgacaataaggatgactgtggcgatggttcagatgagagaaactgccatataaatgaatgtttgagtaagaaagtcagtggatgttctcaagattgtcaagaccttccggtcagttataagtgcaaatgctggcctggattccaactgaaggatgacggcaaaacatgtgtagacattgatgaatgctcttcaggctttccctgtagccagcaatgcatcaatacatacgggacttacaagtgcctctgtacagatgggtatgaaatacaacctgataacccaaatggctgcaaatcgctctcagatgaagaaccttttttaattcttgctgatcatcatgagataaggaaaattagcactgatggctccaactacacacttttaaaacagggattaaacaatgttattgctatagactttgattacagagaagaattcatctattggatcgattctagccgacccaatggcagtcgcataaatagaatgtgtttaaatggaagtgacattaaggtagttcataacacagcggtccccaatgcacttgctgtcgattggattggaaaaaacctctattggtctgacacagaaaaaagaatcattgaagtatccaaactcaatggcttgtaccctactatactcgttagcaaaaggctgaagtttcccagagacttgtctttagatcctcaagctggatatttgtattggattgactgctgcgagtatcctcatattggccgtgttggaatggatggaaccaatcagagtgttgtcatagaaaccaagatttctagacctatggcactaacaatagattatgttaatcgtagactctactgggccgatgaaaatcacattgaatttagcaacatggatggatctcatagacacaaagtccctaatcaagatattccaggggtgattgcactaacattgtttgaagactacatctactggactgatgggaaaaccaagtcactcagccgtgcccataaaacatcgggagcagacagactctcactgatttactcatggcatgccatcacagatatccaggtgtatcattcttatagacaacctgatgtctccaaacatctctgcatgataaataatggtggttgcagtcatttgtgccttttagcccctggaaaaacccacacttgtgcatgtcccactaacttctatctggcagctgataataggacttgcttatccaactgcacagccagccagtttcgttgcaaaactgacaaatgtattccattctggtggaaatgtgacaccgtggatgactgtggtgatggatctgatgaacctgatgactgtcctgaatttagatgtcagccaggccgatttcagtgtgggactggactctgtgctctaccagctttcatctgtgatggagagaatgattgtggagacaattctgatgaactcaactgtgacacacatgtctgcctgtcaggtcaattcaaatgtaccaagaaccagaaatgtatcccagtaaacttaagatgtaatgggcaagatgactgtggtgatgaggaagatgaaagagactgtcctgaaaacagctgttctccagactatttccagtgtaagactacgaagcattgcatttccaagctgtgggtttgtgacgaggatccagactgtgcagatgcatcagacgaggccaactgcgataaaaagacttgtggacctcatgaattccagtgtaaaaacaacaactgtattcccgatcactggcggtgtgatagccaaaatgactgcagtgataattcagatgaagaaaactgtaagccacagacatgtacattgaaagatttcctctgtgccaatggggactgtgtttcttcaaggttttggtgtgatggagattttgactgtgcagatggctctgatgagagaaattgtgagacaagttgttccaaagatcagttccggtgttccaatggtcagtgtataccagcaaaatggaaatgtgatggccatgaagactgcaaatatggggaagatgagaaaagctgtgagccagcttctcctacttgctcatcacgtgaatatatatgtgccagtgatggatgtatttcagcatctttgaaatgtaatggagaatatgattgtgctgatggttcagatgagatggactgtgtgactgaatgtaaggaagatcagtttcggtgcaaaaataaagcccactgtattccaattagatggctgtgtgatggaattcatgactgtgtggatggcagtgatgaagagaactgtgaaagaggaggaaatatatgtagagctgatgagttcctttgcaataattctctctgcaaactacatttctgggtgtgtgatggagaggacgactgtggagacaactctgatgaagcccctgatatgtgtgtcaaatttctttgtccatccacgagacctcacagatgcagaaataacagaatatgcctacagtcggagcaaatgtgcaatgggattgatgaatgcggtgacaattcagatgaagatcactgtggtggtaagctgacatataaagcaaggccttgtaaaaaggatgagtttgcttgtagtaataaaaaatgcatccctatggatctccagtgtgatcgacttgatgactgcggagatggttcagatgagcaaggatgcagaatagctcctactgaatatacctgtgaagataatgtgaatccatgtggagatgatgcatattgtaatcaaataaaaacatctgttttctgtcgctgtaagcctggatttcagagaaacatgaaaaacagacaatgtgaagaccttaatgaatgtttggtgtttggcacatgttcccatcaatgtataaatgtggaaggatcatataaatgtgtgtgtgaccagaattttcaagaaagaaataacacctgcatagcagaaggctctgaagatcaagttctctacattgctaatgacactgatatcctgggttttatatatccattcaactacagtggcgatcatcaacaaatttctcatattgaacataattcaagaataacagggatggatgtatattatcaaagagatatgattatttggagtactcagtttaatccaggcggaattttctacaaaaggatccatggcagagaaaaaaggcaagcaaacagtggcttgatttgtcctgaatttaaaaggcccagggacattgcagttgactgggtggctggaaacatttactggactgatcattctagaatgcattggttcagttactacactactcactggaccagtctgaggtactctatcaacgtagggcagctgaatggccccaactgcaccagactcttaacaaatatggctggagaaccctatgctattgcagtaaatcctaaaagagggatgatgtactggactgttgttggggatcattcccatatagaagaagcagccatggatggtacactgagaaggattttagtacaaaagaacttacagagacccacaggtttggctgtggattattttagtgaacgcatatattgggctgactttgagctctccatcattggcagtgttctgtatgatggctctaattcagtagtctctgtcagcagcaaacaaggtttattacatccacataggatcgatatctttgaagattatatatatggagcaggacctaaaaatggtgtatttcgagttcaaaaatttggccatggttcagtagagtacttagctttaaatattgataaaacaaaaggtgttttgatatctcatcgttataaacaactagatttacccaatccatgcttggatttagcatgcgaatttctttgcttgctaaatccttctggggccacttgtgtgtgtccagaaggaaaatatttgattaatggcacctgcaatgatgacagcctgttagatgattcatgtaagttaacttgtgaaaatggaggaagatgcattttaaatgagaaaggtgatttgaggtgtcactgttggcccagttattcaggagaaagatgtgaagtcaaccactgtagcaactactgccagaatggaggaacttgcgtaccatcagttctagggagacccacctgcagctgtgcactgggtttcactgggccaaactgtggtaagacagtctgtgaggatttttgtcaaaatggaggaacctgcattgtgactgctggaaaccagccttactgccactgccagccggaatacaccggagacagatgtcagtactacgtgtgccaccactattgtgtgaattctgaatcatgtaccattggggatgatggaagtgttgaatgtgtctgtccaacgcgctatgaaggaccaaaatgtgaggttgacaagtgtgtaaggtgccatggggggcactgcattataaataaagacagtgaagatatattttgcaactgcactaatggaaagattgcctctagctgtcagttatgtgatggctactgttacaatggtggcacatgccagctggaccccgagacaaatgtacctgtgtgtctatgctccaccaactggtcaggcacacagtgtgaaaggccagccccaaagagcagcaagtctgatcatatcagcacaagaagcattgccatcattgtgcctctcgtcctcttggtgactttgataaccaccttagtaattggtttagtgctttgtaaaagaaaaagaaggacaaaaacaattagaagacaacctattatcaatggaggaataaatgtagaaattggcaatccatcttataacatgtatgaggtagatcatgatcacaacgatggaggtcttttagatcctggctttatgatagacccaacaaagccaacaaattactccaatccggtatatgcaaaattatatatggatgggcaaaactgtcgaaactccttaggaagtgttgatgaaaggaaagaactgcttccaaagaaaatagaaattggtataagagagacagtggcataatcagtgatatcttttatatgctgtataaatgtataaaatataaggattacttttgtatgttccaacagtattatacttgttttggcatcagcattacctctttctttatctttttcctggttaattgttttctgagttttttgggttttattttttgctgatgactattgattgaccatttgtatggtatttttatgaaaaagaactgcactacagtacaatttacaacaatgctgctgatatgacacacctttgaatttgttaaaattaaaaacaacgtattcctttgtagtgtgaatatgagcaatctattttatatgaacttttttggttgtacttaatcaacgaggagaatctctgcacttttccattatacggtttgaaggctgtaatacagtgtcattttatttttctgtttaaattgatggaaaaatgattgaatggtcaactctcttctttgtgcccataaagatcgattcagactctgctgaaaatatatagctctcacaagttcagcatcacctgctttgaaattagccttagattgccaaccaatagatgagaattttgaggaaaaaaattaaaaatatgtaaaattaataatttgcatgaacacagatgactacattttccaaaacttagtggactctatgtgatgtactaaatgtatacaccttgtaagcaatagttatatttaggtggtagaacatagcaaaaatataaccgaaagttggccgactgcacttgctatggaataagaccttttattctccctcagtctcgagataaatagccagcctagagcacaacagggcattgggtacttgcatcttaggtatttcttcccagtcacatccattttgtggaagattaacccaaccccttacactacactgaacactaaagaataacatataagcacacaaattggtgacagaatttcaattacgtgaacgcatcctctttgctaggtcaaaaacaaagggcaaagcagacattttagtatacagagtgattggcaaatattttcaagatttaatatgagcaacccattatttgccctatccaaaatatattcaagggccttccaagttgtagaagaacaatgatcttcccataatcaaaagtggagagtcgaaatgctgtgccagttgctctggtattcaggtttctctgggttttacagaacgcatggaccccattcacgtttggtttgtttatcttcaaatttgagttgaaacgagtgcgatttatttaagttgtatataaaaataaaaggatagcatttttatacaaatatctttaaaggcacaaaagatttattcacaagttttggagggctttttgttcctctgatagacatgactgacttttagctgtcataatgtattaacctaacagatgaaatatgttaaatatgtggttgctctttatccctttgtacaagcattaaaaaaactgctgttttataagaagactttttgttgtactatgtgcatgcatactacctatttctaaactttgccatattgaggcctttataaactattgatttatgtaatactagtgcaattttgcttgaacaatgttatgcatatcataaactttttcaggttcttgtttaagtacattttttaaattgaacagtatttttcattttggttataatatagtcattttgcctatgtttctacaatgaagtgttaaatactttataaaaaattgttgactgacttatttaaatgaaattctacatattt

SEQ ID NO: 312525 - DNA, 16424 bp, Homo sapiens
ggagttgttgacagcctcctgaaagcaattctgagtgtgaattaagcaagatgctctttgaagaaaggtgctgctcagcataaaagttaaaagtgcaattcaggaagtactgggattctgtgtagagccgaggaaaccatttccctaagagaagctctgttccttggcttgtccttccttcccgggaaggaagcttccgaggaacgaagggagaagctttgttttgcctgcagaagcagccctgtgctcggctgagggttctcagctggctgtgaactgcggagcattgtaggcgcctggctggctcaggccaatgcagaagtctctcccttctccaaagacccaaatccccacagaaccagcttcgagttactttcccttcaaggggattaaaataattgtgatttgtggcgctctccgttcgcggtggtattttcctgttgtgttaaatgcctcttattaagtaatagatgtgatttatgtgaacgacgaaggggtgtgtggtggattcggtgattaatcagtgaattcccatccgctggcatctctcactgcccctcttgcgtgatgtaagatcagacgtaccctgcattgaaaagtcaagacacacgggcgtctcgctcgcgctcacacacgctctgcctcctctctcccgcacgcgcgcatccctccaccttccacatcctgctccaggcaggagaaggctgactggctggactcattgagctgaagaatttccagtgacatttgtaaatgacgccgctcgattccaggctccaagcggccgctgccgccgccgccgccgccgggccgaaggtgccgccgagcagtctccagcgcaggcttccttaccgggcgaccacaatgtccgagtttctcctcgccttactcactctctcgggattattgccgattgccagggtgctgaccgtgggagccgaccgagatcagcagttgtgtgatcctggtgaatttctttgccacgatcacgtgacttgtgtctcccagagctggctgtgtgatggggaccctgactgccctgatgattcagacgagtctttagatacctgtcccgaggaggtagaaatcaagtgccccttgaatcacattgcttgccttggtaccaacaaatgtgttcatttatcccagctgtgcaatggtgtcttggactgcccagatgggtatgacgaaggagtacattgtcaggaactgttatccaattgccaacagctgaattgtcagtataaatgtacaatggtcagaaatagtacaagatgttactgtgaggatggattcgaaataacagaagatgggagaagctgtaaagatcaagatgaatgtgctgtttatggtacatgcagccagacctgcagaaacacacatggatcctacacttgcagttgtgtggaaggctacctaatgcagccagacaacagatcttgcaaggctaaaattgaacctacagatagaccacctatactattaattgcaaattttgaaacaattgaggttttctatcttaatggaagtaaaatggcaactctaagctcagtcaatggaaatgaaattcatactctggattttatttataatgaagatatgatttgttggattgaatcaagagaatcttcaaatcaactcaaatgtatccagataacaaaagcaggaggattaacagatgaatggacaatcaatattcttcaatccttccacaatgtgcaacaaatggcgattgactggctcactcgaaatctctattttgtggaccatgtcggtgaccggatctttgtttgtaattccaacggttctgtatgtgtcaccctgattgatctggagcttcacaatcctaaagcaatagcagtagatccaatagcaggaaaacttttctttactgactacgggaatgtcgccaaagtggagagatgtgacatggatgggatgaaccgaacaaggataattgattcaaagacagagcagccagctgcactggcactagacctagtcaacaaattggtttactgggtagatctttacttggactatgtgggagtagtggactatcaaggaaaaaatagacacactgtcattcaaggcagacaagtcagacatctttatggtataactgtgtttgaagattatttgtatgcaaccaattctgataactacaatatcgtaaggataaaccgatttaatgggactgatattcactcattaattaaaattgagaatgcttggggaatccgaatttatcaaaaaagaactcaaccaacagtcagaagccatgcatgtgaagtcgatccatatggaatgccagggggctgttcacacatctgtctactcagcagcagttacaaaactcggacttgtcgctgcaggactggcttcaacttgggaagtgatggcaggtcatgcaaaagaccaaagaatgagttgttcctcttttatgggaaaggacgcccaggaattgttagaggaatggacttgaataccaagatagctgatgaatacatgatccccatagaaaatctggtaaaccctcgtgctttagactttcacgcagaaaccaattacatctactttgctgacaccaccagtttcctaattggccggcagaagatagatggcacagagagagaaaccatcctgaaagatgatctggataatgtagagggcattgctgtggactggattggaaataatctttactggaccaatgatggccataggaaaaccattaatgtggccaggctggaaaaagcttctcagagtcggaagactcttttagagggtgaaatgtctcatcccagaggaattgtggtggatccagttaatggttggatgtattggacagactgggaggaagatgaaatagatgacagcgtgggaaggattgagaaggcctggatggatggattcaatcggcagatttttgtgacttcaaagatgctgtggccaaacggtttaactctggactttcacaccaacacattatactggtgtgatgcctattacgatcatattgaaaaagtatttttgaatgggactcacaggaagattgtttacagtgggagagagttgaaccaccctttcggactgtcgcatcatggaaattatgtgttctggactgattatatgaatggttccatttttcaactagatttgataacaagtgaggtgacattgctgaggcatgaaagaccacccctatttgggcttcagatttatgatccacgaaagcaacaaggtgacaatatgtgccgagtaaataatgggggctgtagtacactttgcttggctatcccaggaggccgggtgtgtgcttgtgccgataatcaacttttggatgaaaatgggacaacttgcacatttaatcctggagaagcactacctcacatatgtaaagctggagagtttcgctgcaaaaacagacactgtatccaagctcggtggaaatgtgatggcgacgatgactgcctagacggaagcgatgaggattcagtaaactgcttcaatcatagctgtcctgatgatcagtttaaatgccagaataatcgctgcatccccaagagatggctttgtgatggagctaatgactgtgggagcaatgaagatgaatccaatcaaacttgcacagccagaacatgccaggtagaccagttttcttgcggaaatgggcgttgcattcccagagcatggctgtgtgacagggaagacgactgtggtgaccagacagatgaaatggcatcttgtgaattcccaacttgtgagccactaacccaattcgtatgcaaaagtggaagatgcattagcagcaaatggcactgcgactctgatgacgactgtggggacgggagtgatgaggtgggctgtgttcactcttgctttgataatcagttcagatgttccagtggcagatgcatcccaggccactgggcctgtgatggtgacaatgactgtggggacttcagtgatgaagcccagatcaattgtactaaagaagagattcattctcctgctggttgtaacggaaatgaatttcagtgccaccctgatggtaattgcgttcctgatttgtggcgctgtgatggagaaaaagactgtgaagatggtagtgatgaaaaaggttgcaatggtaccatacgattgtgtgaccacaaaaccaagttttcctgttggagtacagggagatgcatcaacaaagcatgggtgtgtgatggagatattgattgcgaagatcagtcagatgaagatgactgtgacagtttcttgtgtggaccacccaagcatccttgtgctaatgacacctcagtctgcctgcagccagagaaactctgcaatgggaaaaaggattgtcctgatggctctgatgaaggctatctctgtgatgagtgttcgctgaacaatggaggctgtagcaaccactgttctgttgttcctggaagaggaattgtctgttcctgccctgaaggacttcaactcaacaaagacaataaaacatgtgaaattgtggattattgtagcaatcatctaaagtgcagccaagtatgtgagcagcacaagcacacagtcaagtgctcatgttatgaaggttggaagctggatgtagacggtgaaagttgtacaagtgttgatccttttgaagcattcatcatcttttctattcgtcatgagatcagaaggattgatcttcacaaaagagactatagtctacttgttcctggattgagaaacacaatagcacttgattttcacttcaatcaaagtttactttattggacagatgttgtagaagacagaatataccggggaaagctttctgaaagtggaggtgtcagtgccattgaagtggttgtggagcatggcctggctactccagaaggcctgacagtcgactggatagcaggaaacatatactggatagacagcaatctggaccaaatcgaagtggccaaactagatggctccctaagaactacactaatagcaggagccatggaacaccccagggccattgctttggacccaagatatggaattcttttctggacagactgggatgcaaattttcctcgcattgaatctgcctctatgagtggtgctgggagaaaaaccatctataaagacatgaaaactggggcttggcctaatggactaactgtggaccactttgagaaaaggatagtgtggacagacgccaggtcagatgctatttattcagccctctatgatggaacaaacatgatagaaatcatccgaggtcatgaatacctttcccatccctttgctgtgtctctatatgggagtgaagtctactggacagactggaggaccaacacattgtccaaagccaataagtggacagggcagaatgtcagtgtgattcagaaaaccagtgcacagccatttgaccttcagatataccatcccagtcgccagccacaggctcccaatccttgtgcagctaatgatggcaaaggcccctgctctcacatgtgtctaatcaatcacaataggagtgctgcctgtgcgtgcccccacttgatgaagctttcttcagacaagaagacctgctatgaaatgaaaaaatttcttctttatgcaagacgttctgaaatcagaggagtggatattgacaatccatactttaacttcatcacggcatttacagtccctgatattgatgacgttactgtgatagacttcgatgcatctgaggaacgtttatactggacagatattaaaacacaaaccattaaacgagcttttattaacggaactgggttagaaactgttatttcaagagatattcagagtatcagagggctagcagtggattgggtgtcacgtaatttatactggattagctcagaatttgatgaaacgcaaattaatgtggcaaggctagatggctctttgaaaacctcaattatccatggaatcgataagccacagtgtcttgcagctcacccagtcaggggaaaactctactggaccgatggaaacacaattaacatggcaaatatggatggcagtaatagcaagattctgtttcagaatcagaaggagccagttggtctatcgatagactatgtggaaaacaagctttattggatcagttcggggaatggaaccataaatagatgcaacctggatggtggtaatttagaagtaatcgagtcaatgaaagaagaattaacaaaagctacagccctaaccatcatggataagaaactgtggtgggcagaccaaaacttagcccagctaggaacctgcagcaaaagagacggaagaaaccccaccatcctacggaataagacttctggggtagttcatatgaaagtctatgataaagaagcacagcaaggcagcaattcctgccaactaaacaatggtggatgctctcaactttgtttaccaacatctgaaactacaaggacttgtatgtgtacagtgggatattatctccaaaagaaccgtatgtcatgtcaaggtatagaatcatttcttatgtactctgttcatgaaggaatcaggggaatacctcttgaaccaagtgacaaaatggatgctttgatgcctatatcaggaacttcatttgccgtgggaatagatttccatgcagaaaatgataccatctactggacagacatgggcttcaataaaattagcagagctaaaagagatcagacttggaaagaagatatcattaccaatggcttgggaagagtggaagggatagctgttgactggattgctggtaacatatattggacagatcatggtttcaacttaattgaagttgcaagactcaatggttctttccgttatgtaattatttcccaaggcctggatcaaccaagatctatagctgtgcacccagagaaaggcctcttgttctggactgaatggggacaaatgccctgtattggaaaggctcgcttggatggctcagagaaggttgtccttgtaagcatgggaatagcatggccgaatggcatctccatcgactatgaggaaaataaattgtactggtgtgatgctcgcacagacaagatagagagaatcgaccttgagactggagggaatcgcgagatggtgctgtcaggaagcaatgtggatatgttttcagttgcagtctttggggcttacatctactggtctgacagagcacatgcaaacgggtctgtcagaaggggccacaagaatgatgccacagaaacgataaccatgagaaccggccttggagtcaacctgaaggaggttaaaatatttaaccgagtaagagagaaagggaccaatgtttgtgccagggacaatggtggctgtaagcaactctgtctttatcgaggaaattcccggagaacttgtgcttgtgcccatggatatttggcagaagatggagttacttgcctgaggcatgaaggctatttactgtattcaggaagaacaatattaaaaagtatacatctttctgatgaaaccaatttaaattccccaataaggccatatgagaatccacgttatttcaagaatgtcatagccttggcttttgactataatcaaagaagaaaaggtaccaaccgaatcttttacagtgatgcacactttggaaatatacagcttattaaagacaactgggaagacagacaagtaattgttgaaaatgtgggttctgtggaaggacttgcctatcacagagcctgggatacactgtactggacaagctctaccacctcatccatcaccagacacactgtggaccagactcggcctggagcatttgacagggaagctgtcatcaccatgtcagaagatgaccatccacatgtgctagccttggatgaatgtcaaaatttaatgttttggaccaactggaatgaacaacatccaagtatcatgagatctactctgactgggaaaaatgctcaagtggtggtcagtacagacatactcactccaaatggacttactatcgactaccgtgcagagaagctgtatttctcagatggcagtctaggaaaaattgaaaggtgtgaatacgatggatcccagagacatgtgatagttaaatctgggccagggactttcctcagtttggctgtttatgacaattatatattctggtcggactggggaagaagagctatactgcggtccaacaagtacacaggaggagatacaaaaattcttcgttccgatattccacatcagccaatgggaatcatagctgttgccaatgacaccaatagctgtgaactttctccatgtgcattattgaatggaggctgccatgacttgtgccttttaactcccaatgggagagtgaattgttcctgcagaggggaccgaatattgctagaggacaacagatgtgtgactaaaaattcctcctgcaacgcttattcggagtttgaatgtggaaatggtgagtgcattgactaccagctcacctgtgatggcattcctcactgtaaagataaatcagatgaaaaactgctctactgtgaaaacagaagctgtcgaagaggcttcaagccatgctataatcgccgctgcattcctcatggcaagttatgtgatggagaaaatgactgcggagacaactctgatgaattagattgtaaagtttcaacctgtgccacggttgagttccgctgtgcagatgggacttgtattccaagatcagcacgatgcaaccagaacatagattgtgcagatgcttcagatgaaaagaactgcaataacacagactgcacacatttctataagcttggagtgaaaaccacagggttcataagatgtaattctacctcactgtgtgttctgccaacctggatatgcgacgggtctaatgactgtggagactattcagatgaattaaagtgcccagttcagaacaaacacaaatgtgaagaaaattattttagttgtcctagtggaagatgcattttgaatacctggatatgcgatggtcagaaagattgtgaggatggacgtgatgaattccactgtgattcttcttgctcttggaaccaatttgcttgttccgcacaaaaatgtatttctaagcattggatttgtgatggagaagatgactgtggggatgggttagatgaaagtgacagcatttgtggtgccataacctgtgctgctgacatgttcagctgccagggctctcgtgcctgcgtgccccgacattggctttgtgatggtgaaagggactgtccagatggaagcgatgagctttccacagcaggctgcgctcccaataatacatgtgatgaaaatgctttcatgtgccataataaagtatgcattcccaagcaatttgtttgtgaccatgatgacgactgtggagatggctctgatgagtcaccgcagtgtggataccgacagtgtggtacagaagaatttagttgtgctgatgggcggtgtcttctaaatactcaatggcagtgtgatggagactttgactgtcctgaccattctgatgaagcacctttaaacccaaagtgtaaaagtgcagaacagtcatgcaacagttcattttttatgtgcaaaaatggcaggtgcattcccagtggaggtctttgtgacaataaggatgactgtggcgatggttcagatgagagaaactgccatataaatgaatgtttgagtaagaaagtcagtggatgttctcaagattgtcaagaccttccggtcagttataagtgcaaatgctggcctggattccaactgaaggatgacggcaaaacatgtgtagacattgatgaatgctcttcaggctttccctgtagccagcaatgcatcaatacatacgggacttacaagtgcctctgtacagatgggtatgaaatacaacctgataacccaaatggctgcaaatcgctctcagatgaagaaccttttttaattcttgctgatcatcatgagataaggaaaattagcactgatggctccaactacacacttttaaaacagggattaaacaatgttattgctatagactttgattacagagaagaattcatctattggatcgattctagccgacccaatggcagtcgcataaatagaatgtgtttaaatggaagtgacattaaggtagttcataacacagcggtccccaatgcacttgctgtcgattggattggaaaaaacctctattggtctgacacagaaaaaagaatcattgaagtatccaaactcaatggcttgtaccctactatactcgttagcaaaaggctgaagtttcccagagacttgtctttagatcctcaagctggatatttgtattggattgactgctgcgagtatcctcatattggccgtgttggaatggatggaaccaatcagagtgttgtcatagaaaccaagatttctagacctatggcactaacaatagattatgttaatcgtagactctactgggccgatgaaaatcacattgaatttagcaacatggatggatctcatagacacaaagtccctaatcaagatattccaggggtgattgcactaacattgtttgaagactacatctactggactgatgggaaaaccaagtcactcagccgtgcccataaaacatcgggagcagacagactctcactgatttactcatggcatgccatcacagatatccaggtgtatcattcttatagacaacctgatgtctccaaacatctctgcatgataaataatggtggttgcagtcatttgtgccttttagcccctggaaaaacccacacttgtgcatgtcccactaacttctatctggcagctgataataggacttgcttatccaactgcacagccagccagtttcgttgcaaaactgacaaatgtattccattctggtggaaatgtgacaccgtggatgactgtggtgatggatctgatgaacctgatgactgtcctgaatttagatgtcagccaggccgatttcagtgtgggactggactctgtgctctaccagctttcatctgtgatggagagaatgattgtggagacaattctgatgaactcaactgtgacacacatgtctgcctgtcaggtcaattcaaatgtaccaagaaccagaaatgtatcccagtaaacttaagatgtaatgggcaagatgactgtggtgatgaggaagatgaaagagactgtcctgaaaacagctgttctccagactatttccagtgtaagactacgaagcattgcatttccaagctgtgggtttgtgacgaggatccagactgtgcagatgcatcagacgaggccaactgcgataaaaagacttgtggacctcatgaattccagtgtaaaaacaacaactgtattcccgatcactggcggtgtgatagccaaaatgactgcagtgataattcagatgaagaaaactgtaagccacagacatgtacattgaaagatttcctctgtgccaatggggactgtgtttcttcaaggttttggtgtgatggagattttgactgtgcagatggctctgatgagagaaattgtgagacaagttgttccaaagatcagttccggtgttccaatggtcagtgtataccagcaaaatggaaatgtgatggccatgaagactgcaaatatggggaagatgagaaaagctgtgagccagcttctcctacttgctcatcacgtgaatatatatgtgccagtgatggatgtatttcagcatctttgaaatgtaatggagaatatgattgtgctgatggttcagatgagatggactgtgtgactgaatgtaaggaagatcagtttcggtgcaaaaataaagcccactgtattccaattagatggctgtgtgatggaattcatgactgtgtggatggcagtgatgaagagaactgtgaaagaggaggaaatatatgtagagctgatgagttcctttgcaataattctctctgcaaactacatttctgggtgtgtgatggagaggacgactgtggagacaactctgatgaagcccctgatatgtgtgtcaaatttctttgtccatccacgagacctcacagatgcagaaataacagaatatgcctacagtcggagcaaatgtgcaatgggattgatgaatgcggtgacaattcagatgaagatcactgtggtggtaagctgacatataaagcaaggccttgtaaaaaggatgagtttgcttgtagtaataaaaaatgcatccctatggatctccagtgtgatcgacttgatgactgcggagatggttcagatgagcaaggatgcagaatagctcctactgaatatacctgtgaagataatgtgaatccatgtggagatgatgcatattgtaatcaaataaaaacatctgttttctgtcgctgtaagcctggatttcagagaaacatgaaaaacagacaatgtgaagaccttaatgaatgtttggtgtttggcacatgttcccatcaatgtataaatgtggaaggatcatataaatgtgtgtgtgaccagaattttcaagaaagaaataacacctgcatagcagaaggctctgaagatcaagttctctacattgctaatgacactgatatcctgggttttatatatccattcaactacagtggcgatcatcaacaaatttctcatattgaacataattcaagaataacagggatggatgtatattatcaaagagatatgattatttggagtactcagtttaatccaggcggaattttctacaaaaggatccatggcagagaaaaaaggcaagcaaacagtggcttgatttgtcctgaatttaaaaggcccagggacattgcagttgactgggtggctggaaacatttactggactgatcattctagaatgcattggttcagttactacactactcactggaccagtctgaggtactctatcaacgtagggcagctgaatggccccaactgcaccagactcttaacaaatatggctggagaaccctatgctattgcagtaaatcctaaaagagggatgatgtactggactgttgttggggatcattcccatatagaagaagcagccatggatggtacactgagaaggattttagtacaaaagaacttacagagacccacaggtttggctgtggattattttagtgaacgcatatattgggctgactttgagctctccatcattggcagtgttctgtatgatggctctaattcagtagtctctgtcagcagcaaacaaggtttattacatccacataggatcgatatctttgaagattatatatatggagcaggacctaaaaatggtgtatttcgagttcaaaaatttggccatggttcagtagagtacttagctttaaatattgataaaacaaaaggtgttttgatatctcatcgttataaacaactagatttacccaatccatgcttggatttagcatgcgaatttctttgcttgctaaatccttctggggccacttgtgtgtgtccagaaggaaaatatttgattaatggcacctgcaatgatgacagcctgttagatgattcatgtaagttaacttgtgaaaatggaggaagatgcattttaaatgagaaaggtgatttgaggtgtcactgttggcccagttattcaggagaaagatgtgaagtcaaccactgtagcaactactgccagaatggaggaacttgcgtaccatcagttctagggagacccacctgcagctgtgcactgggtttcactgggccaaactgtggtaagacagtctgtgaggatttttgtcaaaatggaggaacctgcattgtgactgctggaaaccagccttactgccactgccagccggaatacaccggagacagatgtcagtactacgtgtgccaccactattgtgtgaattctgaatcatgtaccattggggatgatggaagtgttgaatgtgtctgtccaacgcgctatgaaggaccaaaatgtgaggttgacaagtgtgtaaggtgccatggggggcactgcattataaataaagacagtgaagatatattttgcaactgcactaatggaaagattgcctctagctgtcagttatgtgatggctactgttacaatggtggcacatgccagctggaccccgagacaaatgtacctgtgtgtctatgctccaccaactggtcaggcacacagtgtgaaaggccagccccaaagagcagcaagtctgatcatatcagcacaagaagcattgccatcattgtgcctctcgtcctcttggtgactttgataaccaccttagtaattggtttagtgctttgtaaaagaaaaagaaggacaaaaacaattagaagacaacctattatcaatggaggaataaatgtagaaattggcaatccatcttataacatgtatgaggtagatcatgatcacaacgatggaggtcttttagatcctggctttatgatagacccaacaaaggccaggtacatagggggaggacccagtgctttcaagcttccacacacagcgccgcccatctacctaaactctgatttgaaaggaccactaactgctgggccaacaaattactccaatccggtatatgcaaaattatatatggatgggcaaaactgtcgaaactccttaggaagtgttgatgaaaggaaagaactgcttccaaagaaaatagaaattggtataagagagacagtggcataatcagtgatatcttttatatgctgtataaatgtataaaatataaggattacttttgtatgttccaacagtattatacttgttttggcatcagcattacctctttctttatctttttcctggttaattgttttctgagttttttgggttttattttttgctgatgactattgattgaccatttgtatggtatttttatgaaaaagaactgcactacagtacaatttacaacaatgctgctgatatgacacacctttgaatttgttaaaattaaaaacaacgtattcctttgtagtgtgaatatgagcaatctattttatatgaacttttttggttgtacttaatcaacgaggagaatctctgcacttttccattatacggtttgaaggctgtaatacagtgtcattttatttttctgtttaaattgatggaaaaatgattgaatggtcaactctcttctttgtgcccataaagatcgattcagactctgctgaaaatatatagctctcacaagttcagcatcacctgctttgaaattagccttagattgccaaccaatagatgagaattttgaggaaaaaaattaaaaatatgtaaaattaataatttgcatgaacacagatgactacattttccaaaacttagtggactctatgtgatgtactaaatgtatacaccttgtaagcaatagttatatttaggtggtagaacatagcaaaaatataaccgaaagttggccgactgcacttgctatggaataagaccttttattctccctcagtctcgagataaatagccagcctagagcacaacagggcattgggtacttgcatcttaggtatttcttcccagtcacatccattttgtggaagattaacccaaccccttacactacactgaacactaaagaataacatataagcacacaaattggtgacagaatttcaattacgtgaacgcatcctctttgctaggtcaaaaacaaagggcaaagcagacattttagtatacagagtgattggcaaatattttcaagatttaatatgagcaacccattatttgccctatccaaaatatattcaagggccttccaagttgtagaagaacaatgatcttcccataatcaaaagtggagagtcgaaatgctgtgccagttgctctggtattcaggtttctctgggttttacagaacgcatggaccccattcacgtttggtttgtttatcttcaaatttgagttgaaacgagtgcgatttatttaagttgtatataaaaataaaaggatagcatttttatacaaatatctttaaaggcacaaaagatttattcacaagttttggagggctttttgttcctctgatagacatgactgacttttagctgtcataatgtattaacctaacagatgaaatatgttaaatatgtggttgctctttatccctttgtacaagcattaaaaaaactgctgttttataagaagactttttgttgtactatgtgcatgcatactacctatttctaaactttgccatattgaggcctttataaactattgatttatgtaatactagtgcaattttgcttgaacaatgttatgcatatcataaactttttcaggttcttgtttaagtacattttttaaattgaacagtatttttcattttggttataatatagtcattttgcctatgtttctacaatgaagtgttaaatactttataaaaaattgttgactgacttatttaaatgaaattctacatattt

SEQ ID NO: 312526 - DNA, 426 bp, Homo sapiens
gtctgtaaaatttgcttttaataaataaatatgttctccaaagctacattttaatggcagttttctttctaagctgaaaacagctgttctccagactatttccagtgtaagactacgaagcattgcatttccaagctgtgggtttgtgacgaggatccagactgtgcagatgcatcagacgaggccaactgcggtgagtgtctgtgactctgggtcttatctctccgtatttgagtcatcatctgcgacaaccacagttaaacaaatttgaacacaattcttttgaagctaaggtcttacctgaaaaggttttgtctctgtgttcacagattcataaaaacttaggttagctactttacaagaagcctggagtgataagatggaagagtaagtattccttaatataacccagaactttataaaaca

SEQ ID NO: 312527 - DNA, 16532 bp, Homo sapiens
aaagacagaaccccagagaaaaacgctgccaattcgttgctttattgttccctgcctggggacctcaatagccttttccattaaccttcccttcttacgcaacggttaatgacttttggggttgttttgctttctgtttctgctgagtcactaaattttgcctctttgtccccaggtgctgctcagcataaaagttaaaagtgcaattcaggaagtactgggattctgtgtagagccgaggaaaccatttccctaagagaagctctgttccttggcttgtccttccttcccgggaaggaagcttccgaggaacgaagggagaagctttgttttgcctgcagaagcagccctgtgctcggctgagggttctcagctggctgtgaactgcggagcattgtaggcgcctggctggctcaggccaatgcagaagtctctcccttctccaaagacccaaatccccacagaaccagcttcgagttactttcccttcaaggggattaaaataattgtgatttgtggcgctctccgttcgcggtggtattttcctgttgtgttaaatgcctcttattaagtaatagatgtgatttatgtgaacgacgaaggggtgtgtggtggattcggtgattaatcagtgaattcccatccgctggcatctctcactgcccctcttgcgtgatgtaagatcagacgtaccctgcattgaaaagtcaagacacacgggcgtctcgctcgcgctcacacacgctctgcctcctctctcccgcacgcgcgcatccctccaccttccacatcctgctccaggcaggagaaggctgactggctggactcattgagctgaagaatttccagtgacatttgtaaatgacgccgctcgattccaggctccaagcggccgctgccgccgccgccgccgccgggccgaaggtgccgccgagcagtctccagcgcaggcttccttaccgggcgaccacaatgtccgagtttctcctcgccttactcactctctcgggattattgccgattgccagggtgctgaccgtgggagccgaccgagatcagcagttgtgtgatcctggtgaatttctttgccacgatcacgtgacttgtgtctcccagagctggctgtgtgatggggaccctgactgccctgatgattcagacgagtctttagatacctgtcccgaggaggtagaaatcaagtgccccttgaatcacattgcttgccttggtaccaacaaatgtgttcatttatcccagctgtgcaatggtgtcttggactgcccagatgggtatgacgaaggagtacattgtcaggaactgttatccaattgccaacagctgaattgtcagtataaatgtacaatggtcagaaatagtacaagatgttactgtgaggatggattcgaaataacagaagatgggagaagctgtaaagatcaagatgaatgtgctgtttatggtacatgcagccagacctgcagaaacacacatggatcctacacttgcagttgtgtggaaggctacctaatgcagccagacaacagatcttgcaaggctaaaattgaacctacagatagaccacctatactattaattgcaaattttgaaacaattgaggttttctatcttaatggaagtaaaatggcaactctaagctcagtcaatggaaatgaaattcatactctggattttatttataatgaagatatgatttgttggattgaatcaagagaatcttcaaatcaactcaaatgtatccagataacaaaagcaggaggattaacagatgaatggacaatcaatattcttcaatccttccacaatgtgcaacaaatggcgattgactggctcactcgaaatctctattttgtggaccatgtcggtgaccggatctttgtttgtaattccaacggttctgtatgtgtcaccctgattgatctggagcttcacaatcctaaagcaatagcagtagatccaatagcaggaaaacttttctttactgactacgggaatgtcgccaaagtggagagatgtgacatggatgggatgaaccgaacaaggataattgattcaaagacagagcagccagctgcactggcactagacctagtcaacaaattggtttactgggtagatctttacttggactatgtgggagtagtggactatcaaggaaaaaatagacacactgtcattcaaggcagacaagtcagacatctttatggtataactgtgtttgaagattatttgtatgcaaccaattctgataactacaatatcgtaaggataaaccgatttaatgggactgatattcactcattaattaaaattgagaatgcttggggaatccgaatttatcaaaaaagaactcaaccaacagtcagaagccatgcatgtgaagtcgatccatatggaatgccagggggctgttcacacatctgtctactcagcagcagttacaaaactcggacttgtcgctgcaggactggcttcaacttgggaagtgatggcaggtcatgcaaaagaccaaagaatgagttgttcctcttttatgggaaaggacgcccaggaattgttagaggaatggacttgaataccaagatagctgatgaatacatgatccccatagaaaatctggtaaaccctcgtgctttagactttcacgcagaaaccaattacatctactttgctgacaccaccagtttcctaattggccggcagaagatagatggcacagagagagaaaccatcctgaaagatgatctggataatgtagagggcattgctgtggactggattggaaataatctttactggaccaatgatggccataggaaaaccattaatgtggccaggctggaaaaagcttctcagagtcggaagactcttttagagggtgaaatgtctcatcccagaggaattgtggtggatccagttaatggttggatgtattggacagactgggaggaagatgaaatagatgacagcgtgggaaggattgagaaggcctggatggatggattcaatcggcagatttttgtgacttcaaagatgctgtggccaaacggtttaactctggactttcacaccaacacattatactggtgtgatgcctattacgatcatattgaaaaagtatttttgaatgggactcacaggaagattgtttacagtgggagagagttgaaccaccctttcggactgtcgcatcatggaaattatgtgttctggactgattatatgaatggttccatttttcaactagatttgataacaagtgaggtgacattgctgaggcatgaaagaccacccctatttgggcttcagatttatgatccacgaaagcaacaaggtgacaatatgtgccgagtaaataatgggggctgtagtacactttgcttggctatcccaggaggccgggtgtgtgcttgtgccgataatcaacttttggatgaaaatgggacaacttgcacatttaatcctggagaagcactacctcacatatgtaaagctggagagtttcgctgcaaaaacagacactgtatccaagctcggtggaaatgtgatggcgacgatgactgcctagacggaagcgatgaggattcagtaaactgcttcaatcatagctgtcctgatgatcagtttaaatgccagaataatcgctgcatccccaagagatggctttgtgatggagctaatgactgtgggagcaatgaagatgaatccaatcaaacttgcacagccagaacatgccaggtagaccagttttcttgcggaaatgggcgttgcattcccagagcatggctgtgtgacagggaagacgactgtggtgaccagacagatgaaatggcatcttgtgaattcccaacttgtgagccactaacccaattcgtatgcaaaagtggaagatgcattagcagcaaatggcactgcgactctgatgacgactgtggggacgggagtgatgaggtgggctgtgttcactcttgctttgataatcagttcagatgttccagtggcagatgcatcccaggccactgggcctgtgatggtgacaatgactgtggggacttcagtgatgaagcccagatcaattgtactaaagaagagattcattctcctgctggttgtaacggaaatgaatttcagtgccaccctgatggtaattgcgttcctgatttgtggcgctgtgatggagaaaaagactgtgaagatggtagtgatgaaaaaggttgcaatggtaccatacgattgtgtgaccacaaaaccaagttttcctgttggagtacagggagatgcatcaacaaagcatgggtgtgtgatggagatattgattgcgaagatcagtcagatgaagatgactgtgacagtttcttgtgtggaccacccaagcatccttgtgctaatgacacctcagtctgcctgcagccagagaaactctgcaatgggaaaaaggattgtcctgatggctctgatgaaggctatctctgtgatgagtgttcgctgaacaatggaggctgtagcaaccactgttctgttgttcctggaagaggaattgtctgttcctgccctgaaggacttcaactcaacaaagacaataaaacatgtgaaattgtggattattgtagcaatcatctaaagtgcagccaagtatgtgagcagcacaagcacacagtcaagtgctcatgttatgaaggttggaagctggatgtagacggtgaaagttgtacaagtgttgatccttttgaagcattcatcatcttttctattcgtcatgagatcagaaggattgatcttcacaaaagagactatagtctacttgttcctggattgagaaacacaatagcacttgattttcacttcaatcaaagtttactttattggacagatgttgtagaagacagaatataccggggaaagctttctgaaagtggaggtgtcagtgccattgaagtggttgtggagcatggcctggctactccagaaggcctgacagtcgactggatagcaggaaacatatactggatagacagcaatctggaccaaatcgaagtggccaaactagatggctccctaagaactacactaatagcaggagccatggaacaccccagggccattgctttggacccaagatatggaattcttttctggacagactgggatgcaaattttcctcgcattgaatctgcctctatgagtggtgctgggagaaaaaccatctataaagacatgaaaactggggcttggcctaatggactaactgtggaccactttgagaaaaggatagtgtggacagacgccaggtcagatgctatttattcagccctctatgatggaacaaacatgatagaaatcatccgaggtcatgaatacctttcccatccctttgctgtgtctctatatgggagtgaagtctactggacagactggaggaccaacacattgtccaaagccaataagtggacagggcagaatgtcagtgtgattcagaaaaccagtgcacagccatttgaccttcagatataccatcccagtcgccagccacaggctcccaatccttgtgcagctaatgatggcaaaggcccctgctctcacatgtgtctaatcaatcacaataggagtgctgcctgtgcgtgcccccacttgatgaagctttcttcagacaagaagacctgctatgaaatgaaaaaatttcttctttatgcaagacgttctgaaatcagaggagtggatattgacaatccatactttaacttcatcacggcatttacagtccctgatattgatgacgttactgtgatagacttcgatgcatctgaggaacgtttatactggacagatattaaaacacaaaccattaaacgagcttttattaacggaactgggttagaaactgttatttcaagagatattcagagtatcagagggctagcagtggattgggtgtcacgtaatttatactggattagctcagaatttgatgaaacgcaaattaatgtggcaaggctagatggctctttgaaaacctcaattatccatggaatcgataagccacagtgtcttgcagctcacccagtcaggggaaaactctactggaccgatggaaacacaattaacatggcaaatatggatggcagtaatagcaagattctgtttcagaatcagaaggagccagttggtctatcgatagactatgtggaaaacaagctttattggatcagttcggggaatggaaccataaatagatgcaacctggatggtggtaatttagaagtaatcgagtcaatgaaagaagaattaacaaaagctacagccctaaccatcatggataagaaactgtggtgggcagaccaaaacttagcccagctaggaacctgcagcaaaagagacggaagaaaccccaccatcctacggaataagacttctggggtagttcatatgaaagtctatgataaagaagcacagcaaggcagcaattcctgccaactaaacaatggtggatgctctcaactttgtttaccaacatctgaaactacaaggacttgtatgtgtacagtgggatattatctccaaaagaaccgtatgtcatgtcaaggtatagaatcatttcttatgtactctgttcatgaaggaatcaggggaatacctcttgaaccaagtgacaaaatggatgctttgatgcctatatcaggaacttcatttgccgtgggaatagatttccatgcagaaaatgataccatctactggacagacatgggcttcaataaaattagcagagctaaaagagatcagacttggaaagaagatatcattaccaatggcttgggaagagtggaagggatagctgttgactggattgctggtaacatatattggacagatcatggtttcaacttaattgaagttgcaagactcaatggttctttccgttatgtaattatttcccaaggcctggatcaaccaagatctatagctgtgcacccagagaaaggcctcttgttctggactgaatggggacaaatgccctgtattggaaaggctcgcttggatggctcagagaaggttgtccttgtaagcatgggaatagcatggccgaatggcatctccatcgactatgaggaaaataaattgtactggtgtgatgctcgcacagacaagatagagagaatcgaccttgagactggagggaatcgcgagatggtgctgtcaggaagcaatgtggatatgttttcagttgcagtctttggggcttacatctactggtctgacagagcacatgcaaacgggtctgtcagaaggggccacaagaatgatgccacagaaacgataaccatgagaaccggccttggagtcaacctgaaggaggttaaaatatttaaccgagtaagagagaaagggaccaatgtttgtgccagggacaatggtggctgtaagcaactctgtctttatcgaggaaattcccggagaacttgtgcttgtgcccatggatatttggcagaagatggagttacttgcctgaggcatgaaggctatttactgtattcaggaagaacaatattaaaaagtatacatctttctgatgaaaccaatttaaattccccaataaggccatatgagaatccacgttatttcaagaatgtcatagccttggcttttgactataatcaaagaagaaaaggtaccaaccgaatcttttacagtgatgcacactttggaaatatacagcttattaaagacaactgggaagacagacaagtaattgttgaaaatgtgggttctgtggaaggacttgcctatcacagagcctgggatacactgtactggacaagctctaccacctcatccatcaccagacacactgtggaccagactcggcctggagcatttgacagggaagctgtcatcaccatgtcagaagatgaccatccacatgtgctagccttggatgaatgtcaaaatttaatgttttggaccaactggaatgaacaacatccaagtatcatgagatctactctgactgggaaaaatgctcaagtggtggtcagtacagacatactcactccaaatggacttactatcgactaccgtgcagagaagctgtatttctcagatggcagtctaggaaaaattgaaaggtgtgaatacgatggatcccagagacatgtgatagttaaatctgggccagggactttcctcagtttggctgtttatgacaattatatattctggtcggactggggaagaagagctatactgcggtccaacaagtacacaggaggagatacaaaaattcttcgttccgatattccacatcagccaatgggaatcatagctgttgccaatgacaccaatagctgtgaactttctccatgtgcattattgaatggaggctgccatgacttgtgccttttaactcccaatgggagagtgaattgttcctgcagaggggaccgaatattgctagaggacaacagatgtgtgactaaaaattcctcctgcaacgcttattcggagtttgaatgtggaaatggtgagtgcattgactaccagctcacctgtgatggcattcctcactgtaaagataaatcagatgaaaaactgctctactgtgaaaacagaagctgtcgaagaggcttcaagccatgctataatcgccgctgcattcctcatggcaagttatgtgatggagaaaatgactgcggagacaactctgatgaattagattgtaaagtttcaacctgtgccacggttgagttccgctgtgcagatgggacttgtattccaagatcagcacgatgcaaccagaacatagattgtgcagatgcttcagatgaaaagaactgcaataacacagactgcacacatttctataagcttggagtgaaaaccacagggttcataagatgtaattctacctcactgtgtgttctgccaacctggatatgcgacgggtctaatgactgtggagactattcagatgaattaaagtgcccagttcagaacaaacacaaatgtgaagaaaattattttagttgtcctagtggaagatgcattttgaatacctggatatgcgatggtcagaaagattgtgaggatggacgtgatgaattccactgtgattcttcttgctcttggaaccaatttgcttgttccgcacaaaaatgtatttctaagcattggatttgtgatggagaagatgactgtggggatgggttagatgaaagtgacagcatttgtggtgccataacctgtgctgctgacatgttcagctgccagggctctcgtgcctgcgtgccccgacattggctttgtgatggtgaaagggactgtccagatggaagcgatgagctttccacagcaggctgcgctcccaataatacatgtgatgaaaatgctttcatgtgccataataaagtatgcattcccaagcaatttgtttgtgaccatgatgacgactgtggagatggctctgatgagtcaccgcagtgtggataccgacagtgtggtacagaagaatttagttgtgctgatgggcggtgtcttctaaatactcaatggcagtgtgatggagactttgactgtcctgaccattctgatgaagcacctttaaacccaaagtgtaaaagtgcagaacagtcatgcaacagttcattttttatgtgcaaaaatggcaggtgcattcccagtggaggtctttgtgacaataaggatgactgtggcgatggttcagatgagagaaactgccatataaatgaatgtttgagtaagaaagtcagtggatgttctcaagattgtcaagaccttccggtcagttataagtgcaaatgctggcctggattccaactgaaggatgacggcaaaacatgtgtagacattgatgaatgctcttcaggctttccctgtagccagcaatgcatcaatacatacgggacttacaagtgcctctgtacagatgggtatgaaatacaacctgataacccaaatggctgcaaatcgctctcagatgaagaaccttttttaattcttgctgatcatcatgagataaggaaaattagcactgatggctccaactacacacttttaaaacagggattaaacaatgttattgctatagactttgattacagagaagaattcatctattggatcgattctagccgacccaatggcagtcgcataaatagaatgtgtttaaatggaagtgacattaaggtagttcataacacagcggtccccaatgcacttgctgtcgattggattggaaaaaacctctattggtctgacacagaaaaaagaatcattgaagtatccaaactcaatggcttgtaccctactatactcgttagcaaaaggctgaagtttcccagagacttgtctttagatcctcaagctggatatttgtattggattgactgctgcgagtatcctcatattggccgtgttggaatggatggaaccaatcagagtgttgtcatagaaaccaagatttctagacctatggcactaacaatagattatgttaatcgtagactctactgggccgatgaaaatcacattgaatttagcaacatggatggatctcatagacacaaagtccctaatcaagatattccaggggtgattgcactaacattgtttgaagactacatctactggactgatgggaaaaccaagtcactcagccgtgcccataaaacatcgggagcagacagactctcactgatttactcatggcatgccatcacagatatccaggtgtatcattcttatagacaacctgatgtctccaaacatctctgcatgataaataatggtggttgcagtcatttgtgccttttagcccctggaaaaacccacacttgtgcatgtcccactaacttctatctggcagctgataataggacttgcttatccaactgcacagccagccagtttcgttgcaaaactgacaaatgtattccattctggtggaaatgtgacaccgtggatgactgtggtgatggatctgatgaacctgatgactgtcctgaatttagatgtcagccaggccgatttcagtgtgggactggactctgtgctctaccagctttcatctgtgatggagagaatgattgtggagacaattctgatgaactcaactgtgacacacatgtctgcctgtcaggtcaattcaaatgtaccaagaaccagaaatgtatcccagtaaacttaagatgtaatgggcaagatgactgtggtgatgaggaagatgaaagagactgtcctgaaaacagctgttctccagactatttccagtgtaagactacgaagcattgcatttccaagctgtgggtttgtgacgaggatccagactgtgcagatgcatcagacgaggccaactgcgataaaaagacttgtggacctcatgaattccagtgtaaaaacaacaactgtattcccgatcactggcggtgtgatagccaaaatgactgcagtgataattcagatgaagaaaactgtaagccacagacatgtacattgaaagatttcctctgtgccaatggggactgtgtttcttcaaggttttggtgtgatggagattttgactgtgcagatggctctgatgagagaaattgtgagacaagttgttccaaagatcagttccggtgttccaatggtcagtgtataccagcaaaatggaaatgtgatggccatgaagactgcaaatatggggaagatgagaaaagctgtgagccagcttctcctacttgctcatcacgtgaatatatatgtgccagtgatggatgtatttcagcatctttgaaatgtaatggagaatatgattgtgctgatggttcagatgagatggactgtgtgactgaatgtaaggaagatcagtttcggtgcaaaaataaagcccactgtattccaattagatggctgtgtgatggaattcatgactgtgtggatggcagtgatgaagagaactgtgaaagaggaggaaatatatgtagagctgatgagttcctttgcaataattctctctgcaaactacatttctgggtgtgtgatggagaggacgactgtggagacaactctgatgaagcccctgatatgtgtgtcaaatttctttgtccatccacgagacctcacagatgcagaaataacagaatatgcctacagtcggagcaaatgtgcaatgggattgatgaatgcggtgacaattcagatgaagatcactgtggtggtaagctgacatataaagcaaggccttgtaaaaaggatgagtttgcttgtagtaataaaaaatgcatccctatggatctccagtgtgatcgacttgatgactgcggagatggttcagatgagcaaggatgcagaatagctcctactgaatatacctgtgaagataatgtgaatccatgtggagatgatgcatattgtaatcaaataaaaacatctgttttctgtcgctgtaagcctggatttcagagaaacatgaaaaacagacaatgtgaagaccttaatgaatgtttggtgtttggcacatgttcccatcaatgtataaatgtggaaggatcatataaatgtgtgtgtgaccagaattttcaagaaagaaataacacctgcatagcagaaggctctgaagatcaagttctctacattgctaatgacactgatatcctgggttttatatatccattcaactacagtggcgatcatcaacaaatttctcatattgaacataattcaagaataacagggatggatgtatattatcaaagagatatgattatttggagtactcagtttaatccaggcggaattttctacaaaaggatccatggcagagaaaaaaggcaagcaaacagtggcttgatttgtcctgaatttaaaaggcccagggacattgcagttgactgggtggctggaaacatttactggactgatcattctagaatgcattggttcagttactacactactcactggaccagtctgaggtactctatcaacgtagggcagctgaatggccccaactgcaccagactcttaacaaatatggctggagaaccctatgctattgcagtaaatcctaaaagagggatgatgtactggactgttgttggggatcattcccatatagaagaagcagccatggatggtacactgagaaggattttagtacaaaagaacttacagagacccacaggtttggctgtggattattttagtgaacgcatatattgggctgactttgagctctccatcattggcagtgttctgtatgatggctctaattcagtagtctctgtcagcagcaaacaaggtttattacatccacataggatcgatatctttgaagattatatatatggagcaggacctaaaaatggtgtatttcgagttcaaaaatttggccatggttcagtagagtacttagctttaaatattgataaaacaaaaggtgttttgatatctcatcgttataaacaactagatttacccaatccatgcttggatttagcatgcgaatttctttgcttgctaaatccttctggggccacttgtgtgtgtccagaaggaaaatatttgattaatggcacctgcaatgatgacagcctgttagatgattcatgtaagttaacttgtgaaaatggaggaagatgcattttaaatgagaaaggtgatttgaggtgtcactgttggcccagttattcaggagaaagatgtgaagtcaaccactgtagcaactactgccagaatggaggaacttgcgtaccatcagttctagggagacccacctgcagctgtgcactgggtttcactgggccaaactgtggtaagacagtctgtgaggatttttgtcaaaatggaggaacctgcattgtgactgctggaaaccagccttactgccactgccagccggaatacaccggagacagatgtcagtactacgtgtgccaccactattgtgtgaattctgaatcatgtaccattggggatgatggaagtgttgaatgtgtctgtccaacgcgctatgaaggaccaaaatgtgaggttgacaagtgtgtaaggtgccatggggggcactgcattataaataaagacagtgaagatatattttgcaactgcactaatggaaagattgcctctagctgtcagttatgtgatggctactgttacaatggtggcacatgccagctggaccccgagacaaatgtacctgtgtgtctatgctccaccaactggtcaggcacacagtgtgaaaggccagccccaaagagcagcaagtctgatcatatcagcacaagaagcattgccatcattgtgcctctcgtcctcttggtgactttgataaccaccttagtaattggtttagtgctttgtaaaagaaaaagaaggacaaaaacaattagaagacaacctattatcaatggaggaataaatgtagaaattggcaatccatcttataacatgtatgaggtagatcatgatcacaacgatggaggtcttttagatcctggctttatgatagacccaacaaaggccaggtacatagggggaggacccagtgctttcaagcttccacacacagcgccgcccatctacctaaactctgatttgaaaggaccactaactgctgggccaacaaattactccaatccggtatatgcaaaattatatatggatgggcaaaactgtcgaaactccttaggaagtgttgatgaaaggaaagaactgcttccaaagaaaatagaaattggtataagagagacagtggcataatcagtgatatcttttatatgctgtataaatgtataaaatataaggattacttttgtatgttccaacagtattatacttgttttggcatcagcattacctctttctttatctttttcctggttaattgttttctgagttttttgggttttattttttgctgatgactattgattgaccatttgtatggtatttttatgaaaaagaactgcactacagtacaatttacaacaatgctgctgatatgacacacctttgaatttgttaaaattaaaaacaacgtattcctttgtagtgtgaatatgagcaatctattttatatgaacttttttggttgtacttaatcaacgaggagaatctctgcacttttccattatacggtttgaaggctgtaatacagtgtcattttatttttctgtttaaattgatggaaaaatgattgaatggtcaactctcttctttgtgcccataaagatcgattcagactctgctgaaaatatatagctctcacaagttcagcatcacctgctttgaaattagccttagattgccaaccaatagatgagaattttgaggaaaaaaattaaaaatatgtaaaattaataatttgcatgaacacagatgactacattttccaaaacttagtggactctatgtgatgtactaaatgtatacaccttgtaagcaatagttatatttaggtggtagaacatagcaaaaatataaccgaaagttggccgactgcacttgctatggaataagaccttttattctccctcagtctcgagataaatagccagcctagagcacaacagggcattgggtacttgcatcttaggtatttcttcccagtcacatccattttgtggaagattaacccaaccccttacactacactgaacactaaagaataacatataagcacacaaattggtgacagaatttcaattacgtgaacgcatcctctttgctaggtcaaaaacaaagggcaaagcagacattttagtatacagagtgattggcaaatattttcaagatttaatatgagcaacccattatttgccctatccaaaatatattcaagggccttccaagttgtagaagaacaatgatcttcccataatcaaaagtggagagtcgaaatgctgtgccagttgctctggtattcaggtttctctgggttttacagaacgcatggaccccattcacgtttggtttgtttatcttcaaatttgagttgaaacgagtgcgatttatttaagttgtatataaaaataaaaggatagcatttttatacaaatatctttaaaggcacaaaagatttattcacaagttttggagggctttttgttcctctgatagacatgactgacttttagctgtcataatgtattaacctaacagatgaaatatgttaaatatgtggttgctctttatccctttgtacaagcattaaaaaaactgctgttttataagaagactttttgttgtactatgtgcatgcatactacctatttctaaactttgccatattgaggcctttataaactattgatttatgtaatactagtgcaattttgcttgaacaatgttatgcatatcataaactttttcaggttcttgtttaagtacattttttaaattgaacagtatttttcattttggttataatatagtcattttgcctatgtttctacaatgaagtgttaaatactttataaaaaattgttgactgacttatttaaatgaaattctacatattt

SEQ ID NO: 312528 - DNA, 1633 bp, Homo sapiens
atcaatgaacccgcaatcatgaaacttctgacaccaccaggagctgactcacacctgaacagtacaccgtcgaagcttcgacggtgttctgccaagaactagtaatacccttgttttaaaatcttcacaaggtaaaacttaaaaagccaaccaaacaaattgctctccattctacttttaattgggccaaacagcatatgctacagtagtaacatgtttttcggagagtgtaaaaaactctgtttacatttgcctcctccgtgggttgatcgaaaatgtataaaactgactgcttctcgccagcctcagacaagaagagtgagttgctggtactcgctactcttttacttcttttgtaaagtattgactcttggaaggctacagtatacaaagtctcaacatgttttttaaaagaaataaggagcaagcgactgccctgctagaaatcacaaaccgatttttgtagaatattttgtgccccaggcattaatttcactgactccagaacctgcagttcagagaatgatttcttatgatgataaaaatcgaatgggatcagacgatgtttgcatttttttaatacttgaataggacacctcaagtttgagatttcattttcttttagaacacagtcacaagattaatctggtgaatccttttgtcacagttctcgtgtgtgtgtgcgcgtctccgtgtgtgtgtgtgtgcatgtgtgtaaaactgaatggtcacatttaattgctttttggaccattgaatagttgggaagtaagaattttttaattggcatgagacggttcctcaactgttaaattaaccaactttgacctgtctttagaaaaaggcttatttgtatgattttgggctaactccccggggaccatattaaatgacaaaaatgctcctttgggtgacacaccctacaaagtatttgctgttacgaacataaacgcccacattcttaatatctaatatttttgaccagtgatgttttatgctgtcatctgaaccctagagaagcagtgtcagaggaaaccttggtgtcacatgtgtcttagcaaaagggttaccatgatcgagggtcatgtgaccaaaagatgctccagagaagcttgagaatttgtttcaagttgggaggagggttggagatacaaaaatcactctgctctacaggactcttcagctgtctatgcaagaaattccgttttctctttcagcacctggaaagacacagcagcccaccgaggcgataggtgattcactaagcacaagaggaatgttttctaagcaaggcgtcccttgcctctcaaacaaatgccctccaagtttgttagggtttctattcctgcaacttgtggtatcaaaaccacttcctggaattgtcaaagcactgccaaaataaatgtttttcccccttctaagaaaaaaaaaatgacagtgctcatatttgacacttgtgtattggactctcttttgaatgaataaaaaggaaaaggggtttggtgtaattcctgatggggtgcgtgttgtttttcatgccatggtttgtgaattttaattgtggtttcccatttcgttgttgtaactgggcagaaattaaaaaagaaaaatcaataaaaatacaaagaaatgg

SEQ ID NO: 312529 - DNA, 1766 bp, Homo sapiens
caggagtcagttctgaatcttacaaagtgctctgcttaataagtaccttacttagcagagcactttgcaaacatattacttattagcagagctctttgtagaccttccacatctggctgtcagatcttaaggttgtgaatttaggctccagttacattcactggagagcataatcccacacgggttatttataaatacagagcctctgattggacggtgttctgccaagaactagtaatacccttgttttaaaatcttcacaaggtaaaacttaaaaagccaaccaaacaaattgctctccattctacttttaattgggccaaacagcatatgctacagtagtaacatgtttttcggagagtgtaaaaaactctgtttacatttgcctcctccgtgggttgatcgaaaatgtataaaactgactgcttctcgccagcctcagacaagaagagtgagttgctggtactcgctactcttttacttcttttgtaaagtattgactcttggaaggctacagtatacaaagtctcaacatgttttttaaaagaaataaggagcaagcgactgccctgctagaaatcacaaaccgatttttgtagaatattttgtgccccaggcattaatttcactgactccagaacctgcagttcagagaatgatttcttatgatgataaaaatcgaatgggatcagacgatgtttgcatttttttaatacttgaataggacacctcaagtttgagatttcattttcttttagaacacagtcacaagattaatctggtgaatccttttgtcacagttctcgtgtgtgtgtgcgcgtctccgtgtgtgtgtgtgtgcatgtgtgtaaaactgaatggtcacatttaattgctttttggaccattgaatagttgggaagtaagaattttttaattggcatgagacggttcctcaactgttaaattaaccaactttgacctgtctttagaaaaaggcttatttgtatgattttgggctaactccccggggaccatattaaatgacaaaaatgctcctttgggtgacacaccctacaaagtatttgctgttacgaacataaacgcccacattcttaatatctaatatttttgaccagtgatgttttatgctgtcatctgaaccctagagaagcagtgtcagaggaaaccttggtgtcacatgtgtcttagcaaaagggttaccatgatcgagggtcatgtgaccaaaagatgctccagagaagcttgagaatttgtttcaagttgggaggagggttggagatacaaaaatcactctgctctacaggactcttcagctgtctatgcaagaaattccgttttctctttcagcacctggaaagacacagcagcccaccgaggcgataggtgattcactaagcacaagaggaatgttttctaagcaaggcgtcccttgcctctcaaacaaatgccctccaagtttgttagggtttctattcctgcaacttgtggtatcaaaaccacttcctggaattgtcaaagcactgccaaaataaatgtttttcccccttctaagaaaaaaaaaatgacagtgctcatatttgacacttgtgtattggactctcttttgaatgaataaaaaggaaaaggggtttggtgtaattcctgatggggtgcgtgttgtttttcatgccatggtttgtgaattttaattgtggtttcccatttcgttgttgtaactgggcagaaattaaaaaagaaaaatcaataaaaatacaaagaaatgg

SEQ ID NO: 312530 - DNA, 791 bp, Homo sapiens
caaatccttcagacttgacagtgtgaggctggggttggcagtctgcttaacaagatgctgggaccacctctgaattagtgaatcagggagctgctgtgtgatcccctcctccaggctttcttggagtttgtctctgccacttcctcaagccctttaaaaaggctcctgtgctttagagagttaggatgttaatgaccgttcttttttcttgtactttattaagtactagtcttactagactagtgcttaagtggcagtgtctgcctttgccttctcccatctctttatgctcctttcttccaacttctcacgtttctgtttctcgcacggccaggtgtccagcatcccatgctgacttgcggttggccaatcccctcctcgtagatttcctccacattttcctcttcctccttttcctgtgggaagttctttttctgggctgtggctggtcttacgtagttcggtggaaaaagtattgaggtagtgttagatactgtgctgcacctccaggagtgtccaatcttttggcttccctgggccacactggaacaagaagaactgtcttgggccacacgtaaaatacacggacactaacgatagctgatgagctaaaaaaaaaaaaaattgcaaaaaaaatctcatagcgttttaagaaagtttgtgaatttgtgttgagccacattcaaagctgtcctggaccacatcttggacaagcttgcttacagtatttctgctggatttctggttccaactagctatggaaccctgtgagagatttgagtctccgctca

SEQ ID NO: 312531 - DNA, 879 bp, Homo sapiens
ttaatgcgagttccatgtgatgtgggccccttcaaaacaaagaccaaagaaatggtctatttcacagcggagcaggagtgagcggaggatggaagggtgtgatcaaggcccgacttgactctgacatccctttcctctggttagggggcgggacaccacgtgagggtctgcagggagagggtctgggagtggccttcctgggttttatggcctgcttcagggaagaaaggcagggaggttagaatggcctcaacggtgaaatatttatctttttcttcctccctaatcccagaattcagaaactgttagtgggtttgcataagttcaatgagaatctgttcttgtaatagggcacaattgaaaacattggttatattaccaaggctttgactggaatgtcctattttcagatacgactaaaggagttagggttgactgcatggtccaataaagccccttggaaaaaagctggcctggtacctcacatacgtggttcccttacagatgagtaaagaatgtcaattcctggcaggtcccagaatcttaagataccttagggacctcaagaagagaggaattcccctaaatctgtacttattgcaggcaaagtctgatggcaagtctttgcgatggcttcctagcctcaagaggcttttaaaagcccaatctcagattccttataaaaagttccagtaggccaggcacagtggctcacacctgtaatcccagcactttgggaggccacggtgggcagatcacgaggtcaggggatcgagaccatcctggctaacacggtgaaaccccgtctctactaaaaataaaaaaattagccgggcatggtggcgggtgcctgtagtcccagctatgcgggaggctgag

SEQ ID NO: 312532 - DNA, 989 bp, Homo sapiens
  misc_feature (15)..(15): n is a, c, g, or t
  misc_feature (76)..(76): n is a, c, g, or t
  misc_feature (92)..(92): n is a, c, g, or t
  misc_feature (96)..(96): n is a, c, g, or t
  misc_feature (115)..(115): n is a, c, g, or t
  misc_feature (121)..(121): n is a, c, g, or t
  misc_feature (131)..(131): n is a, c, g, or t
  misc_feature (134)..(134): n is a, c, g, or t
  misc_feature (146)..(146): n is a, c, g, or t
  misc_feature (158)..(158): n is a, c, g, or t
  misc_feature (163)..(163): n is a, c, g, or t
  misc_feature (196)..(196): n is a, c, g, or t
  misc_feature (202)..(202): n is a, c, g, or t
  misc_feature (204)..(204): n is a, c, g, or t
  misc_feature (209)..(209): n is a, c, g, or t
  misc_feature (233)..(233): n is a, c, g, or t
  misc_feature (239)..(239): n is a, c, g, or t
  misc_feature (241)..(241): n is a, c, g, or t
  misc_feature (248)..(248): n is a, c, g, or t
  misc_feature (254)..(255): n is a, c, g, or t
  misc_feature (278)..(278): n is a, c, g, or t
  misc_feature (282)..(282): n is a, c, g, or t
  misc_feature (299)..(299): n is a, c, g, or t
  misc_feature (303)..(303): n is a, c, g, or t
  misc_feature (317)..(317): n is a, c, g, or t
  misc_feature (328)..(328): n is a, c, g, or t
  misc_feature (351)..(351): n is a, c, g, or t
  misc_feature (356)..(356): n is a, c, g, or t
  misc_feature (360)..(360): n is a, c, g, or t
  misc_feature (371)..(371): n is a, c, g, or t
  misc_feature (382)..(382): n is a, c, g, or t
  misc_feature (388)..(388): n is a, c, g, or t
  misc_feature (405)..(405): n is a, c, g, or t
  misc_feature (411)..(411): n is a, c, g, or t
  misc_feature (421)..(421): n is a, c, g, or t
  misc_feature (429)..(429): n is a, c, g, or t
  misc_feature (467)..(468): n is a, c, g, or t
  misc_feature (474)..(474): n is a, c, g, or t
  misc_feature (505)..(505): n is a, c, g, or t
  misc_feature (521)..(521): n is a, c, g, or t
  misc_feature (527)..(527): n is a, c, g, or t
taaaaatgcttattngtcaattaaaaagaaaacccaaaaagaattggggaatgctttggaaagggtggtgtcctanggaatttcggaagaanaaanggaatttcttggcccaaanccaaancccaatggcnganaaattaatcaanggttttgcagcnctccngcatgggtgaatcaaaaggggaggaatggagcnttcggnangagtnccaaatttgaaaaatttatttaangaaagnancaaatcntttgtnnttttcgttgaaggggttagccanagcntgttttttcaaagttgngtcncacttggggtagcncaagcatgtgnagaacaaggttgtgtcccttgtnaaaanagcntttttatttcncttatattgtngtggcnacaatttcacaacatcncacaantgaggtcttntcaaaaanaacttttttttttttttgaaattattattttttttttnnagattnaatacaattaattagatacaaacagttttantgaacgcccgcgcggntttgcntttgtaacgtaactaaataatgtaatggcatctatattcagttgaagtgttttgatgtgcatgtgtacttcctaaggtgaaatgcatctatatacagacagcctctaaatcaagtccttcagtataattgatatatgtttttataatttcctcactggtataagtgtttcatatttgaaaaagttatctctgggtattgcataaaaggcttcatcttataaagtgaaatcattgttattgaattttaggaaggattaatggttaagtgtatataaaatactaatattaagtaaacttcatattggccaacaccagggttgtattctatggatgtcattattttgaattaagaattagtgtttaacattcctaaattgttttgagtgcttgattataatttgtaaaaaatgtttattttcaatacttctttaaatttaaaataaagcttatatttcaaatgtc

SEQ ID NO: 312533 - DNA, 2352 bp, Homo sapiens
gtgattgagcccaagaaaccagggacttacgcatttggccaatgtcaaaagaacagaactttgcccactgcacacttgctgtgtacaatgactgagccctttcttgtagtttgtttccttgtttgagaggtgtgcatgcgaccgtggcttttcccaaagtttctgactttgtggtttacccccttcaccttccagggacgcagttgttacgaggttagacgtggcagctctgtgcagtgtttgagcctacagtgggatacatagggtcaaattgagaataataaactgagtcattctcctggaaaaaaaaaaaaaaaaaactcgaggacgccgcgtgtacccggttgtcctcaggcgctgtcagatctgtggtttttctacttgaaggacacaatgttttccaaactagcacatttgcagaggtttgctgtacttagtcgcggagttcattcttcagtggcttctgctacatctgttgcaactaaaaaaacagtccaaggccctccaacctctgatgacatttttgaaagggaatataagtatggtgcacacaactaccatcctttacctgtagccctggagagaggaaaaggtatttacttatgggatgtagaaggcagaaaatattttgacttcctgagttcttacagtgctgtcaaccaagggcattgtcaccccaagattgtgaatgctctgaagagtcaagtggacaaattgaccttaacatctagagctttctataataacgtacttggtgaatatgaggagtatattactaaacttttcaactaccacaaagttcttcctatgaatacaggagtggaggctggagagactgcctgtaaactagctcgtaagtggggctataccgtgaagggcattcagaaatacaaagcaaagattgtttttgcagctgggaacttctggggtaggacgttgtctgctatctccagttccacagacccaaccagttacgatggttttggaccatttatgccgggattcgacatcattccctataatgatctgcccgcactggagcgtgctcttcaggatccaaatgtggctgcgttcatggtagaaccaattcagggtgaagcaggcgttgttgttccggatccaggttacctaatgggagtgcgagagctctgcaccaggcaccaggttctctttattgctgatgaaatacagacaggattggccagaactggtagatggctggctgttgattatgaaaatgtcagacctgatatagtcctccttggaaaggccctttctgggggcttataccctgtgtctgcagtgctgtgtgatgatgacatcatgctgaccattaagccaggggagcatgggtccacatacggtggcaatccactaggctgccgagtggccatcgcagcccttgaggttttagaagaagaaaaccttgctgaaaatgcagacaaattgggcattatcttgagaaatgaactcatgaagctaccttctgatgttgtaactgccgtaagaggaaaaggattattaaacgctattgtcattaaagaaaccaaagattgggatgcttggaaggtgtgtctacgacttcgagataatggacttctggccaagccaacccatggcgacattatcaggtttgcgcctccgctggtgatcaaggaggatgagcttcgagagtccattgaaattattaacaagaccatcttgtctttctgagggtagccagctgttttcagtggtccctgggagccagctggagacaggtggtcctgtaaaagctttattcctaatgtgggcacattccactcccatgagtcttcaaaaactttttttttgaatatatttttttcagttgatacataatagaacaacgtttatgaacctgccgtttgctttgtaacgtaactaaataatgtaatggcatctatattcagttgaagtgttttgatgtgcatgtgtacttcctaaggtgaaatgcatctatatacagacagcctctaaatcaagtccttcagtataattgatatatgtttttataatttcctcactggtataagtgtttcatatttgaaaaagttatctctgggtattgcataaaaggcttcatcttataaagtgaaatcattgttattgaattttaggaaggattaatggttaagtgtatataaaatactaatattaagtaaacttcatattggccaacaccagggttgtattctatggatgtcattattttgaattaagaattagtgtttaacattcctaaattgttttgagtgcttgattataatttgtaaaaaatgtttattttcaatacttctttaaatttaaaataaagcttatatttcaaatgtc

SEQ ID NO: 312534 - DNA, 1931 bp, Homo sapiens
  misc_feature (1908)..(1908): n is a, c, g, or t
aagttgcattgacgctccggcgtcactgttgcgcttcatagacgccgcgtgtacccggttgtcctcaggcgctgtcagatctgtggtttttctacttgaaggacacaatgttttccaaactagcacatttgcagaggtttgctgtacttagtcgcggagttcattcttcagtggcttctgctacatctgttgcaactaaaaaaacagtccaaggccctccaacctctgatgacatttttgaaagggaatataagtatggtgcacacaactaccatcctttacctgtagccctggagagaggaaaaggtatttacttatgggatgtagaaggcagaaaatattttgacttcctgagttcttacagtgctgtcaaccaagggcattgtcaccccaagattgtgaatgctctgaagagtcaagtggacaaattgaccttaacatctagagctttctataataacgtacttggtgaatatgaggagtatattactaaacttttcaactaccacaaagttcttcctatgaatacaggagtggaggctggagagactgcctgtaaactagctcgtaagtggggctataccgtgaagggcattcagaaatacaaagcaaagattgtttttgcagctgggaacttctggggtaggacgttgtctgctatctccagttccacagacccaaccagttacgatggttttggaccatttatgccgggattcgacatcattccctataatgatctgcccgcactggagcgtgctcttcaggatccaaatgtggctgcgttcatggtagaaccaattcagggtgaagcaggcgttgttgttccggatccaggttacctaatgggagtgcgagagctctgcaccaggcaccaggttctctttattgctgatgaaatacagacaggattggccagaactggtagatggctggctgttgattatgaaaatgtcagacctgatatagtcctccttggaaaggccctttctgggggcttataccctgtgtctgcagtgctgtgtgatgatgacatcatgctgaccattaagccaggggagcatgggtccacatacggtggcaatccactaggctgccgagtggccatcgcagcccttgaggttttagaagaagaaaaccttgctgaaaatgcagacaaattgggcattatcttgagaaatgaactcatgaagctaccttctgatgttgtaactgccgtaagaggaaaaggattattaaacgctattgtcattaaagaaaccaaagattgggatgcttggaaggtgtgtctacgacttcgagataatggacttctggccaagccaacccatggcgacattatcaggtttgcgcctccgctggtgatcaaggaggatgagcttcgagagtccattgaaattattaacaagaccatcttgtctttctgagggtagccagctgttttcagtggtccctgggagccagctggagacaggtggtcctgtaaaagctttattcctaatgtgggcacattccactcccatgagtcttcaaaaactttttttttgaatatatttttttcagttgatacataatagaacaacgtttatgaacctgccgtttgctttgtaacgtaactaaataatgtaatggcatctatattcagttgaagtgttttgatgtgcatgtgtacttcctaaggtgaaatgcatctatatacagacagcctctaaatcaagtccttcagtataattgatatatgtttttataatttcctcactggtataagtgtttcatatttgaaaaagttatctctgggtattgcataaaaggcttcatcttataaagtgaaatcattgttattgaattttaggaaggattaatggttaagtgttgcattattttgaataagcattagcgttaaccatnctaaattggttgaagggctgatt

SEQ ID NO: 312535 - DNA, 2026 bp, Homo sapiens
aagttgcattgacgctccggcgtcactgttgcgcttcatagacgccgcgtgtacccggttgtcctcaggcgctgtcagatctgtggtttttctacttgaaggacacaatgttttccaaactagcacatttgcagaggtttgctgtacttagtcgcggagttcattcttcagtggcttctgctacatctgttgcaactaaaaaaacagtccaaggccctccaacctctgatgacatttttgaaagggaatataagtatggtgcacacaactaccatcctttacctgtagccctggagagaggaaaaggtatttacttatgggatgtagaaggcagaaaatattttgacttcctgagttcttacagtgctgtcaaccaagggcattgtcaccccaagattgtgaatgctctgaagagtcaagtggacaaattgaccttaacatctagagctttctataataacgtacttggtgaatatgaggagtatattactaaacttttcaactaccacaaagttcttcctatgaatacaggagtggaggctggagagactgcctgtaaactagctcgtaagtggggctataccgtgaagggcattcagaaatacaaagcaaagattgtttttgcagctgggaacttctggggtaggacgttgtctgctatctccagttccacagacccaaccagttacgatggttttggaccatttatgccgggattcgacatcattccctataatgatctgcccgcactggagcgtgctcttcaggatccaaatgtggctgcgttcatggtagaaccaattcagggtgaagcaggcgttgttgttccggatccaggttacctaatgggagtgcgagagctctgcaccaggcaccaggttctctttattgctgatgaaatacagacaggattggccagaactggtagatggctggctgttgattatgaaaatgtcagacctgatatagtcctccttggaaaggccctttctgggggcttataccctgtgtctgcagtgctgtgtgatgatgacatcatgctgaccattaagccaggggagcatgggtccacatacggtggcaatccactaggctgccgagtggccatcgcagcccttgaggttttagaagaagaaaaccttgctgaaaatgcagacaaattgggcattatcttgagaaatgaactcatgaagctaccttctgatgttgtaactgccgtaagaggaattgggatgcttggaaggtgtgtctacgacttcgagataatggacttctggccaagccaacccatggcgacattatcaggtttgcgcctccgctggtgatcaaggaggatgagcttcgagagtccattgaaattattaacaagaccatcttgtctttctgagggtagccagctgttttcagtggtccctgggagccagctggagacaggtggtcctgtaaaagctttattcctaatgtgggcacattccactcccatgagtcttcaaaaactttttttttgaatatatttttttcagttgatacataatagaacaacgtttatgaacctgccgtttgctttgtaacgtaactaaataatgtaatggcatctatattcagttgaagtgttttgatgtgcatgtgtacttcctaaggtgaaatgcatctatatacagacagcctctaaatcaagtccttcagtataattgatatatgtttttataatttcctcactggtataagtgtttcatatttgaaaaagttatctctgggtattgcataaaaggcttcatcttataaagtgaaatcattgttattgaattttaggaaggattaatggttaagtgtatataaaatactaatattaagtaaacttcatattggccaacaccagggttgtattctatggatgtcattattttgaattaagaattagtgtttaacattcctaaattgttttgagtgcttgattataatttgtaaaaaatgtttattttcaatacttctttaaatttaaaataaagcttatatttcaaatgtc

SEQ ID NO: 312536 - DNA, 1975 bp, Homo sapiens
aagttgcattgacgctccggcgtcactgttgcgcttcatagacgccgcgtgtacccggttgtcctcaggcgctgtcagatctgtggtttttctacttgaaggacacaatgttttccaaactagcacatttgcagaggtttgctgtacttagtcgcggagttcattcttcagtggcttctgctacatctgttgcaactaaaaaaacagtccaaggccctccaacctctgatgacatttttgaaagggaatataagtatggtgcacacaactaccatcctttacctgtagccctggagagaggaaaaggtatttacttatgggatgtagaaggcagaaaatattttgacttcctgagttcttacagtgctgtcaaccaagggcattgtcaccccaagattgtgaatgctctgaagagtcaagtggacaaattgaccttaacatctagagctttctataataacgtacttggtgaatatgaggagtatattactaaacttttcaactaccacaaagttcttcctatgaatacaggagtggaggctggagagactgcctgtaaactagctcgtaagtggggctataccgtgaagggcattcagaaatacaaagcaaagattgtttttgcagctgggaacttctggggtaggacgttgtctgctatctccagttccacagacccaaccagttacgatggttttggaccatttatgccgggattcgacatcattccctataatgatctgcccgcactggagcgtgctcttcaggatccaaatgtggctgcgttcatggtagaaccaattcagggtgaagcaggcgttgttgttccggatccaggttacctaatgggagtgcgagagctctgcaccaggcaccaggttctctttattgctgatgaaatacagacaggattggccagaactggtagatggctggctgttgattatgaaaatgtcagacctgatatagtcctccttggaaaggccctttctgggggcttataccctgtgtctgcagtgctgtgtgatgatgacatcatgctgaccattaagccaggggagcatgggtccacatacggtggcaatccactaggctgccgagtggccatcgcagcccttgaggttttagaagaagaaaaccttgctgaaaatgcagacaaattgggcattatcttgagaaatgaactcatgaagctaccttctgatgttgtaactgccgtaagaggaaaaggattattaaacgctattgtcattaaagaaaccaaagattgggatgcttggaaggtgtgtctacgacttcgagataatggacttctggccaagccaacccatggcgacattatcaggtttgcgcctccgctggtgatcaaggaggatgagcttcgagagtccattgaaattattaacaagaccatcttgtctttctgagggtagccagctgttttcagtggtccctgggagccagctggagacaggtggtcctgtaaaagctttattcctaatgtgggcacattccactcccatgagtcttcaaaaactttttttttgaatatatttttttcagttgatacataatagaacaacgtttatgaacctgccgtttgctttgtaacgtaactaaataatgtaatggcatctatattcagttgaagtgttttgatgtgcatgtgtacttcctaaggtgaaatgcatctatatacagacagcctctaaatcaagtccttcaatcttataaagtgaaatcattgttattgaattttaggaaggattaatggttaagtgtatataaaatactaatattaagtaaacttcatattggccaacaccagggttgtattctatggatgtcattattttgaattaagaattagtgtttaacattcctaaattgttttgagtgcttgattataatttgtaaaaaatgtttattttcaatacttctttaaatttaaaataaagcttatatttcaaatgtc

SEQ ID NO: 312537 - DNA, 1786 bp, Homo sapiens
  misc_feature (1693)..(1693): n is a, c, g, or t
  misc_feature (1695)..(1695): n is a, c, g, or t
  misc_feature (1704)..(1704): n is a, c, g, or t
  misc_feature (1715)..(1715): n is a, c, g, or t
aagttgcattgacgctccggcgtcactgttgcgcttcatagacgccgcgtgtacccggttgtcctcaggcgctgtcagatctgtggtttttctacttgaaggacacaatgttttccaaactagcacatttgcagaggtttgctgtacttagtcgcggagttcattcttcagtggcttctgctacatctgttgcaactaaaaaaacagtccaaggccctccaacctctgatgacatttttgaaagggaatataagtatggtgcacacaactaccatcctttacctgtagccctggagagaggaaaaggtatttacttatgggatgtagaaggcagaaaatattttgacttcctgagttcttacagtgctgtcaaccaagggcattgtcaccccaagattgtgaatgctctgaagagtcaagtggacaaattgaccttaacatctagagctttctataataacgtacttggtgaatatgaggagtatattactaaacttttcaactaccacaaagttcttcctatgaatacaggagtggaggctggagagactgcctgtaaactagctcgtaagtggggctataccgtgaagggcattcagaaatacaaagcaaagattgtttttgcagctgggaacttctggggtaggacgttgtctgctatctccagttccacagacccaaccagttacgatggttttggaccatttatgccgggattcgacatcattccctataatgatctgcccgcactggagcgtgctcttcaggatccaaatgtggctgcgttcatggtagaaccaattcagggtgaagcaggcgttgttgttccggatccaggttacctaatgggagtgcgagagctctgcaccaggcaccaggttctctttattgctgatgaaatacagacaggattggccagaactggtagatggctggctgttgattatgaaaatgtcagacctgatatagtcctccttggaaaggccctttctgggggcttataccctgtgtctgcagtgctgtgtgatgatgacatcatgctgaccattaagccaggggagcatgggtccacatacggtggcaatccactaggctgccgagtggccatcgcagcccttgaggttttagaagaagaaaaccttgctgaaaatgcagacaaattgggcattatcttgagaaatgaactcatgaagctaccttctgatgttgtaactgccgtaagaggaaaaggattattaaacgctattgtcattaaagaaaccaaagattgggatgcttggaaggtgtgtctacgacttcgagataatggacttctggccaagccaacccatggcgacattatcaggtttgcgcctccgctggtgatcaaggaggatgagcttcgagagtccattgaaattattaacaagaccatcttgtctttctgagggtagccagctgttttcagtggtccctgggagccagctggagacaggtggtcctgtaaaagctttattcctaatgtgggcacattccactcccatgagtcttcaaaaactttttttttgaatatatttttttcagttgatacataatagaacaacgtttatgaacctgccgtttgctttgtaacgtaactaaataatgtaatggcatctatattcagttgaagtgttttgatgtgcatgtgtacttcctaaggtgaagggttatntnagaaggctnaaaagcttcgnaatgaagaagtggaaaaacccccggggaggggcccattgaaggatccgggttggaaaggggctctaggaac

SEQ ID NO: 312538 - DNA, 2013 bp, Homo sapiens
aagttgcattgacgctccggcgtcactgttgcgcttcatagacgccgcgtgtacccggttgtcctcaggcgctgtcagatctgtggtttttctacttgaaggacacaatgttttccaaactagcacatttgcagaggtttgctgtacttagtcgcggagttcattcttcagtggcttctgctacatctgttgcaactaaaaaaacagtccaaggccctccaacctctgatgacatttttgaaagggaatataagtatggtgcacacaactaccatcctttacctgtagccctggagagaggaaaaggtatttacttatgggatgtagaaggcagaaaatattttgacttcctgagttcttacagtgctgtcaaccaagggcattgtcaccccaagattgtgaatgctctgaagagtcaagtggacaaattgaccttaacatctagagctttctataataacgtacttggtgaatatgaggagtatattactaaacttttcaactaccacaaagttcttcctatgaatacaggagtggaggctggagagactgcctgtaaactagctcgtaagtggggctataccgtgaagggcattcagaaatacaaagcaaagattgtttttgcagctgggaacttctggggtaggacgttgtctgctatctccagttccacagacccaaccagttacgatggttttggaccatttatgccgggattcgacatcattccctataatgatctgcccgcactggagcgtgctcttcaggatccaaatgtggctgcgttcatggtagaaccaattcagggtgaagcaggcgttgttgttccggatccaggttacctaatgggagtgcgagagctctgcaccaggcaccaggttctctttattgctgatgaaatacagacaggattggccagaactggtagatggctggctgttgattatgaaaatgtcagacctgatatagtcctccttggaaaggccctttctgggggcttataccctgtgtctgcagtgctgtgtgatgatgacatcatgctgaccattaagccaggggagcatgggtccacatacggtggcaatccactaggctgccgagtggccatcgcagcccttgaggttttagaagaagaaaaccttgctgaaaatgcagacaaattgggcattatcttgagaaatgaactcatgaagctaccttctgatgttgtaactgccgtaagaggaaaaggattattaaacgctattgtcattaaagaaaccaaagattgggatgcttggaaggtgtgtctacgacttcgagataatggacttctggccaagccaacccatggcgacattatcaggtttgcgcctccgctggtgatcaaggaggatgagcttcgagagtccattgaaattattaacaagaccatcttgtctttctgagggtagccagctgttttcagtggtccctgggagccagctggagacaggtggtcctgtaaaagctttattcctaatgtgggcacattccactcccatgagtcttcattatgaacctgccgtttgctttgtaacgtaactaaataatgtaatggcatctatattcagttgaagtgttttgatgtgcatgtgtacttcctaaggtgaaatgcatctatatacagacagcctctaaatcaagtccttcagtataattgatatatgtttttataatttcctcactggtataagtgtttcatatttgaaaaagttatctctgggtattgcataaaaggcttcatcttataaagtgaaatcattgttattgaattttaggaaggattaatggttaagtgtatataaaatactaatattaagtaaacttcatattggccaacaccagggttgtattctatggatgtcattattttgaattaagaattagtgtttaacattcctaaattgttttgagtgcttgattataatttgtaaaaaatgtttattttcaatacttctttaaatttaaaataaagcttatatttcaaatgtc

SEQ ID NO: 312539 - DNA, 2328 bp, Homo sapiens
catgtaattctgcattttatttcaggagattttggactctctgcagactgtccctggatcttgggttaaaaatctgtattctagactgaaccgtgggaagaaaaaatagtcagtgagtctttggcaaaccggagtactggattttgtttagcaattgcaaattcctgaacatactggatttactgggtagtgccaagtttaaagggaagtaagccaaactccaagtattatgttttgctaatttggcagctcgaatcaagagtggctgtgagattatacatggtttgacttgtcattggtagacttctgttgaaacatgaattaactagtcttttagaaaatctgtggtttttctacttgaaggacacaatgttttccaaactagcacatttgcagaggtttgctgtacttagtcgcggagttcattcttcagtggcttctgctacatctgttgcaactaaaaaaacagtccaaggccctccaacctctgatgacatttttgaaagggaatataagtatggtgcacacaactaccatcctttacctgtagccctggagagaggaaaaggtatttacttatgggatgtagaaggcagaaaatattttgacttcctgagttcttacagtgctgtcaaccaagggcattgtcaccccaagattgtgaatgctctgaagagtcaagtggacaaattgaccttaacatctagagctttctataataacgtacttggtgaatatgaggagtatattactaaacttttcaactaccacaaagttcttcctatgaatacaggagtggaggctggagagactgcctgtaaactagctcgtaagtggggctataccgtgaagggcattcagaaatacaaagcaaagattgtttttgcagctgggaacttctggggtaggacgttgtctgctatctccagttccacagacccaaccagttacgatggttttggaccatttatgccgggattcgacatcattccctataatgatctgcccgcactggagcgtgctcttcaggatccaaatgtggctgcgttcatggtagaaccaattcagggtgaagcaggcgttgttgttccggatccaggttacctaatgggagtgcgagagctctgcaccaggcaccaggttctctttattgctgatgaaatacagacaggattggccagaactggtagatggctggctgttgattatgaaaatgtcagacctgatatagtcctccttggaaaggccctttctgggggcttataccctgtgtctgcagtgctgtgtgatgatgacatcatgctgaccattaagccaggggagcatgggtccacatacggtggcaatccactaggctgccgagtggccatcgcagcccttgaggttttagaagaagaaaaccttgctgaaaatgcagacaaattgggcattatcttgagaaatgaactcatgaagctaccttctgatgttgtaactgccgtaagaggaaaaggattattaaacgctattgtcattaaagaaaccaaagattgggatgcttggaaggtgtgtctacgacttcgagataatggacttctggccaagccaacccatggcgacattatcaggtttgcgcctccgctggtgatcaaggaggatgagcttcgagagtccattgaaattattaacaagaccatcttgtctttctgagggtagccagctgttttcagtggtccctgggagccagctggagacaggtggtcctgtaaaagctttattcctaatgtgggcacattccactcccatgagtcttcaaaaactttttttttgaatatatttttttcagttgatacataatagaacaacgtttatgaacctgccgtttgctttgtaacgtaactaaataatgtaatggcatctatattcagttgaagtgttttgatgtgcatgtgtacttcctaaggtgaaatgcatctatatacagacagcctctaaatcaagtccttcagtataattgatatatgtttttataatttcctcactggtataagtgtttcatatttgaaaaagttatctctgggtattgcataaaaggcttcatcttataaagtgaaatcattgttattgaattttaggaaggattaatggttaagtgtatataaaatactaatattaagtaaacttcatattggccaacaccagggttgtattctatggatgtcattattttgaattaagaattagtgtttaacattcctaaattgttttgagtgcttgattataatttgtaaaaaatgtttattttcaatacttctttaaatttaaaataaagcttatatttcaaatgtc

SEQ ID NO: 312540 - DNA, 2298 bp, Homo sapiens
gtgattgagcccaagaaaccagggacttacgcatttggccaatgtcaaaagaacagaactttgcccactgcacacttgctgtgtacaatgactgagccctttcttgtagtttgtttccttgtttgagaggtgtgcatgcgaccgtggcttttcccaaagtttctgactttgtggtttacccccttcaccttccagggacgcagttgttacgaggttagacgtggcagctctgtgcagtgtttgagcctacagtgggatacatagggtcaaattgagaataataaactgagtcattctcctggaaaaaaaaaaaaaaaaaactcgaggacgccgcgtgtacccggttgtcctcaggcgctgtcagatctgtggtttttctacttgaaggacacaatgttttccaaactagcacatttgcagaggtttgctgtacttagtcgcggagttcattcttcagtggcttctgctacatctgttgcaactaaaaaaacagtccaaggccctccaacctctgatgacatttttgaaagggaatataagtatggtgcacacaactaccatcctttacctgtagccctggagagaggaaaaggtatttacttatgggatgtagaaggcagacccaagattgtgaatgctctgaagagtcaagtggacaaattgaccttaacatctagagctttctataataacgtacttggtgaatatgaggagtatattactaaacttttcaactaccacaaagttcttcctatgaatacaggagtggaggctggagagactgcctgtaaactagctcgtaagtggggctataccgtgaagggcattcagaaatacaaagcaaagattgtttttgcagctgggaacttctggggtaggacgttgtctgctatctccagttccacagacccaaccagttacgatggttttggaccatttatgccgggattcgacatcattccctataatgatctgcccgcactggagcgtgctcttcaggatccaaatgtggctgcgttcatggtagaaccaattcagggtgaagcaggcgttgttgttccggatccaggttacctaatgggagtgcgagagctctgcaccaggcaccaggttctctttattgctgatgaaatacagacaggattggccagaactggtagatggctggctgttgattatgaaaatgtcagacctgatatagtcctccttggaaaggccctttctgggggcttataccctgtgtctgcagtgctgtgtgatgatgacatcatgctgaccattaagccaggggagcatgggtccacatacggtggcaatccactaggctgccgagtggccatcgcagcccttgaggttttagaagaagaaaaccttgctgaaaatgcagacaaattgggcattatcttgagaaatgaactcatgaagctaccttctgatgttgtaactgccgtaagaggaaaaggattattaaacgctattgtcattaaagaaaccaaagattgggatgcttggaaggtgtgtctacgacttcgagataatggacttctggccaagccaacccatggcgacattatcaggtttgcgcctccgctggtgatcaaggaggatgagcttcgagagtccattgaaattattaacaagaccatcttgtctttctgagggtagccagctgttttcagtggtccctgggagccagctggagacaggtggtcctgtaaaagctttattcctaatgtgggcacattccactcccatgagtcttcaaaaactttttttttgaatatatttttttcagttgatacataatagaacaacgtttatgaacctgccgtttgctttgtaacgtaactaaataatgtaatggcatctatattcagttgaagtgttttgatgtgcatgtgtacttcctaaggtgaaatgcatctatatacagacagcctctaaatcaagtccttcagtataattgatatatgtttttataatttcctcactggtataagtgtttcatatttgaaaaagttatctctgggtattgcataaaaggcttcatcttataaagtgaaatcattgttattgaattttaggaaggattaatggttaagtgtatataaaatactaatattaagtaaacttcatattggccaacaccagggttgtattctatggatgtcattattttgaattaagaattagtgtttaacattcctaaattgttttgagtgcttgattataatttgtaaaaaatgtttattttcaatacttctttaaatttaaaataaagcttatatttcaaatgtc

SEQ ID NO: 312541 - DNA, 1953 bp, Homo sapiens
taaggcccgtcccggcggccccgcggccccggcgtcccagccgggccgcgcgcggtcgcgcgctcatcttcgcgggtctgctcatcgtggcgctcaaaacgtccaggccctccacctcgacgacattcgaccgggctctcgtatggtgcacacaactaccatcctttacctgtagccctggagagaggaaaaggtatttacttatgggatgtagaaggcagaaaatattttgacttcctgagttcttacagtgctgtcaaccaagggcattgtcaccccaagattgtgaatgctctgaagagtcaagtggacaaattgaccttaacatctagagctttctataataacgtacttggtgaatatgaggagtatattactaaacttttcaactaccacaaagttcttcctatgaatacaggagtggaggctggagagactgcctgtaaactagctcgtaagtggggctataccgtgaagggcattcagaaatacaaagcaaagattgtttttgcagctgggaacttctggggtaggacgttgtctgctatctccagttccacagacccaaccagttacgatggttttggaccatttatgccgggattcgacatcattccctataatgatctgcccgcactggagcgtgctcttcaggatccaaatgtggctgcgttcatggtagaaccaattcagggtgaagcaggcgttgttgttccggatccaggttacctaatgggagtgcgagagctctgcaccaggcaccaggttctctttattgctgatgaaatacagacaggattggccagaactggtagatggctggctgttgattatgaaaatgtcagacctgatatagtcctccttggaaaggccctttctgggggcttataccctgtgtctgcagtgctgtgtgatgatgacatcatgctgaccattaagccaggggagcatgggtccacatacggtggcaatccactaggctgccgagtggccatcgcagcccttgaggttttagaagaagaaaaccttgctgaaaatgcagacaaattgggcattatcttgagaaatgaactcatgaagctaccttctgatgttgtaactgccgtaagaggaaaaggattattaaacgctattgtcattaaagaaaccaaagattgggatgcttggaaggtgtgtctacgacttcgagataatggacttctggccaagccaacccatggcgacattatcaggtttgcgcctccgctggtgatcaaggaggatgagcttcgagagtccattgaaattattaacaagaccatcttgtctttctgagggtagccagctgttttcagtggtccctgggagccagctggagacaggtggtcctgtaaaagctttattcctaatgtgggcacattccactcccatgagtcttcaaaaactttttttttgaatatatttttttcagttgatacataatagaacaacgtttatgaacctgccgtttgctttgtaacgtaactaaataatgtaatggcatctatattcagttgaagtgttttgatgtgcatgtgtacttcctaaggtgaaatgcatctatatacagacagcctctaaatcaagtccttcagtataattgatatatgtttttataatttcctcactggtataagtgtttcatatttgaaaaagttatctctgggtattgcataaaaggcttcatcttataaagtgaaatcattgttattgaattttaggaaggattaatggttaagtgtatataaaatactaatattaagtaaacttcatattggccaacaccagggttgtattctatggatgtcattattttgaattaagaattagtgtttaacattcctaaattgttttgagtgcttgattataatttgtaaaaaatgtttattttcaatacttctttaaatttaaaataaagcttatatttcaaatgtc

SEQ ID NO: 312542 - DNA, 2201 bp, Homo sapiens
cgattcttgtgtcttagcctgctgagtagctggtcttgaactcctgacctcaggcgatctgcccaccttggcctcccaaagtgcagggattacataagtgagccactgtgcctggtctattccccaacatctaaaacaatgcctgacatagtagatcctcagtcacctttattaatggataaaaaatattccagcagaaagggagacgtctgtcatttagcatcataaaggattataatatcaaggaaggtaaaatggaaacgtgtttggattgcttgaggatcttttctccaaatgaaattggaaatgcattctgttgttagcctgcagtattggagttttgaaaggaaaaccgctaattgtctatgaaggatattctttctcatatcactatcataaatgcaccttctctagaaaacatgcattcaagacctcaattgttagggcttggttttgggttggggattattgaaagaaaagtaagttatctatcttcaggggctatatattccagtcaagaggctcagtagagagaaatgcctaaaataggaattacaaggccagacttagtggccttgtgtcataggagccatggtgtttaatatcagactttgttttaacaattgaaagcccaccgaaggtgcactaaagcaagcccttgatttattttttgagtcaaacttcttgtggtgttttgcggggatagtgcttattgaattttgggtttctttgaaataatcactgtttgtttcccctttgtagctgggaacttctggggtaggacgttgtctgctatctccagttccacagacccaaccagttacgatggttttggaccatttatgccgggattcgacatcattccctataatgatctgcccgcactggagcgtgctcttcaggatccaaatgtggctgcgttcatggtagaaccaattcagggtgaagcaggcgttgttgttccggatccaggttacctaatgggagtgcgagagctctgcaccaggcaccaggttctctttattgctgatgaaatacagacaggattggccagaactggtagatggctggctgttgattatgaaaatgtcagacctgatatagtcctccttggaaaggccctttctgggggcttataccctgtgtctgcagtgctgtgtgatgatgacatcatgctgaccattaagccaggggagcatgggtccacatacggtggcaatccactaggctgccgagtggccatcgcagcccttgaggttttagaagaagaaaaccttgctgaaaatgcagacaaattgggcattatcttgagaaatgaactcatgaagctaccttctgatgttgtaactgccgtaagaggaaaaggattattaaacgctattgtcattaaagaaaccaaagattgggatgcttggaaggtgtgtctacgacttcgagataatggacttctggccaagccaacccatggcgacattatcaggtttgcgcctccgctggtgatcaaggaggatgagcttcgagagtccattgaaattattaacaagaccatcttgtctttctgagggtagccagctgttttcagtggtccctgggagccagctggagacaggtggtcctgtaaaagctttattcctaatgtgggcacattccactcccatgagtcttcaaaaactttttttttgaatatatttttttcagttgatacataatagaacaacgtttatgaacctgccgtttgctttgtaacgtaactaaataatgtaatggcatctatattcagttgaagtgttttgatgtgcatgtgtacttcctaaggtgaaatgcatctatatacagacagcctctaaatcaagtccttcagtataattgatatatgtttttataatttcctcactggtataagtgtttcatatttgaaaaagttatctctgggtattgcataaaaggcttcatcttataaagtgaaatcattgttattgaattttaggaaggattaatggttaagtgtatataaaatactaatattaagtaaacttcatattggccaacaccagggttgtattctatggatgtcattattttgaattaagaattagtgtttaacattcctaaattgttttgagtgcttgattataatttgtaaaaaatgtttattttcaatacttctttaaatttaaaataaagcttatatttcaaatgtc

SEQ ID NO: 312543 - DNA, 678 bp, Homo sapiens
  misc_feature (1)..(1): n is a, c, g, or t
  misc_feature (18)..(19): n is a, c, g, or t
  misc_feature (23)..(23): n is a, c, g, or t
  misc_feature (29)..(30): n is a, c, g, or t
  misc_feature (37)..(37): n is a, c, g, or t
ntacaattcactcggatnnagtngaatcnntccaccngagggtagccagctgttttcagtggtccctgggagccagctggagacaggtggtcctgtaaaagctttattcctaatgtgggcacattccactcccatgagtcttcaaaaactttttttttgaatatatttttttcagttgatacataatagaacaacgtttatgaacctgccgtttgctttgtaacgtaactaaataatgtaatggcatctatattcagttgaagtgttttgatgtgcatgtgtacttcctaaggtgaaatgcatctatatacagacagcctctaaatcaagtccttcagtataattgatatatgtttttataatttcctcactggtataagtgtttcatatttgaaaaagttatctctgggtattgcataaaaggcttcatcttataaagtgaaatcattgttattgaattttaggaaggattaatggttaagtgtatataaaatactaatattaagtaaacttcatattggccaacaccagggttgtattctatggatgtcattattttgaattaagaattagtgtttaacattcctaaattgttttgagtgcttgattataatttgtaaaaaatgtttattttcaatacttctttaaatttaaaataaagcttatatttcaaatgtc

SEQ ID NO: 312544 - DNA, 1741 bp, Homo sapiens
gtgattgagcccaagaaaccagggacttacgcatttggccaatgtcaaaagaacagaactttgcccactgcacacttgctgtgtacaatgactgagccctttcttgtagtttgtttccttgtttgagaggtgtgcatgcgaccgtggcttttcccaaagtttctgactttgtggtttacccccttcaccttccagggacgcagttgttacgaggttagacgtggcagctctgtgcagtgtttgagcctacagtgggatacatagggtcaaattgagaataataaactgagtcattctcctggaaaaaaaaaaaaaaaaaactcgaggacgccgcgtgtacccggttgtcctcaggcgctgtcagtaccgtctgggcgccgctgtcctggggctctggttcgggccctggccggggttccctgacagcggcgggggaggcgggcgggcgcggggtggccgcggcccgggttcgggggatgctggctgagggggcgcgctgggcctcggccggggaacgagccccgcttcagcggcccgtttactctgcgggcggctcggacccgggcgccctggagtctccggccggcgcgcagcttcagggggcaggggcgtggcgacccacggcttgcaggccggagtcctggttccagcccagagcggccgacgggcgggcggcagggagaggctgaggatgtggcagccccgcctgccagaccgggcggagccgccgccccctgcgctcgcggcctgtggaggccaggactcggcccacccggcccagagaccccgaggcgccccggggttccgggtaggaggcctttgggcacccttggttcctggggttggcggggaggctgcgttctggggacgggggagctgtgcagtaaaccggtggccctggtcacgcggcgggggcgctgatgcagccttggagggctgggtcctcccggcctgctcctgcgccctgcagatcggcctgcccatcgctcccctcttccagcctatgattttttttctccagcctctgtcgaaataaagaaaattacggaagcagaaccttccttacagtaacgtgcagatctgtggtttttctacttgaaggacacaatgttttccaaactagcacatttgcagaggtttgctgtacttagtcgcggagttcattcttcagtggcttctgctacatctgttgcaactaaaaaaacagtccaaggccctccaacctctgatgacatttttgaaagggaatataagtatggtgcacacaactaccatcctttacctgtagccctggagagaggaaaaggtatttacttatgggatgtagaaggcagaaaatattttgacttcctgagttcttacagtgctgtcaaccaagggcattgtcaccccaagattgtgaatgctctgaagagtcaagtggacaaattgaccttaacatctagagctttctataataacgtacttggtgaatatgaggagtatattactaaacttttcaactaccacaaagttcttcctatgaatacaggagtggaggctggagagactgcctgtaaactagctcgtaagtggggctataccgtgaagggcattcagaaatacaaagcaaagattgtttttgcagactgtgtccagtctctttcttaatagcaaagggtgcaaagatgttttcacctgagtattgaaagaagctggtgagtcagtggggtggagagacagaggaagactgtccctaact

SEQ ID NO: 312545 - DNA, 585 bp, Homo sapiens
gagacagtcttgctctgtcacccaggccggaatgcagtggtgcgatctcagctcacagcaacctctgcttcctgggttcaagcgattcttgtgtcttagcctgctgagtagctgggactacaggtgtgcactaccatgcctggctaatttttgtatttttagtagagatggggtttcaccatgttggccaggctggtcttgaactcctgacctcaggcgatctgcccaccttggcctcccaaagtgcagggattacataagtgagccactgtgcctggtctattccccaacatctaaaacaatgcctgacatagtagatcctcagtcacctttattaatggataaaaaatattccagcagaaagggagacgtctgtcatttagcatcataaaggattataatatcaaggaaggtaaaatggaaacgtgtttggattgcttgaggatcttttctccaaatgaaattggaaatgcattctgttgttagcctgcagtattggagttttgaaaggaaaaccgctaattgtctatgaaggatattctttctcatatcactatcataaatgcaccttctctagaaaacatg

SEQ ID NO: 312546 - DNA, 2066 bp, Homo sapiens
aagttgcattgacgctccggcgtcactgttgcgcttcatagacgccgcgtgtacccggttgtcctcaggcgctgtcagatctgtggtttttctacttgaaggacacaatgttttccaaactagcacatttgcagaggtttgctgtacttagtcgcggagttcattcttcagtggcttctgctacatctgttgcaactaaaaaaacagtccaaggccctccaacctctgatgacatttttgaaagggaatataagtatggtgcacacaactaccatcctttacctgtagccctggagagaggaaaaggtatttacttatgggatgtagaaggcagaaaatattttgacttcctgagttcttacagtgctgtcaaccaagggcattgtcaccccaagattgtgaatgctctgaagagtcaagtggacaaattgaccttaacatctagagctttctataataacgtacttggtgaatatgaggagtatattactaaacttttcaactaccacaaagttcttcctatgaatacaggagtggaggctggagagactgcctgtaaactagctcgtaagtggggctataccgtgaagggcattcagaaatacaaagcaaagattgtttttgcagctgggaacttctggggtaggacgttgtctgctatctccagttccacagacccaaccagttacgatggttttggaccatttatgccgggattcgacatcattccctataatgatctgcccgcactggagcgtgctcttcaggatccaaatgtggctgcgttcatggtagaaccaattcagggtgaagcaggcgttgttgttccggatccaggttacctaatgggagtgcgagagctctgcaccaggcaccaggttctctttattgctgatgaaatacagacaggattggccagaactggtagatggctggctgttgattatgaaaatgtcagacctgatatagtcctccttggaaaggccctttctgggggcttataccctgtgtctgcagtgctgtgtgatgatgacatcatgctgaccattaagccaggggagcatgggtccacatacggtggcaatccactaggctgccgagtggccatcgcagcccttgaggttttagaagaagaaaaccttgctgaaaatgcagacaaattgggcattatcttgagaaatgaactcatgaagctaccttctgatgttgtaactgccgtaagaggaaaaggattattaaacgctattgtcattaaagaaaccaaagattgggatgcttggaaggtgtgtctacgacttcgagataatggacttctggccaagccaacccatggcgacattatcaggtttgcgcctccgctggtgatcaaggaggatgagcttcgagagtccattgaaattattaacaagaccatcttgtctttctgagggtagccagctgttttcagtggtccctgggagccagctggagacaggtggtcctgtaaaagctttattcctaatgtgggcacattccactcccatgagtcttcaaaaactttttttttgaatatatttttttcagttgatacataatagaacaacgtttatgaacctgccgtttgctttgtaacgtaactaaataatgtaatggcatctatattcagttgaagtgttttgatgtgcatgtgtacttcctaaggtgaaatgcatctatatacagacagcctctaaatcaagtccttcagtataattgatatatgtttttataatttcctcactggtataagtgtttcatatttgaaaaagttatctctgggtattgcataaaaggcttcatcttataaagtgaaatcattgttattgaattttaggaaggattaatggttaagtgtatataaaatactaatattaagtaaacttcatattggccaacaccagggttgtattctatggatgtcattattttgaattaagaattagtgtttaacattcctaaattgttttgagtgcttgattataatttgtaaaaaatgtttattttcaatacttctttaaatttaaaataaagcttatatttcaaatgtc

SEQ ID NO: 312547 - DNA, 2517 bp, Homo sapiens
aagttgcattgacgctccggcgtcactgttgcgcttcatagacgccgcgtgtacccggttgtcctcaggcgctgtcagatctgtggtttttctacttgaaggacacaatgttttccaaactagcacatttgcagaggtttgctgtacttagtcgcggagttcattcttcagtggcttctgctacatctgttgcaactaaaaaaacagtccaaggccctccaacctctgatgacatttttgaaagggaatataagtatggtgcacacaactaccatcctttacctgtagccctggagagaggaaaaggtatttacttatgggatgtagaaggcagaaaatattttgacttcctgagttcttacagtgctgtcaaccaagggcattgtcaccccaagattgtgaatgctctgaagagtcaagtggacaaattgaccttaacatctagagctttctataataacgtacttggtgaatatgaggagtatattactaaacttttcaactaccacaaagttcttcctatgaatacaggagtggaggctggagagactgcctgtaaactagctcgtaagtggggctataccgtgaagggcattcagaaatacaaagcaaagattgtttttgcagctgggaacttctggggtaggacgttgtctgctatctccagttccacagacccaaccagttacgatggttttggaccatttatgccgggattcgacatcattccctataatgatctgcccgcactggagcgtgctcttcaggatccaaatgtggctgcgttcatggtagaaccaattcagggtgaagcaggcgttgttgttccggatccaggttacctaatgggagtgcgagagctctgcaccaggcaccaggttctctttattgctgatgaaatacagacaggattggccagaactggtagatggctggctgttgattatgaaaatgtcagacctgatatagtcctccttggaaaggccctttctgggggcttataccctgtgtctgcagtgctgtgtgatgatgacatcatgctgaccattaagccaggggagcatgggtccacatacggtggcaatccactaggctgccgagtggccatcgcagcccttgaggttttagaagaagaaaaccttgctgaaaatgcagacaaattgggcattatcttgagaaatgaactcatgaagctaccttctgatgttgtaactgccgtaagaggaaaaggattattaaacgctattgtcattaaagaaaccaaagattgggatgcttggaaggtgtgtctacgacttcgagataatggacttctggccaagccaacccatggcgacattatcaggtttgcgcctccgctggtgatcaaggaggatgagcttcgagagtccattgaaattattaacaagaccatcttgtctttctgagggtagccagctgttttcagtggtccctgggagccagctggagacaggtggtcctgtaaaagctttattcctaatgtgggcacattccactcccatgagtcttcaaaaactttttttttgaatatatttttttcagttgatacataatagaacaacgtttatgaacctgccgtttgctttgtaacgtaactaaataatgtaatggcatctatattcagttgaagtgttttgatgtgcatgtgtacttcctaaggtgaaatgcatctatatacagacagcctctaaatcaagtccttcagtataattgatatatgtttttataatttcctcactggtataagtgtttcatatttgaaaaagttatctctgggtattgcataaaaggcttcatcttataaagtgaaatcattgttattgaattttaggaaggattaatggttaagtgtatataaaatactaatattaagtaaacttcatattggccaacaccagggttgtattctatggatgtcattattttgaattaagaattagtgtttaacattcctaaattgttttgagtgcttgattataatttgtaaaaaatgtttattttcaatacttctttaaatttaaaataaagcttatatttcaaatgtcaaaaaaaaaaaaaaaaaaacaaaaaacaaaaacaacaaaaaaaaaaaacaaaaagacaaaacaacgaaacaaccagcacaagagacacaaaacacacaacagaaggggggggcgtcgcccaaaacaccacccccccgcgcaggacgcagagcgcggcgccccccgccccagacacgagccgcgcccccacactgacagagccataaacaacacaccgagccgacgcccgcccgacacaaccaacacgaccgacgagaaacggagcaaccacccccccagctgccctgagacaacaaccacaccccccacgcggcgcggacacacatacacacacacaaccaagagataccacccgcgcccaagcaaacaaacacgacacaagccgccacacacaccgacacacggtgccaagaaagcagaccagcgagctcacaacccacacgcggcagca

SEQ ID NO: 312548 - DNA, 2009 bp, Homo sapiens
aagttgcattgacgctccggcgtcactgttgcgcttcatagacgccgcgtgtacccggttgtcctcaggcgctgtcagatctgtggtttttctacttgaaggacacaatgttttccaaactagcacatttgcagaggtttgctgtacttagtcgcggagttcattcttcagtggcttctgctacatctgttgcaactaaaaaaacagtccaaggccctccaacctctgatgacatttttgaaagggaatataagtatggtgcacacaactaccatcctttacctgtagccctggagagaggaaaaggtatttacttatgggatgtagaaggcagaaaatattttgacttcctgagttcttacagtgctgtcaaccaagggcattgtcaccccaagattgtgaatgctctgaagagtcaagtggacaaattgaccttaacatctagagctttctataataacgtacttggtgaatatgaggagtatattactaaacttttcaactaccacaaagttcttcctatgaatacaggagtggaggctggagagactgcctgtaaactagctcgtaagtggggctataccgtgaagggcattcagaaatacaaagcaaagattgtttttgcagctgggaacttctggggtaggacgttgtctgctatctccagttccacagacccaaccagttacgatggttttggaccatttatgccgggattcgacatcattccctataatgatctgcccgcactggagcgtgctcttcaggatccaaatgtggctgcgttcatggtagaaccaattcagggtgaagcaggcgttgttgttccggatccaggttacctaatgggagtgcgagagctctgcaccaggcaccaggttctctttattgctgatgaaatacagacaggattggccagaactggtagatggctggctgttgattatgaaaatgtcagacctgatatagtcctccttggaaaggccctttctgggggcttataccctgtgtctgcagtgctgtgtgatgatgacatcatgctgaccattaagccaggggagcatgggtccacatacggtggcaatccactaggctgccgagtggccatcgcagcccttgaggttttagaagaagaaaaccttgctgaaaatgcagacaaattgggcattatcttgagaaatgaactcatgaagctaccttctgatgttgtaactgccgtaagaggaaaaggattattaaacgctattgtcattaaagaaaccaaagattgggatgcttggaaggtgtgtctacgacttcgagataatggacttctggccaagccaacccatggcgacattatcaggtttgcgcctccgctggtgatcaaggaggatgagcttcgagagtccattgaaattattaacaagaccatcttgtctttctgagggtagccagctgttttcagtggtccctgggagccagctggagacaggtggtcctgtaaaagctttattcctaatgtgggcacattccactcccatgagtcttcaaaaactttttttttgaatatatttttttcagttgatacataatagaacaacgtttatgaacctgccgtttgctttgtaacgtaactaaataatgtaatggcatctatattcagttgaagtgttttgatgtgcatgtgtacttcctaaggtgaaatgcatctatatacagacagcctctaaatcaagtccttcagtataattgatatatgtttttataatttcctcactggtataagtgtttcatatttgaaaaagttatctctgggtattgcataaaaggcttcatataaaatactaatattaagtaaacttcatattggccaacaccagggttgtattctatggatgtcattattttgaattaagaattagtgtttaacattcctaaattgttttgagtgcttgattataatttgtaaaaaatgtttattttcaatacttctttaaatttaaaataaagcttatatttcaaatgtc

SEQ ID NO: 312549 - DNA, 2004 bp, Homo sapiens
aagttgcattgacgctccggcgtcactgttgcgcttcatagacgccgcgtgtacccggttgtcctcaggcgctgtcagatctgtggtttttctacttgaaggacacaatgttttccaaactagcacatttgcagaggtttgctgtacttagtcgcggagttcattcttcagtggcttctgctacatctgttgcaactaaaaaaacagtccaaggccctccaacctctgatgacatttttgaaagggaatataagtatggtgcacacaactaccatcctttacctgtagccctggagagaggaaaaggtatttacttatgggatgtagaaggcagaaaatattttgacttcctgagttcttacagtgctgtcaaccaagggcattgtcaccccaagattgtgaatgctctgaagagtcaagtggacaaattgaccttaacatctagagctttctataataacgtacttggtgaatatgaggagtatattactaaacttttcaactaccacaaagttcttcctatgaatacaggagtggaggctggagagactgcctgtaaactagctcgtaagtggggctataccgtgaagggcattcagaaatacaaagcaaagattgtttttgcagctgggaacttctggggtaggacgttgtctgctatctccagttccacagacccaaccagttacgatggttttggaccatttatgccgggattcgacatcattccctataatgatctgcccgcactggagcgtgctcttcaggatccaaatgtggctgcgttcatggtagaaccaattcagggtgaagcaggcgttgttgttccggatccaggttacctaatgggagtgcgagagctctgcaccaggcaccaggttctctttattgctgatgaaatacagacaggattggccagaactggtagatggctggctgttgattatgaaaatgtcagacctgatatagtcctccttggaaaggccctttctgggggcttataccctgtgtctgcagtgctgtgtgatgatgacatcatgctgaccattaagccaggggagcatgggtccacatacggtggcaatccactaggctgccgagtggccatcgcagcccttgaggttttagaagaagaaaaccttgctgaaaatgcagacaaattgggcattatcttgagaaatgaactcatgaagctaccttctgatgttgtaactgccgtaagaggaaaaggattattaaacgctattgtcattaaagaaaccaaagattgggatgcttggaaggtgtgtctacgacttcgagataatggacttctggccaagccaacccatggcgacattatcaggtttgcgcctccgctggtgatcaaggaggatgagcttcgagagtccattgaaaccagctggagacaggtggtcctgtaaaagctttattcctaatgtgggcacattccactcccatgagtcttcaaaaactttttttttgaatatatttttttcagttgatacataatagaacaacgtttatgaacctgccgtttgctttgtaacgtaactaaataatgtaatggcatctatattcagttgaagtgttttgatgtgcatgtgtacttcctaaggtgaaatgcatctatatacagacagcctctaaatcaagtccttcagtataattgatatatgtttttataatttcctcactggtataagtgtttcatatttgaaaaagttatctctgggtattgcataaaaggcttcatcttataaagtgaaatcattgttattgaattttaggaaggattaatggttaagtgtatataaaatactaatattaagtaaacttcatattggccaacaccagggttgtattctatggatgtcattattttgaattaagaattagtgtttaacattcctaaattgttttgagtgcttgattataatttgtaaaaaatgtttattttcaatacttctttaaatttaaaataaagcttatatttcaaatgtc

SEQ ID NO: 312550 - DNA, 3066 bp, Homo sapiens
gtgattgagcccaagaaaccagggacttacgcatttggccaatgtcaaaagaacagaactttgcccactgcacacttgctgtgtacaatgactgagccctttcttgtagtttgtttccttgtttgagaggtgtgcatgcgaccgtggcttttcccaaagtttctgactttgtggtttacccccttcaccttccagggacgcagttgttacgaggttagacgtggcagctctgtgcagtgtttgagcctacagtgggatacatagggtcaaattgagaataataaactgagtcattctcctggaaaaaaaaaaaaaaaaaactcgaggacgccgcgtgtacccggttgtcctcaggcgctgtcagtaccgtctgggcgccgctgtcctggggctctggttcgggccctggccggggttccctgacagcggcgggggaggcgggcgggcgcggggtggccgcggcccgggttcgggggatgctggctgagggggcgcgctgggcctcggccggggaacgagccccgcttcagcggcccgtttactctgcgggcggctcggacccgggcgccctggagtctccggccggcgcgcagcttcagggggcaggggcgtggcgacccacggcttgcaggccggagtcctggttccagcccagagcggccgacgggcgggcggcagggagaggctgaggatgtggcagccccgcctgccagaccgggcggagccgccgccccctgcgctcgcggcctgtggaggccaggactcggcccacccggcccagagaccccgaggcgccccggggttccgggtaggaggcctttgggcacccttggttcctggggttggcggggaggctgcgttctggggacgggggagctgtgcagtaaaccggtggccctggtcacgcggcgggggcgctgatgcagccttggagggctgggtcctcccggcctgctcctgcgccctgcagatcggcctgcccatcgctcccctcttccagcctatgattttttttctccagcctctgtcgaaataaagaaaattacggaagcagaaccttccttacagtaacgtgcagatctgtggtttttctacttgaaggacacaatgttttccaaactagcacatttgcagaggtttgctgtacttagtcgcggagttcattcttcagtggcttctgctacatctgttgcaactaaaaaaacagtccaaggccctccaacctctgatgacatttttgaaagggaatataagtatggtgcacacaactaccatcctttacctgtagccctggagagaggaaaaggtatttacttatgggatgtagaaggcagaaaatattttgacttcctgagttcttacagtgctgtcaaccaagggcattgtcaccccaagattgtgaatgctctgaagagtcaagtggacaaattgaccttaacatctagagctttctataataacgtacttggtgaatatgaggagtatattactaaacttttcaactaccacaaagttcttcctatgaatacaggagtggaggctggagagactgcctgtaaactagctcgtaagtggggctataccgtgaagggcattcagaaatacaaagcaaagattgtttttgcagctgggaacttctggggtaggacgttgtctgctatctccagttccacagacccaaccagttacgatggttttggaccatttatgccgggattcgacatcattccctataatgatctgcccgcactggagcgtgctcttcaggatccaaatgtggctgcgttcatggtagaaccaattcagggtgaagcaggcgttgttgttccggatccaggttacctaatgggagtgcgagagctctgcaccaggcaccaggttctctttattgctgatgaaatacagacaggattggccagaactggtagatggctggctgttgattatgaaaatgtcagacctgatatagtcctccttggaaaggccctttctgggggcttataccctgtgtctgcagtgctgtgtgatgatgacatcatgctgaccattaagccaggggagcatgggtccacatacggtggcaatccactaggctgccgagtggccatcgcagcccttgaggttttagaagaagaaaaccttgctgaaaatgcagacaaattgggcattatcttgagaaatgaactcatgaagctaccttctgatgttgtaactgccgtaagaggaaaaggattattaaacgctattgtcattaaagaaaccaaagattgggatgcttggaaggtgtgtctacgacttcgagataatggacttctggccaagccaacccatggcgacattatcaggtttgcgcctccgctggtgatcaaggaggatgagcttcgagagtccattgaaattattaacaagaccatcttgtctttctgagggtagccagctgttttcagtggtccctgggagccagctggagacaggtggtcctgtaaaagctttattcctaatgtgggcacattccactcccatgagtcttcaaaaactttttttttgaatatatttttttcagttgatacataatagaacaacgtttatgaacctgccgtttgctttgtaacgtaactaaataatgtaatggcatctatattcagttgaagtgttttgatgtgcatgtgtacttcctaaggtgaaatgcatctatatacagacagcctctaaatcaagtccttcagtataattgatatatgtttttataatttcctcactggtataagtgtttcatatttgaaaaagttatctctgggtattgcataaaaggcttcatcttataaagtgaaatcattgttattgaattttaggaaggattaatggttaagtgtatataaaatactaatattaagtaaacttcatattggccaacaccagggttgtattctatggatgtcattattttgaattaagaattagtgtttaacattcctaaattgttttgagtgcttgattataatttgtaaaaaatgtttattttcaatacttctttaaatttaaaataaagcttatatttcaaatgtc

SEQ ID NO: 312551 - DNA, 2559 bp, Homo sapiens
gtgattgagcccaagaaaccagggacttacgcatttggccaatgtcaaaagaacagaactttgcccactgcacacttgctgtgtacaatgactgagccctttcttgtagtttgtttccttgtttgagaggtgtgcatgcgaccgtggcttttcccaaagtttctgactttgtggtttacccccttcaccttccagggacgcagttgttacgaggttagacgtggcagctctgtgcagtgtttgagcctacagtgggatacatagggtcaaattgagaataataaactgagtcattctcctggaaaaaaaaaaaaaaaaaactcgaggacgccgcgtgtacccggttgtcctcaggcgctgtcagcgctttgtagcccaggctggagtgctggtggcacagatcgtggctcactgcagcccagaactcagggctcaagagatctttccaccttagtcttagtctcctaagtaccagatactacaggagattttggactctctgcagactgtccctggatcttgggttaaaaatctgtattctagactgaaccgtgggaagaaaaaatagtcaatctgtggtttttctacttgaaggacacaatgttttccaaactagcacatttgcagaggtttgctgtacttagtcgcggagttcattcttcagtggcttctgctacatctgttgcaactaaaaaaacagtccaaggccctccaacctctgatgacatttttgaaagggaatataagtatggtgcacacaactaccatcctttacctgtagccctggagagaggaaaaggtatttacttatgggatgtagaaggcagaaaatattttgacttcctgagttcttacagtgctgtcaaccaagggcattgtcaccccaagattgtgaatgctctgaagagtcaagtggacaaattgaccttaacatctagagctttctataataacgtacttggtgaatatgaggagtatattactaaacttttcaactaccacaaagttcttcctatgaatacaggagtggaggctggagagactgcctgtaaactagctcgtaagtggggctataccgtgaagggcattcagaaatacaaagcaaagattgtttttgcagctgggaacttctggggtaggacgttgtctgctatctccagttccacagacccaaccagttacgatggttttggaccatttatgccgggattcgacatcattccctataatgatctgcccgcactggagcgtgctcttcaggatccaaatgtggctgcgttcatggtagaaccaattcagggtgaagcaggcgttgttgttccggatccaggttacctaatgggagtgcgagagctctgcaccaggcaccaggttctctttattgctgatgaaatacagacaggattggccagaactggtagatggctggctgttgattatgaaaatgtcagacctgatatagtcctccttggaaaggccctttctgggggcttataccctgtgtctgcagtgctgtgtgatgatgacatcatgctgaccattaagccaggggagcatgggtccacatacggtggcaatccactaggctgccgagtggccatcgcagcccttgaggttttagaagaagaaaaccttgctgaaaatgcagacaaattgggcattatcttgagaaatgaactcatgaagctaccttctgatgttgtaactgccgtaagaggaaaaggattattaaacgctattgtcattaaagaaaccaaagattgggatgcttggaaggtgtgtctacgacttcgagataatggacttctggccaagccaacccatggcgacattatcaggtttgcgcctccgctggtgatcaaggaggatgagcttcgagagtccattgaaattattaacaagaccatcttgtctttctgagggtagccagctgttttcagtggtccctgggagccagctggagacaggtggtcctgtaaaagctttattcctaatgtgggcacattccactcccatgagtcttcaaaaactttttttttgaatatatttttttcagttgatacataatagaacaacgtttatgaacctgccgtttgctttgtaacgtaactaaataatgtaatggcatctatattcagttgaagtgttttgatgtgcatgtgtacttcctaaggtgaaatgcatctatatacagacagcctctaaatcaagtccttcagtataattgatatatgtttttataatttcctcactggtataagtgtttcatatttgaaaaagttatctctgggtattgcataaaaggcttcatcttataaagtgaaatcattgttattgaattttaggaaggattaatggttaagtgtatataaaatactaatattaagtaaacttcatattggccaacaccagggttgtattctatggatgtcattattttgaattaagaattagtgtttaacattcctaaattgttttgagtgcttgattataatttgtaaaaaatgtttattttcaatacttctttaaatttaaaataaagcttatatttcaaatgtc

SEQ ID NO: 312552 - DNA, 2124 bp, Homo sapiens
gtgattgagcccaagaaaccagggacttacgcatttggccaatgtcaaaagaacagaactttgcccactgcacacttgctgtgtacaatgactgagccctttcttgtagtttgtttccttgtttgagaggtgtgcatgcgaccgtggcttttcccaaagtttctgactttgtggtttacccccttcaccttccagggacgcagttgttacgaggttagacgtggcagctctgtgcagtgtttgagcctacagtgggatacatagggtcaaattgagaataataaactgagtcattctcctggaaaaaaaaaaaaaaaaaactcgaggacgccgcgtgtacccggttgtcctcaggcgctgtcaggtatttacttatgggatgtagaaggcagaaaatattttgacttcctgagttcttacagtgctgtcaaccaagggcattgtcaccccaagattgtgaatgctctgaagagtcaagtggacaaattgaccttaacatctagagctttctataataacgtacttggtgaatatgaggagtatattactaaacttttcaactaccacaaagttcttcctatgaatacaggagtggaggctggagagactgcctgtaaactagctcgtaagtggggctataccgtgaagggcattcagaaatacaaagcaaagattgtttttgcagctgggaacttctggggtaggacgttgtctgctatctccagttccacagacccaaccagttacgatggttttggaccatttatgccgggattcgacatcattccctataatgatctgcccgcactggagcgtgctcttcaggatccaaatgtggctgcgttcatggtagaaccaattcagggtgaagcaggcgttgttgttccggatccaggttacctaatgggagtgcgagagctctgcaccaggcaccaggttctctttattgctgatgaaatacagacaggattggccagaactggtagatggctggctgttgattatgaaaatgtcagacctgatatagtcctccttggaaaggccctttctgggggcttataccctgtgtctgcagtgctgtgtgatgatgacatcatgctgaccattaagccaggggagcatgggtccacatacggtggcaatccactaggctgccgagtggccatcgcagcccttgaggttttagaagaagaaaaccttgctgaaaatgcagacaaattgggcattatcttgagaaatgaactcatgaagctaccttctgatgttgtaactgccgtaagaggaaaaggattattaaacgctattgtcattaaagaaaccaaagattgggatgcttggaaggtgtgtctacgacttcgagataatggacttctggccaagccaacccatggcgacattatcaggtttgcgcctccgctggtgatcaaggaggatgagcttcgagagtccattgaaattattaacaagaccatcttgtctttctgagggtagccagctgttttcagtggtccctgggagccagctggagacaggtggtcctgtaaaagctttattcctaatgtgggcacattccactcccatgagtcttcaaaaactttttttttgaatatatttttttcagttgatacataatagaacaacgtttatgaacctgccgtttgctttgtaacgtaactaaataatgtaatggcatctatattcagttgaagtgttttgatgtgcatgtgtacttcctaaggtgaaatgcatctatatacagacagcctctaaatcaagtccttcagtataattgatatatgtttttataatttcctcactggtataagtgtttcatatttgaaaaagttatctctgggtattgcataaaaggcttcatcttataaagtgaaatcattgttattgaattttaggaaggattaatggttaagtgtatataaaatactaatattaagtaaacttcatattggccaacaccagggttgtattctatggatgtcattattttgaattaagaattagtgtttaacattcctaaattgttttgagtgcttgattataatttgtaaaaaatgtttattttcaatacttctttaaatttaaaataaagcttatatttcaaatgtc

SEQ ID NO: 312553 - DNA, 1469 bp, Homo sapiens
tacaaaaccctcacctttgcatcagcaccttttcactatgtagagcagggcagaatgggcctctagggagatagtggcctgacaaaggaaatagttggtgagtctacaagattcttataggatactcttgaaattgtgtgcagttaaaacatttttacaaatttgagggcacatcagaattacacatttattgttggtggggggacagtgaaataaggatggctattttccctgtggaaacgaaagtgatcactaataggggtattttttttccccaataggttctctttattgctgatgaaatacagacaggattggccagaactggtagatggctggctgttgattatgaaaatgtcagacctgatatagtcctccttggaaaggccctttctgggggcttataccctgtgtctgcagtgctgtgtgatgatgacatcatgctgaccattaagccaggggagcatgggtccacatacggtggcaatccactaggctgccgagtggccatcgcagcccttgaggttttagaagaagaaaaccttgctgaaaatgcagacaaattgggcattatcttgagaaatgaactcatgaagctaccttctgatgttgtaactgccgtaagaggaaaaggattattaaacgctattgtcattaaagaaaccaaagattgggatgcttggaaggtgtgtctacgacttcgagataatggacttctggccaagccaacccatggcgacattatcaggtttgcgcctccgctggtgatcaaggaggatgagcttcgagagtccattgaaattattaacaagaccatcttgtctttctgagggtagccagctgttttcagtggtccctgggagccagctggagacaggtggtcctgtaaaagctttattcctaatgtgggcacattccactcccatgagtcttcaaaaactttttttttgaatatatttttttcagttgatacataatagaacaacgtttatgaacctgccgtttgctttgtaacgtaactaaataatgtaatggcatctatattcagttgaagtgttttgatgtgcatgtgtacttcctaaggtgaaatgcatctatatacagacagcctctaaatcaagtccttcagtataattgatatatgtttttataatttcctcactggtataagtgtttcatatttgaaaaagttatctctgggtattgcataaaaggcttcatcttataaagtgaaatcattgttattgaattttaggaaggattaatggttaagtgtatataaaatactaatattaagtaaacttcatattggccaacaccagggttgtattctatggatgtcattattttgaattaagaattagtgtttaacattcctaaattgttttgagtgcttgattataatttgtaaaaaatgtttattttcaatacttctttaaatttaaaataaagcttatatttcaaatgtc

SEQ ID NO: 312554 - DNA, 997 bp, Homo sapiens
ttagtgccccccaccccccccgaagagcgacccctagtggtgcaccggtgcggaccagaaaattgcacgctttcttgaaacaggtattgactgagcgcccaatgtatgcctggcactgggctgggtgctgccacctaagcgagcacgaccaatgcaagtctatcagggacgccctgaccgccaagcagctggcccctgcagtccgccatgccactcccgacgcctagcgcgccgctcagcacaccgtgagcgcccactaactgttgggctccaatgacgccgaggaggcggccccgtccccgcgctcccgccgctcccgccagggcagcccgggaggccagacgctggcgctgcagggagagggcggtgggcgcatccgctagggggcgcggcggggcggggcgcacctttcggcgggcctcgcggatggcggcgcagggcgtagggcctgggccggggtcggcggcgcccccggggctggaggcggcccggcagaagctggcgctgcggcgcaagaaggtgctgagcaccgaggagatggagctgtacgagctggctcaggcggcgggcggcggtatcgaccccgacgtgttcaagatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgagggagagacaaaggcagcgctgccctcgggggagtattggccctggcggaacgcagcaaccacgagggatccagccagaggatgccacgccagcccagcgctaccaggctgcccaaggggggcgggcctgggaagagccctacgcagggcagcacctaggatggggcagagacttgtcacatctttgtccccagcaaaggctacatgttacctccttcagttgataataaacctttctgagatgcagagggtc

SEQ ID NO: 312555 - DNA, 224 bp, Homo sapiens
cagaggaggtggacagcacagaggaggggagctcctgggctctccctggctgccctggggtggggctgagcctcagttggagtcagagtctgaggagtcccctcctctgtgctgtcctggacagcaaagagatggggcagagacttgtcacatctttgtccccagcaaaggctacatgttacctccttcagttgataataaacctttctgagatgcagagggtc

SEQ ID NO: 312556 - DNA, 1063 bp, Homo sapiens
ttagtgccccccaccccccccgaagagcgacccctagtggtgcaccggtgcggaccagaaaattgcacgctttcttgaaacaggtattgactgagcgcccaatgtatgcctggcactgggctgggtgctgccacctaagcgagcacgaccaatgcaagtctatcagggacgccctgaccgccaagcagctggcccctgcagtccgccatgccactcccgacgcctagcgcgccgctcagcacaccgtgagcgcccactaactgttgggctccaatgacgccgaggaggcgggcctcgcggatggcggcgcagggcgtagggcctgggccggggtcggcggcgcccccggggctggaggcggcccggcagaagctggcgctgcggcgcaagaaggtgctgagcaccgaggagatggagctgtacgagctggctcaggcggcgggcggcggtatcgaccccgacgtgttcaagatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgagggagagacaaaggcagcgctgccctcgggggagtattggccctggcggaacgcagcaaccacgagggatccagccagaggatgccacgccagcccagcgctaccaggctgcccaaggggggcgggcctgggaagagccctacgcagggcagcacctaggatggggcagagacttgtcacatctttgtccccagcaaaggctacatgttacctccttcagttgataataaacctttctgagatgcagagggtccaggtcagatgctctctactgttttttttttttttttatattaaggcccccttagaatgaagtttctgggccggtcctggttgtgccacagtgaactaaccaggtcccttcaccatgggtcaacttcctgaacctgatttgggttctgaggaaaggtgtctggattgccaggtcttttataaatagacatca

SEQ ID NO: 312557 - DNA, 1017 bp, Homo sapiens
ttagtgccccccaccccccccgaagagcgacccctagtggtgcaccggtgcggaccagaaaattgcacgctttcttgaaacaggtattgactgagcgcccaatgtatgcctggcactgggctgggtgctgccacctaagcgagcacgaccaatgcaagtctatcagggacgccctgaccgccaagcagctggcccctgcagtccgccatgccactcccgacgcctagcgcgccgctcagcacaccgtgagcgcccactaactgttgggctccaatgacgccgaggaggcgggcctcgcggatggcggcgcagggcgtagggcctgggccggggtcggcggcgcccccggggctggaggcggcccggcagaagctggcgctgcggcgcaagaaggtgctgagcaccgaggagatggagctgtacgagctggctcaggcggcgggcggcggtatcgaccccgacgtgttcaagatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgagggagagacaaaggcagcgctgccctcgggggagtattggccctggcggaacgcagcaaccacgagggatccagccagaggatgccacgccagcccagcgctaccaggctgcccaaggggggcgggcctgggaagagccctacgcagggcagcacctaggatggggcagagacttgtcacatctttgtccccagcaaaggctacatgttacctccttcagttgataataaacctttctgagatgcagagggtcaacaacacacacacacccccaaacacaaacccgggggacaacggcggcgcgcgcacacaacggtcacacaggccacggcaaaggcccccaacccttcttggcaagcgggaaaaccggcccccaaagggcgacaccaacaccggacg

SEQ ID NO: 312558 - DNA, 1473 bp, Homo sapiens
ttagtgccccccaccccccccgaagagcgacccctagtggtgcaccggtgcggaccagaaaattgcacgctttcttgaaacaggtattgactgagcgcccaatgtatgcctggcactgggctgggtgctgccacctaagcgagcacgaccaatgcaagtctatcagggacgccctgaccgccaagcagctggcccctgcagtccgccatgccactcccgacgcctagcgcgccgctcagcacaccgtgagcgcccactaactgttgggctccaatgacgccgaggaggcggccccgtccccgcgctcccgccgctcccgccagggcagcccgggaggccagacgctggcgctgcagggagagggcggtgggcgcatccgctagggggcgcggcggggcggggcgcacctttcggcgggcctcgcggatggcggcgcagggcgtagggcctgggccggggtcggcggcgcccccggggctggaggcggcccggcagaagctggcgctgcggcgcaagaaggtgctgagcaccgaggagatggagctgtacgagctggctcaggcggcgggcggcggtatcgaccccgacgtgttcaagatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgaggcttgagtgacaacttgaggacaaggcggcgcctcaacaagatttcacacagcagctacgggggccagagaagcagcaccgcatggtgtggcaggagaaggaggacatgcacaagcaattggttgaagcttcagagacattgaaatcccaagccaaagaactgaaagatgcccatcagcagcaaaagctggccctgcaggagttcttggagctcaatgagctcatggcagagctctactcccagaagcagaaggtgtgggacaaggaggaggagatggaagtagccatgcagaaagctgacatgatgtggcaggagatctgaagatccaagaagctcagaaagaggatgctgtttagccagatgcggtggctcacgcctgtaatcccagcactttgggaggtcgaggcgggtggatggcctgaggtcaggagtttgagaccagcctggccaacatggtgaaaccctgtctctattaaaaatgcaaaaactaaccaggcatggtattgggtgcctgtaatcctagctacttgggaggctgaagcaggagaattgcttgaacctgggaggcggaggttgcagtgagccaagatcatgccactgcactccagcctgggcaacaagagcaaaactctgtctcaaaaaaaaaaaagggggggaggaagctatttagatatttcagcgatggtattgactggactttggtatgaccttaataaaacatctttga

SEQ ID NO: 312559 - DNA, 1132 bp, Homo sapiens
ttagtgccccccaccccccccgaagagcgacccctagtggtgcaccggtgcggaccagaaaattgcacgctttcttgaaacaggtattgactgagcgcccaatgtatgcctggcactgggctgggtgctgccacctaagcgagcacgaccaatgcaagtctatcagggacgccctgaccgccaagcagctggcccctgcagtccgccatgccactcccgacgcctagcgcgccgctcagcacaccgtgagcgcccactaactgttgggctccaatgacgccgaggaggcgggcctcgcggatggcggcgcagggcgtagggcctgggccggggtcggcggcgcccccggggctggaggcggcccggcagaagctggcgctgcggcgcaagaaggtgctgagcaccgaggagatggagctgtacgagctggctcaggcggcgggcggcggtatcgaccccgacgtgttcaagatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgagggagagacaaaggcagcgctgccctcgggggagtattggccctggcggaacgcagcaaccacgagggatccagccagaggatgccacgccagcccagcgctaccaggctgcccaaggggggcgggcctgggaagagccctacgcagggcagcacctaggatggggcagagacttgtcacatctttgtccccagcaaaggctacatgttacctccttcagttgataataaacctttctgagatgcagagggtcaaaaaaaaaaaaaaaaaaaaaaaaaaaaacttggggggcttcttatttcggggtgtggggaaaaaggggttagtgaagtgggccatgggccaaaaggggttttctggaccaagtttccttggtacccggggcgcacaattgcgcggggccccccatattaggaggcggattaaattgcaaaaacgcgaggttaccctgggttatgaacggccagcacggcaccagagaaaaccacacgcaggacaacagcagaggcccacc

SEQ ID NO: 312560 - DNA, 871 bp, Homo sapiens
ttagtgccccccaccccccccgaagagcgacccctagtggtgcaccggtgcggaccagaaaattgcacgctttcttgaaacaggtattgactgagcgcccaatgtatgcctggcactgggctgggtgctgccacctaagcgagcacgaccaatgcaagtctatcagggacgccctgaccgccaagcagctggcccctgcagtccgccatgccactcccgacgcctagcgcgccgctcagcacaccgtgagcgcccactaactgttgggctccaatgacgccgaggaggcgggcctcgcggatggcggcgcagggcgtagggcctgggccggggtcggcggcgcccccggggctggaggcggcccggcagaagctggcgctgcggcgcaagaaggtgctgagcaccgaggagatggagctgtacgagctggctcaggcggcgggcggcggtatcgaccccgacgtgttcaagatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgagggagagacaaaggcagcgctgccctcgggggagtattggccctggcggaacgcagcaaccacgagggatccagccagaggatgccacgccagcccagcgctaccaggctgcccaaggggggcgggcctgggaagagccctacgcagggcagcacctaggatggggcagagacttgtcacatctttgtccccagcaaaggctacatgttacctccttcagttgataataaacctttctgagatgcagagggtc

SEQ ID NO: 312561 - DNA, 1529 bp, Homo sapiens
ttagtgccccccaccccccccgaagagcgacccctagtggtgcaccggtgcggaccagaaaattgcacgctttcttgaaacaggtattgactgagcgcccaatgtatgcctggcactgggctgggtgctgccacctaagcgagcacgaccaatgcaagtctatcagggacgccctgaccgccaagcagctggcccctgcagtccgccatgccactcccgacgcctagcgcgccgctcagcacaccgtgagcgcccactaactgttgggctccaatgacgccgaggaggcgggcctcgcggatggcggcgcagggcgtagggcctgggccggggtcggcggcgcccccggggctggaggcggcccggcagaagctggcgctgcggcgcaagaaggtgctgagcaccgaggagatggagctgtacgagctggctcaggcggcgggcggcggtatcgaccccgacgtgttcaagtgagcggggcgggtgggggccgcatgctcgccagacacccccgacctctgctctccgggtacgcccggcccgctggtcgggaggagcccccgctgcccccgcccccgtccttgtccggtcttcagggaggtggccgcgccgggcggagagggctcaccggccccgcgtctgtccccgccaggatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgaggcttgagtgacaacttgaggacaaggcggcgcctcaacaagatttcacacagcagctacgggggccagagaagcagcaccgcatggtgtggcaggagaaggaggacatgcacaagcaattggttgaagcttcagagacattgaaatcccaagccaaagaactgaaagatgcccatcagcagcaaaagctggccctgcaggagttcttggagctcaatgagctcatggcagagctctactcccagaagcagaaggtgtgggacaaggaggaggagatggaagtagccatgcagaaagctgacatgatgtggcaggagatctgaagatccaagaagctcagaaagaggatgctgtttagccagatgcggtggctcacgcctgtaatcccagcactttgggaggtcgaggcgggtggatggcctgaggtcaggagtttgagaccagcctggccaacatggtgaaaccctgtctctattaaaaatgcaaaaactaaccaggcatggtattgggtgcctgtaatcctagctacttgggaggctgaagcaggagaattgcttgaacctgggaggcggaggttgcagtgagccaagatcatgccactgcactccagcctgggcaacaagagcaaaactctgtctcaaaaaaaaaaaagggggggaggaagctatttagatatttcagcgatggtattgactggactttggtatgaccttaataaaacatctttga

SEQ ID NO: 312562 - DNA, 302 bp, Homo sapiens
tggtttatttttttttaatagaaatataatgctgattatgaactctcagcaaaacaaggggcagatacattggcttatattgctctcctcgaagagaagcttctccctgcagtgcttcacacattctgggttgagagtgacaattactttactgtgacaaagccatggtttgcttcacaaattccttttcctttgagtttgatcctgcctggaagaatgtctaagggagcactgaataggattctcctgaccagaggacagcctcccctctaccacctccgagaagtggaagcacaggtata

SEQ ID NO: 312563 - DNA, 663 bp, Homo sapiens
cccatttaataccagctgccccaccattaaaatagtgattactggagaattagaagatgcaccatcattcatagacacttgggaactgacttcactttctcctatgaggacgtggcttgactggtgttaattggcctaaattctgttaaaacctgacaaatcttgccatcttcctaaaggtctgtacagtaagtgagtgtgtaagtttttcctgaatgtggtataagtcctgaatgtcagtggagaatattctagtgagaattatgcttatcctgatatggcaagatcctatctggtgaggacatagtcaccagcagctacatacccaatcagggactcttctattcctgcatctagtagctttctctttggcttccattcagtttcaagtatcaactaaataaaatggggacttgatctagcctctggtgtatgttttcattggtgtgtgttctccaataagccacgtataacctacttgaacactttagtggtacctgcctttttgtgtgctggggtgtactgaaatgttcctcatttccacatttccttttctgaaagataacttgagagtggatgaacaccatgactgctgatcttaatatcctcatcccttctccctgtcctgatgcataagggcaacctcaaatatttaactgtgtg

SEQ ID NO: 312564 - DNA, 1432 bp, Homo sapiens
tctccgcccctgcctcatccctagacctttccgactgggatggctaacctgttgtaagcccgcagctttgggcctggtctctgctgctcccaggcggcccctttgggtactgcctgagcaagaagtgctggagaggaggaccagtcatcaataggaggatgagattgggagagacactcggtgcaggaggctgagtgagcaggggagcactaagacccaggggtagtggaggactgcagcaacgagctggaggaggagaaggaaggcccggcgactgaagcaggcaaaggaggaggcacagatggaggtggagcaataccgcagagagcgagagcacgaattccagagcaagcagcaggcggccatgggctcccaggggaacctgtctgctgaggtggagcaggctacaaggcgccaggtgcagggcatgcagagctcccagcagagaaaccgagagcgtgtcctggcccagcttcttggcatggtctgcgacgtcaggccccaggtccaccccaactaccggatttctgcctagggccaccgtagggcctgactccttctgccagttccctccctcaaagaaatcctccaatcaaaatcacctcccaccataatccctgtcttctttccatcccctagaaatcctgggaggcaggatccaataattttcctgtgacacttataaatatcctgctcacatctgaatctccttgttgttctttaaccctcactgggactttgtaaacttccaagtcattctcacctaaaccctctgtgaaatttgtaatatggggaagtaggaatgtggaaaacatcctgacttcagtgtctggccgatgtgggtccctctcttgaccctgtcacttgctggctgtgaaaccaggacaagctacttaacttggtagcctcgatgtcctcctctgtgaaactgggatgataataatgcctaccttgtgagggttgcttcaatgattaggaatcattctgtaaagtctagcacagttccttgcatgttgtagcagtgattcagtaagtagcaaccctgtgatactattaccaccacctgctcactggtcaaaacctacacagctgtttcctcacgtccatcactggctctctaattccacttgttcattctgtgaccctagttattttctgaaaaattggttcttctcttttcccagagaccttctgatctccaaaaagaggagatgactacatttagcccctctcttataattccaggtagataactgcattttgtagcctctctttgtttttcttttgctgatctttgtctttattagattttcctcctttcctatttccccaaagacttatcagatgctcattgctttctaagatctaaaatgatactgtgttccctcatatgcatgcccttcctttctatatccttgacaccttactttcc

SEQ ID NO: 312565 - DNA, 419 bp, Homo sapiens
ggacagcccccaccccatggctgtcaggcgtgggggcagtagtgtctccttcacccctgacagcccccaccccatggcttccatcttttgcatcaccaccactcctgaacccccatttctgatttgtcagaatttttttttaacaaaactaaaaatgaaacacatgtgtctgtggtatctataaaaaaaaaaaaaaaaaaaaacttggagggccttttttgtgggggtgggggaaaaagggggtaactgcacaagtgtggccccagtggctccctacgcccgttttccccgtgaacccaaagctttccttggtcaccactgactgggtaaaaatctggccgggtcctctcccttattaggaactcggatttaactttcgaataaggccagggttacccctggcattatggaatcggcaa

SEQ ID NO: 312566 - DNA, 3692 bp, Homo sapiens
catcggccataacaacagaaatggccagtcagtcccaaggtatccagcagcttctgcaagctgagaagcgggcagctgagaaggtggcagatgccagaaagaggaaggcccggcgactgaagcaggcaaaggaggaggcacagatggaggtggagcaataccgcagagagcgagagcacgaattccagagcaagcagcaggcgacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttaggtaagctttggccttcgctacaatccgtttccatctgcgcttctccgcacccatcccgtcacatgggttcctgatacccttttcacaggcgatggtctggtcgctggggcctagttggttcgctatttccttagcttgcatccctttcgagagcaaagagctcctgggggaaggaagggaagctaaggggggacccaatccaagatggtgtcctcggcgccattgtgttcgttttgctcccttcttccaatgggttcttctcatattggaggcctcagcatcaatgagaggcggtgctcggcgtcccttggtcttggtatttgcggagggcggggctcttctcaccttccttgttctttcttgagctctttttcggccctcggtgggactgggaggaggagctggtttctgggcccagttggatttttctcaccttgacttgcccaacttaatttggagtgccttccaagtgtttacgatacgattggtgtcattgtatgtttctccaaaaggagtctcaccttcgtagcgtaacagtgatgtgagaccacttggtaaagatcctgttaaagcctgggcggggattgcctttctctgtcacctattagctttcttattgtagggtggagacatgaattttgtttttttgtggccgagccatttgtcttgcaccgcccctcccccccatgctaattacacaaggcttgcttaaacagcggaagggaggatactgagaagtgggaggctgagagctatgggaggtggacggcggccatatgatgttttcttttcgaaaggtgagcgctttgcgcagtgatgaccctcatctatcacccttgactgatggctgctgagttaggcatccataacggtgggattataatagggaaagcggagtcttcctttgaggacttttcaggactctacttgtcatctccattttccactttactaagttattagtcatattttaccttttattatctattctatttcctcactgttactttcagatcaagaatttataagttggtcttccccttccaacttttctggtttccgctactgtgattgctaatcttgttgggaacctctgtcctaaccactttccctggtactgctttttctgttctgttatatttgcttttcgtttttatgttttgtatctgtttttctttccaggtaaaagtttcctggtttagggaaagtgggaactggggatggctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataagtgcttcgtccctttattgtatttggggtgaggttattttagggcatggtccagggtgaattcctataaggcctgggtgccctgcctgctgtgagatcaaaggggaatgggactaagactgcagagccctggctcccccactgcctgccaattgcctgcggtttgtggtctcttccactttctctggcctgggaagacgctggggtgtttatgatcccaaggctcctggtgggtggtgcgtgtattttcagtgccggagggtgctgtgggcactgggggaaacttaggcacctcctccaaggctctcttggtgcctcctcatctgttccttcagcttctggatcttgagcaccagggcttgggcctcccaggctccctcctgcccttcaaggagggcctggtacagctccagctgctgctccaacaactctt

SEQ ID NO: 312567 - DNA, 3265 bp, Homo sapiens
catcggccataacaacagaaatggccagtcagtcccaaggtatccagcagcttctgcaagctgagaagcgggcagctgagaaggtggcagatgccagaaagaggaaggcccggcgactgaagcaggcaaaggaggaggcacagatggaggtggagcaataccgcagagagcgagagcacgaattccagagcaagcagcaggcgacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttaggtaagctttggccttcgctacaatccgtttccatctgcgcttctccgcacccatcccgtcacatgggttcctgatacccttttcacaggcgatggtctggtcgctggggcctagttggttcgctatttccttagcttgcatccctttcgagagcaaagagctcctgggggaaggaagggaagctaaggggggacccaatccaagatggtgtcctcggcgccattgtgttcgttttgctcccttcttccaatgggttcttctcatattggaggcctcagcatcaatgagaggcggtgctcggcgtcccttggtcttggtatttgcggagggcggggctcttctcaccttccttgttctttcttgagctctttttcggccctcggtgggactgggaggaggagctggtttctgggcccagttggatttttctcaccttgacttgcccaacttaatttggagtgccttccaagtgtttacgatacgattggtgtcattgtatgtttctccaaaaggagtctcaccttcgtagcgtaacagtgatgtgagaccacttggtaaagatcctgttaaagcctgggcggggattgcctttctctgtcacctattagctttcttattgtagggtggagacatgaattttgtttttttgtggccgagccatttgtcttgcaccgcccctcccccccatgctaattacacaaggcttgcttaaacagcggaagggaggatactgagaagtgggaggctgagagctatgggaggtggacggcggccatatgatgttttcttttcgaaagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataagtgcttcgtccctttattgtatttggggtgaggttattttagggcatggtccagggtgaattcctataaggcctgggtgccctgcctgctgtgagatcaaaggggaatgggactaagactgcagagccctggctcccccactgcctgccaattgcctgcggtttgtggtctcttccactttctctggcctgggaagacgctggggtgtttatgatcccaaggctcctggtgggtggtgcgtgtattttcagtgccggagggtgctgtgggcactgggggaaacttaggcacctcctccaaggctctcttggtgcctcctcatctgttccttcagcttctggatcttgagcaccagggcttgggcctcccaggctccctcctgcccttcaaggagggcctggtacagctccagctgctgctccaacaactctt

SEQ ID NO: 312568 - DNA, 3022 bp, Homo sapiens
catcggccataacaacagaaatggccagtcagtcccaaggtatccagcagcttctgcaagctgagaagcgggcagctgagaaggtggcagatgccagaaagaggaaggcccggcgactgaagcaggcaaaggaggaggcacagatggaggtggagcaataccgcagagagcgagagcacgaattccagagcaagcagcaggcgacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttaggtaagctttggccttcgctacaatccgtttccatctgcgcttctccgcacccatcccgtcacatgggttcctgatacccttttcacaggcgatggtctggtcgctggggcctagttggttcgctatttccttagcttgcatccctttcgagagcaaagagctcctgggggaaggaagggaagctaaggggggacccaatccaagatggtgtcctcggcgccattgtgttcgttttgctcccttcttccaatgggttcttctcatattggaggcctcagcatcaatgagaggcggtgctcggcgtcccttggtcttggtatttgcggagggcggggctcttctcaccttccttgttctttcttgagctctttttcggccctcggtgggactgggaggaggagctggtttctgggcccagttggatttttctcaccttgacttgcccaacttaatttggagtgccttccaagtgtttacgatacgattggtgtcattgtatgtttctccaaaaggagtctcaccttcgtagcgtaacagtgatgtgagaccacttgctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataagtgcttcgtccctttattgtatttggggtgaggttattttagggcatggtccagggtgaattcctataaggcctgggtgccctgcctgctgtgagatcaaaggggaatgggactaagactgcagagccctggctcccccactgcctgccaattgcctgcggtttgtggtctcttccactttctctggcctgggaagacgctggggtgtttatgatcccaaggctcctggtgggtggtgcgtgtattttcagtgccggagggtgctgtgggcactgggggaaacttaggcacctcctccaaggctctcttggtgcctcctcatctgttccttcagcttctggatcttgagcaccagggcttgggcctcccaggctccctcctgcccttcaaggagggcctggtacagctccagctgctgctccaacaactctt

SEQ ID NO: 312569 - DNA, 5066 bp, Homo sapiens
catcggccataacaacagaaatggccagtcagtcccaaggtatccagcagcttctgcaagctgagaagcgggcagctgagaaggtggcagatgccagaaagaggaaggcccggcgactgaagcaggcaaaggaggaggcacagatggaggtggagcaataccgcagagagcgagagcacgaattccagagcaagcagcaggcgacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttaggtaagctttggccttcgctacaatccgtttccatctgcgcttctccgcacccatcccgtcacatgggttcctgatacccttttcacaggcgatggtctggtcgctggggcctagttggttcgctatttccttagcttgcatccctttcgagagcaaagagctcctgggggaaggaagggaagctaaggggggacccaatccaagatggtgtcctcggcgccattgtgttcgttttgctcccttcttccaatgggttcttctcatattggaggcctcagcatcaatgagaggcggtgctcggcgtcccttggtcttggtatttgcggagggcggggctcttctcaccttccttgttctttcttgagctctttttcggccctcggtgggactgggaggaggagctggtttctgggcccagttggatttttctcaccttgacttgcccaacttaatttggagtgccttccaagtgtttacgatacgattggtgtcattgtatgtttctccaaaaggagtctcaccttcgtagcgtaacagtgatgtgagaccacttggtaaagatcctgttaaagcctgggcggggattgcctttctctgtcacctattagctttcttattgtagggtggagacatgaattttgtttttttgtggccgagccatttgtcttgcaccgcccctcccccccatgctaattacacaaggcttgcttaaacagcggaagggaggatactgagaagtgggaggctgagagctatgggaggtggacggcggccatatgatgttttcttttcgaaaggtgagcgctttgcgcagtgatgaccctcatctatcacccttgactgatggctgctgagttaggcatccataacggtgggattataatagggaaagcggagtcttcctttgaggacttttcaggactctacttgtcatctccattttccactttactaagttattagtcatattttaccttttattatctattctatttcctcactgttactttcagatcaagaatttataagttggtcttccccttccaacttttctggtttccgctactgtgattgctaatcttgttgggaacctctgtcctaaccactttccctggtactgctttttctgttctgttatatttgcttttcgtttttatgttttgtatctgtttttctttccaggtaaaagtttcctggtttagggaaagtgggaactggggatggctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtcagttagacgtccagtagggggatgagcattggagcactccagctgtagcagaaacctggatattaagtacacttttattgaggaaatcacatgtgtgatgtgggagagaataatgagggtataaatatcttaggggctgagcatgagtaaggtgggagctgcttttctattctatggctggcacgggtatgtcctcaataacctcaaggaaaataaacttcaaaaattaagatccttggccaggcacggtggcttatgtgtgtaatcccagcacttggggaggctgagggaggtggatcacttgagtccaggagtttgagaccagtctgggcaacatggcgaaacttcatcactaccaaagaagaaaaaaattagccaggtgtggtggtgtatgcctgtagtcccagatactctggtggctgaggtgagaggatagcttgagcccaggaaattgaggctgcagtgaactatgattgcactactgtgctccagcttgggcaacagagtgagatcttgtctccaaaagtccttgaaggattttaggaagttgttaaaagtcttgaaacgatgtttgggggcatgttagggttcttgaatgtttaattcctctaataactgcttattcaagagaagcatttctgactgggtgcagggcagtggctcatgcccataatcccagtactttgggaggctgaggcaggagcattgcttgagcccaggacttcaagaccagcctgggtaacatagggagacgcccgtctctacaaatagtaaaaataaaaaataaaaaaagtagctgggcgtggtggtgtgcacctgtggtcccagctgcttgggatgctgaggtggaaggatctcttaaacccaggagggtggaggctgcagtgacttgcgattgcaccactgcactccagtctgggggacagagtgagaccccatctcaaaaaagtgtttaattaatatacttgtgagtggtctatttgcatttaaaactgctttctagaattaggatagctcccttaggtttaatgttttggtgagcaggaatatcagttacccctccagatcttaattctagttttttatcactttttcatgaggtgatctcatcctcatctcctagcatgtctggcaattttgatttctgaactctgtgctacctcagaggccagcttccttagggaaaaatcagtgctgaaataaagttatatttccttttctgctctaaatatatagtgggggaataagagaaatgaagaggaattcctgagaacgtaattactagaaactcccctctcccacgtaatgtctctcacacaccatggacccctattcccccaatttgcgaccccccaccccaccccacaacaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataagtgcttcgtccctttattgtatttggggtgaggttattttagggcatggtccagggtgaattcctataaggcctgggtgccctgcctgctgtgagatcaaaggggaatgggactaagactgcagagccctggctcccccactgcctgccaattgcctgcggtttgtggtctcttccactttctctggcctgggaagacgctggggtgtttatgatcccaaggctcctggtgggtggtgcgtgtattttcagtgccggagggtgctgtgggcactgggggaaacttaggcacctcctccaaggctctcttggtgcctcctcatctgttccttcagcttctggatcttgagcaccagggcttgggcctcccaggctccctcctgcccttcaaggagggcctggtacagctccagctgctgctccaacaactctt

SEQ ID NO: 312570 - DNA, 5946 bp, Homo sapiens
catcggccataacaacagaaatggccagtcagtcccaaggtatccagcagcttctgcaagctgagaagcgggcagctgagaaggtggcagatgccagaaagaggaaggcccggcgactgaagcaggcaaaggaggaggcacagatggaggtggagcaataccgcagagagcgagagcacgaattccagagcaagcagcaggcgacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttaggtaagctttggccttcgctacaatccgtttccatctgcgcttctccgcacccatcccgtcacatgggttcctgatacccttttcacaggcgatggtctggtcgctggggcctagttggttcgctatttccttagcttgcatccctttcgagagcaaagagctcctgggggaaggaagggaagctaaggggggacccaatccaagatggtgtcctcggcgccattgtgttcgttttgctcccttcttccaatgggttcttctcatattggaggcctcagcatcaatgagaggcggtgctcggcgtcccttggtcttggtatttgcggagggcggggctcttctcaccttccttgttctttcttgagctctttttcggccctcggtgggactgggaggaggagctggtttctgggcccagttggatttttctcaccttgacttgcccaacttaatttggagtgccttccaagtgtttacgatacgattggtgtcattgtatgtttctccaaaaggagtctcaccttcgtagcgtaacagtgatgtgagaccacttggtaaagatcctgttaaagcctgggcggggattgcctttctctgtcacctattagctttcttattgtagggtggagacatgaattttgtttttttgtggccgagccatttgtcttgcaccgcccctcccccccatgctaattacacaaggcttgcttaaacagcggaagggaggatactgagaagtgggaggctgagagctatgggaggtggacggcggccatatgatgttttcttttcgaaaggtgagcgctttgcgcagtgatgaccctcatctatcacccttgactgatggctgctgagttaggcatccataacggtgggattataatagggaaagcggagtcttcctttgaggacttttcaggactctacttgtcatctccattttccactttactaagttattagtcatattttaccttttattatctattctatttcctcactgttactttcagatcaagaatttataagttggtcttccccttccaacttttctggtttccgctactgtgattgctaatcttgttgggaacctctgtcctaaccactttccctggtactgctttttctgttctgttatatttgcttttcgtttttatgttttgtatctgtttttctttccaggtaaaagtttcctggtttagggaaagtgggaactggggatggctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagattaaatacccttctaccttctctccctccactccccgcccgctgcctcctccccttcctcgccctcttcctcagactcccttgtcattcaagtgccaagaaggcggcttgtgcccaactgggagtaatgactccttgaagagacatacagaagcagagacagctagtgttagggcctgcgcgggtgccagggaaactccggaagacttggtcgggttaatgtgagagcgggtagtgttcgactttttcataaatcacaacatttttgaacctcttctcccttcgggggagggcaggatttttctgccctaccacccacccatccatcgtctcttacatgcaccctacagccacgcaccctcaaggtggcatcgagcatacagctggagccttctgctcaccaaaactcctacttcccggtggcaggagagcaagagagggacagacagatggcagggcatgtccaaaagaagagcatcagcacaaatgaatcctccccttccccacctccaggggtgggggcctttggcacctcaatccccgataccctactccttcccacccacatctccttgcacccatctggaacctcggttgatgtgagccggcaacagagaagcaccgtggcgcggcgagggaatgcagacggcacccagcggtggatggcggcagcggaggccgcggggaaacctgaccaggaagctgaggaccaaaccagcctctttttccgttcccggtttttttcctgaacccaacgcgtgccgtgccccgtttcccccaatatgtgttggggaggggtgtcctgaatggggtggtagattttttttcttaaaaaaatttttttgttttttttaatactcagaggagagggacataggaaagccaatggagatcttcgtggatgatgagacgaagttgacgctgcatgggttgcagcagtactacgtgaaactgaaggacaacgagaagaaccggaagctctttgaccttctggatgtccttgagttcaaccaggtcagttagacgtccagtagggggatgagcattggagcactccagctgtagcagaaacctggatattaagtacacttttattgaggaaatcacatgtgtgatgtgggagagaataatgagggtataaatatcttaggggctgagcatgagtaaggtgggagctgcttttctattctatggctggcacgggtatgtcctcaataacctcaaggaaaataaacttcaaaaattaagatccttggccaggcacggtggcttatgtgtgtaatcccagcacttggggaggctgagggaggtggatcacttgagtccaggagtttgagaccagtctgggcaacatggcgaaacttcatcactaccaaagaagaaaaaaattagccaggtgtggtggtgtatgcctgtagtcccagatactctggtggctgaggtgagaggatagcttgagcccaggaaattgaggctgcagtgaactatgattgcactactgtgctccagcttgggcaacagagtgagatcttgtctccaaaagtccttgaaggattttaggaagttgttaaaagtcttgaaacgatgtttgggggcatgttagggttcttgaatgtttaattcctctaataactgcttattcaagagaagcatttctgactgggtgcagggcagtggctcatgcccataatcccagtactttgggaggctgaggcaggagcattgcttgagcccaggacttcaagaccagcctgggtaacatagggagacgcccgtctctacaaatagtaaaaataaaaaataaaaaaagtagctgggcgtggtggtgtgcacctgtggtcccagctgcttgggatgctgaggtggaaggatctcttaaacccaggagggtggaggctgcagtgacttgcgattgcaccactgcactccagtctgggggacagagtgagaccccatctcaaaaaagtgtttaattaatatacttgtgagtggtctatttgcatttaaaactgctttctagaattaggatagctcccttaggtttaatgttttggtgagcaggaatatcagttacccctccagatcttaattctagttttttatcactttttcatgaggtgatctcatcctcatctcctagcatgtctggcaattttgatttctgaactctgtgctacctcagaggccagcttccttagggaaaaatcagtgctgaaataaagttatatttccttttctgctctaaatatatagtgggggaataagagaaatgaagaggaattcctgagaacgtaattactagaaactcccctctcccacgtaatgtctctcacacaccatggacccctattcccccaatttgcgaccccccaccccaccccacaacaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataagtgcttcgtccctttattgtatttggggtgaggttattttagggcatggtccagggtgaattcctataaggcctgggtgccctgcctgctgtgagatcaaaggggaatgggactaagactgcagagccctggctcccccactgcctgccaattgcctgcggtttgtggtctcttccactttctctggcctgggaagacgctggggtgtttatgatcccaaggctcctggtgggtggtgcgtgtattttcagtgccggagggtgctgtgggcactgggggaaacttaggcacctcctccaaggctctcttggtgcctcctcatctgttccttcagcttctggatcttgagcaccagggcttgggcctcccaggctccctcctgcccttcaaggagggcctggtacagctccagctgctgctccaacaactctt

SEQ ID NO: 312571 - DNA, 4786 bp, Homo sapiens
catcggccataacaacagaaatggccagtcagtcccaaggtatccagcagcttctgcaagctgagaagcgggcagctgagaaggtggcagatgccagaaagaggaaggcccggcgactgaagcaggcaaaggaggaggcacagatggaggtggagcaataccgcagagagcgagagcacgaattccagagcaagcagcaggcgacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttaggtaagctttggccttcgctacaatccgtttccatctgcgcttctccgcacccatcccgtcacatgggttcctgatacccttttcacaggcgatggtctggtcgctggggcctagttggttcgctatttccttagcttgcatccctttcgagagcaaagagctcctgggggaaggaagggaagctaaggggggacccaatccaagatggtgtcctcggcgccattgtgttcgttttgctcccttcttccaatgggttcttctcatattggaggcctcagcatcaatgagaggcggtgctcggcgtcccttggtcttggtatttgcggagggcggggctcttctcaccttccttgttctttcttgagctctttttcggccctcggtgggactgggaggaggagctggtttctgggcccagttggatttttctcaccttgacttgcccaacttaatttggagtgccttccaagtgtttacgatacgattggtgtcattgtatgtttctccaaaaggagtctcaccttcgtagcgtaacagtgatgtgagaccacttggtaaagatcctgttaaagcctgggcggggattgcctttctctgtcacctattagctttcttattgtagggtggagacatgaattttgtttttttgtggccgagccatttgtcttgcaccgcccctcccccccatgctaattacacaaggcttgcttaaacagcggaagggaggatactgagaagtgggaggctgagagctatgggaggtggacggcggccatatgatgttttcttttcgaaaggtgagcgctttgcgcagtgatgaccctcatctatcacccttgactgatggctgctgagttaggcatccataacggtgggattataatagggaaagcggagtcttcctttgaggacttttcaggactctacttgtcatctccattttccactttactaagttattagtcatattttaccttttattatctattctatttcctcactgttactttcagatcaagaatttataagttggtcttccccttccaacttttctggtttccgctactgtgattgctaatcttgttgggaacctctgtcctaaccactttccctggtactgctttttctgttctgttatatttgcttttcgtttttatgttttgtatctgtttttctttccaggtaaaagtttcctggtttagggaaagtgggaactggggatggctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtcagttagacgtccagtagggggatgagcattggagcactccagctgtagcagaaacctggatattaagtacacttttattgaggaaatcacatgtgtgatgtgggagagaataatgagggtataaatatcttaggggctgagcatgagtaaggtgggagctgcttttctattctatggctgcagtgaactatgattgcactactgtgctccagcttgggcaacagagtgagatcttgtctccaaaagtccttgaaggattttaggaagttgttaaaagtcttgaaacgatgtttgggggcatgttagggttcttgaatgtttaattcctctaataactgcttattcaagagaagcatttctgactgggtgcagggcagtggctcatgcccataatcccagtactttgggaggctgaggcaggagcattgcttgagcccaggacttcaagaccagcctgggtaacatagggagacgcccgtctctacaaatagtaaaaataaaaaataaaaaaagtagctgggcgtggtggtgtgcacctgtggtcccagctgcttgggatgctgaggtggaaggatctcttaaacccaggagggtggaggctgcagtgacttgcgattgcaccactgcactccagtctgggggacagagtgagaccccatctcaaaaaagtgtttaattaatatacttgtgagtggtctatttgcatttaaaactgctttctagaattaggatagctcccttaggtttaatgttttggtgagcaggaatatcagttacccctccagatcttaattctagttttttatcactttttcatgaggtgatctcatcctcatctcctagcatgtctggcaattttgatttctgaactctgtgctacctcagaggccagcttccttagggaaaaatcagtgctgaaataaagttatatttccttttctgctctaaatatatagtgggggaataagagaaatgaagaggaattcctgagaacgtaattactagaaactcccctctcccacgtaatgtctctcacacaccatggacccctattcccccaatttgcgaccccccaccccaccccacaacaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataagtgcttcgtccctttattgtatttggggtgaggttattttagggcatggtccagggtgaattcctataaggcctgggtgccctgcctgctgtgagatcaaaggggaatgggactaagactgcagagccctggctcccccactgcctgccaattgcctgcggtttgtggtctcttccactttctctggcctgggaagacgctggggtgtttatgatcccaaggctcctggtgggtggtgcgtgtattttcagtgccggagggtgctgtgggcactgggggaaacttaggcacctcctccaaggctctcttggtgcctcctcatctgttccttcagcttctggatcttgagcaccagggcttgggcctcccaggctccctcctgcccttcaaggagggcctggtacagctccagctgctgctccaacaactctt

SEQ ID NO: 312572 - DNA, 5892 bp, Homo sapiens
catcggccataacaacagaaatggccagtcagtcccaaggtatccagcagcttctgcaagctgagaagcgggcagctgagaaggtggcagatgccagaaagaggaaggcccggcgactgaagcaggcaaaggaggaggcacagatggaggtggagcaataccgcagagagcgagagcacgaattccagagcaagcagcaggcgacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttaggtaagctttggccttcgctacaatccgtttccatctgcgcttctccgcacccatcccgtcacatgggttcctgatacccttttcacaggcgatggtctggtcgctggggcctagttggttcgctatttccttagcttgcatccctttcgagagcaaagagctcctgggggaaggaagggaagctaaggggggacccaatccaagatggtgtcctcggcgccattgtgttcgttttgctcccttcttccaatgggttcttctcatattggaggcctcagcatcaatgagaggcggtgctcggcgtcccttggtcttggtatttgcggagggcggggctcttctcaccttccttgttctttcttgagctctttttcggccctcggtgggactgggaggaggagctggtttctgggcccagttggatttttctcaccttgacttgcccaacttaatttggagtgccttccaagtgtttacgatacgattggtgtcattgtatgtttctccaaaaggagtctcaccttcgtagcgtaacagtgatgtgagaccacttggtaaagatcctgttaaagcctgggcggggattgcctttctctgtcacctattagctttcttattgtagggtggagacatgaattttgtttttttgtggccgagccatttgtcttgcaccgcccctcccccccatgctaattacacaaggcttgcttaaacagcggaagggaggatactgagaagtgggaggctgagagctatgggaggtggacggcggccatatgatgttttcttttcgaaaggtgagcgctttgcgcagtgatgaccctcatctatcacccttgactgatggctgctgagttaggcatccataacggtgggattataatagggaaagcggagtcttcctttgaggacttttcaggactctacttgtcatctccattttccactttactaagttattagtcatattttaccttttattatctattctatttcctcactgttactttcagatcaagaatttataagttggtcttccccttccaacttttctggtttccgctactgtgattgctaatcttgttgggaacctctgtcctaaccactttccctggtactgctttttctgttctgttatatttgcttttcgtttttatgttttgtatctgtttttctttccaggtaaaagtttcctggtttagggaaagtgggaactggggatggctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagattaaatacccttctaccttctctccctccactccccgcccgctgcctcctccccttcctcgccctcttcctcagactcccttgtcattcaagtgccaagaaggcggcttgtgcccaactgggagtaatgactccttgaagagacatacagaagcagagacagctagtgttagggcctgcgcgggtgccagggaaactccggaagacttggtcgggttaatgtgagagcgggtagtgttcgactttttcataaatcacaacatttttgaacctcttctcccttcgggggagggcaggatttttctgccctaccacccacccatccatcgtctcttacatgcaccctacagccacgcaccctcaaggtggcatcgagcatacagctggagccttctgctcaccaaaactcctacttcccggtggcaggagagcaagagagggacagacagatggcagggcatgtccgggcctttggcacctcaatccccgataccctactccttcccacccacatctccttgcacccatctggaacctcggttgatgtgagccggcaacagagaagcaccgtggcgcggcgagggaatgcagacggcacccagcggtggatggcggcagcggaggccgcggggaaacctgaccaggaagctgaggaccaaaccagcctctttttccgttcccggtttttttcctgaacccaacgcgtgccgtgccccgtttcccccaatatgtgttggggaggggtgtcctgaatggggtggtagattttttttcttaaaaaaatttttttgttttttttaatactcagaggagagggacataggaaagccaatggagatcttcgtggatgatgagacgaagttgacgctgcatgggttgcagcagtactacgtgaaactgaaggacaacgagaagaaccggaagctctttgaccttctggatgtccttgagttcaaccaggtcagttagacgtccagtagggggatgagcattggagcactccagctgtagcagaaacctggatattaagtacacttttattgaggaaatcacatgtgtgatgtgggagagaataatgagggtataaatatcttaggggctgagcatgagtaaggtgggagctgcttttctattctatggctggcacgggtatgtcctcaataacctcaaggaaaataaacttcaaaaattaagatccttggccaggcacggtggcttatgtgtgtaatcccagcacttggggaggctgagggaggtggatcacttgagtccaggagtttgagaccagtctgggcaacatggcgaaacttcatcactaccaaagaagaaaaaaattagccaggtgtggtggtgtatgcctgtagtcccagatactctggtggctgaggtgagaggatagcttgagcccaggaaattgaggctgcagtgaactatgattgcactactgtgctccagcttgggcaacagagtgagatcttgtctccaaaagtccttgaaggattttaggaagttgttaaaagtcttgaaacgatgtttgggggcatgttagggttcttgaatgtttaattcctctaataactgcttattcaagagaagcatttctgactgggtgcagggcagtggctcatgcccataatcccagtactttgggaggctgaggcaggagcattgcttgagcccaggacttcaagaccagcctgggtaacatagggagacgcccgtctctacaaatagtaaaaataaaaaataaaaaaagtagctgggcgtggtggtgtgcacctgtggtcccagctgcttgggatgctgaggtggaaggatctcttaaacccaggagggtggaggctgcagtgacttgcgattgcaccactgcactccagtctgggggacagagtgagaccccatctcaaaaaagtgtttaattaatatacttgtgagtggtctatttgcatttaaaactgctttctagaattaggatagctcccttaggtttaatgttttggtgagcaggaatatcagttacccctccagatcttaattctagttttttatcactttttcatgaggtgatctcatcctcatctcctagcatgtctggcaattttgatttctgaactctgtgctacctcagaggccagcttccttagggaaaaatcagtgctgaaataaagttatatttccttttctgctctaaatatatagtgggggaataagagaaatgaagaggaattcctgagaacgtaattactagaaactcccctctcccacgtaatgtctctcacacaccatggacccctattcccccaatttgcgaccccccaccccaccccacaacaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataagtgcttcgtccctttattgtatttggggtgaggttattttagggcatggtccagggtgaattcctataaggcctgggtgccctgcctgctgtgagatcaaaggggaatgggactaagactgcagagccctggctcccccactgcctgccaattgcctgcggtttgtggtctcttccactttctctggcctgggaagacgctggggtgtttatgatcccaaggctcctggtgggtggtgcgtgtattttcagtgccggagggtgctgtgggcactgggggaaacttaggcacctcctccaaggctctcttggtgcctcctcatctgttccttcagcttctggatcttgagcaccagggcttgggcctcccaggctccctcctgcccttcaaggagggcctggtacagctccagctgctgctccaacaactctt

SEQ ID NO: 312573 - DNA, 3471 bp, Homo sapiens
catcggccataacaacagaaatggccagtcagtcccaaggtatccagcagcttctgcaagctgagaagcgggcagctgagaaggtggcagatgccagaaagaggaaggcccggcgactgaagcaggcaaaggaggaggcacagatggaggtggagcaataccgcagagagcgagagcacgaattccagagcaagcagcaggcgacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttaggtaagctttggccttcgctacaatccgtttccatctgcgcttctccgcacccatcccgtcacatgggttcctgatacccttttcacaggcgatggtctggtcgctggggcctagttggttcgctatttccttagcttgcatccctttcgagagcaaagagctcctgggggaaggaagggaagctaaggggggacccaatccaagatggtgtcctcggcgccattgtgttcgttttgctcccttcttccaatgggttcttctcatattggaggcctcagcatcaatgagaggcggtgctcggcgtcccttggtcttggtatttgcggagggcggggctcttctcaccttccttgttctttcttgagctctttttcggccctcggtgggactgggaggaggagctggtttctgggcccagttggatttttctcaccttgacttgcccaacttaatttggagtgccttccaagtgtttacgatacgattggtgtcattgtatgtttctccaaaaggagtctcaccttcgtagcgtaacagtgatgtgagaccacttggtaaagatcctgttaaagcctgggcggggattgcctttctctgtcacctattagctttcttattgtagggtggagacatgaattttgtttttttgtggccgagccatttgtcttgcaccgcccctcccccccatgctaattacacaaggcttgcttaaacagcggaagggaggatactgagaagtgggaggctgagagctatgggaggtggacggcggccatatgatgttttcttttcgaaaggtgagcgctttgcgcagtgatgaccctcatctatcacccttgactgatggctgctgagttaggcatccataacggtgggattataatagggaaagcggagtcttcctttgaggacttttcaggactctacttgtcatctccattttccactttactaagttattagtcatattttaccttttattatctattctatttcctcactgttactttcagatcaagaatttataagttggtcttccccttccaacttttctggtttccgctactgtgattgctaatcttgttgggaacctctgtcctaaccactttccctggtactgctttttctgttctgttatatttgcttttcgtttttatgttttgtatctgtttttctttccaggtaaaagtttcctggtttagggaaagtgggaactggggatggctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataagtgcttcgtccctttattgtatttggggtgaggttattttagggcatggtccagggtgaattcctataaggcctgggtgccctgcctgctgtgagatcaaaggggaatgggactaagactgcagagccctggctcccccactgcctgccaattgcctgcggtttgtggtctcttccactttctctggcctgggaagacgctggggtgtttatgatcccaaggctcctggtgggtggtgcgtgtattttcagtgccggagggtgctgtgggcactgggggaaacttaggcacctcctccaaggctctcttggtgcctcctcatctgttccttcagcttctggatcttgagcaccagggcttgggcctcccaggctccctcctgcccttcaaggagggcctggtacagctccagctgctgctccaacaactctt

SEQ ID NO: 312574 - DNA, 3715 bp, Homo sapiens
catcggccataacaacagaaatggccagtcagtcccaaggtatccagcagcttctgcaagctgagaagcgggcagctgagaaggtggcagatgccagaaagaggaaggcccggcgactgaagcaggcaaaggaggaggcacagatggaggtggagcaataccgcagagagcgagagcacgaattccagagcaagcagcaggcgacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttaggtaagctttggccttcgctacaatccgtttccatctgcgcttctccgcacccatcccgtcacatgggttcctgatacccttttcacaggcgatggtctggtcgctggggcctagttggttcgctatttccttagcttgcatccctttcgagagcaaagagctcctgggggaaggaagggaagctaaggggggacccaatccaagatggtgtcctcggcgccattgtgttcgttttgctcccttcttccaatgggttcttctcatattggaggcctcagcatcaatgagaggcggtgctcggcgtcccttggtcttggtatttgcggagggcggggctcttctcaccttccttgttctttcttgagctctttttcggccctcggtgggactgggaggaggagctggtttctgggcccagttggatttttctcaccttgacttgcccaacttaatttggagtgccttccaagtgtttacgatacgattggtgtcattgtatgtttctccaaaaggagtctcaccttcgtagcgtaacagtgatgtgagaccacttggtaaagatcctgttaaagcctgggcggggattgcctttctctgtcacctattagctttcttattgtagggtggagacatgaattttgtttttttgtggccgagccatttgtcttgcaccgcccctcccccccatgctaattacacaaggcttgcttaaacagcggaagggaggatactgagaagtgggaggctgagagctatgggaggtggacggcggccatatgatgttttcttttcgaaaggtgagcgctttgcgcagtgatgaccctcatctatcacccttgactgatggctgctgagttaggcatccataacggtgggattataatagggaaagcggagtcttcctttgaggacttttcaggactctacttgtcatctccattttccactttactaagttattagtcatattttaccttttattatctattctatttcctcactgttactttcagatcaagaatttataagttggtcttccccttccaacttttctggtttccgctactgtgattgctaatcttgttgggaacctctgtcctaaccactttccctggtactgctttttctgttctgttatatttgcttttcgtttttatgttttgtatctgtttttctttccaggtaaaagtttcctggtttagggaaagtgggaactggggatggctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcggtgctaccctctgtctccctccaggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataagtgcttcgtccctttattgtatttggggtgaggttattttagggcatggtccagggtgaattcctataaggcctgggtgccctgcctgctgtgagatcaaaggggaatgggactaagactgcagagccctggctcccccactgcctgccaattgcctgcggtttgtggtctcttccactttctctggcctgggaagacgctggggtgtttatgatcccaaggctcctggtgggtggtgcgtgtattttcagtgccggagggtgctgtgggcactgggggaaacttaggcacctcctccaaggctctcttggtgcctcctcatctgttccttcagcttctggatcttgagcaccagggcttgggcctcccaggctccctcctgcccttcaaggagggcctggtacagctccagctgctgctccaacaactctt

SEQ ID NO: 312575 - DNA, 3122 bp, Homo sapiens
catcggccataacaacagaaatggccagtcagtcccaaggtatccagcagcttctgcaagctgagaagcgggcagctgagaaggtggcagatgccagaaagaggaaggcccggcgactgaagcaggcaaaggaggaggcacagatggaggtggagcaataccgcagagagcgagagcacgaattccagagcaagcagcaggcgacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttaggtaagctttggccttcgctacaatccgtttccatctgcgcttctccgcacccatcccgtcacatgggttcctgatacccttttcacaggcgatggtctggtcgctggggcctagttggttcgctatttccttagcttgcatccctttcgagagcaaagagctcctgggggaaggaagggaagctaaggggggacccaatccaagatggtgtcctcggcgccattgtgttcgttttgctcccttcttccaatgggttcttctcatattggaggcctcagcatcaatgagaggcggtgctcggcgtcccttggtcttggtatttgcggagggcggggctcttctcaccttccttgttctttcttgagctctttttcggccctcggtgggactgggaggaggagctggtttctgggcccagttggatttttctcaccttgacttgcccaacttaatttggagtgccttccaagtgtttacgatacgattggtgtcattgtatgtttctccaaaaggagtctcaccttcgtagcgtaacagtgatgtgagaccacttggtaaagatcctgttaaagcctgggcggggattgcctttctctgtcacctattagctttcttattgtagggtggagacatgaattttgtttttttgtggccgagccatttgtcttgcaccgcccctcccccccatgctaattacacaaggcttgcttaaacagcggaagggaggatactgagaagtgggaggctgagagctatgggaggtggacggcggccatatgatgttttcttttcgaaaggtgagcgctttgcgcagtgatgaccctcatctatcacccttgactgatggctgctgagttaggcatccataacggtgggattataatagggaaagcggagtcttcctttgaggacttttcaggactctacttgtcatctccattttccactttactaagttattagtcatattttaccttttattatctattctatttcctcactgttactttcagatcaagaatttataagttggtcttccccttccaacttttctggtttccgctactgtgattgctaatcttgttgggaacctctgtcctaaccactttccctggtactgctttttctgttctgttatatttgcttttcgtttttatgttttgtatctgtttttctttccaggtaaaagtttcctggtttagggaaagtgggaactggggatggctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgtacagacacggtagttagactccccatgaatgtgtttcctcatgtgttaaatgggaatagcaggacacgggacacgttgtgcagggatcct

SEQ ID NO: 312576 - DNA, 2936 bp, Homo sapiens
catcggccataacaacagaaatggccagtcagtcccaaggtatccagcagcttctgcaagctgagaagcgggcagctgagaaggtggcagatgccagaaagaggaaggcccggcgactgaagcaggcaaaggaggaggcacagatggaggtggagcaataccgcagagagcgagagcacgaattccagagcaagcagcaggcgacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttaggtaagctttggccttcgctacaatccgtttccatctgcgcttctccgcacccatcccgtcacatgggttcctgatacccttttcacaggcgatggtctggtcgctggggcctagttggttcgctatttccttagcttgcatccctttcgagagcaaagagctcctgggggaaggaagggaagctaaggggggacccaatccaagatggtgtcctcggcgccattgtgttcgttttgctcccttcttccaatgggttcttctcatattggaggcctcagcatcaatgagaggcggtgctcggcgtcccttggtcttggtatttgcggagggcggggctcttctcaccttccttgttctttcttgagctctttttcggccctcggtgggactgggaggaggagctggtttctgggcccagttggatttttctcaccttgacttgcccaacttaatttggagtgccttccaagtgtttacgatacgattggtgtcattgtatgtttctccaaaaggagtctcaccttcgtagcgtaacagtgatgtgagaccacttggtaaagatcctgttaaagcctgggcggggattgcctttctctgtcacctattagctttcttattgtagggtggagacatgaattttgtttttttgtggccgagccatttgtcttgcaccgcccctcccccccatgctaattacacaaggcttgcttaaacagcggaagggaggatactgagaagtgggaggctgagagctatgggaggtggacggcggccatatgatgttttcttttcgaaaggtgagcgctttgcgcagtgatgaccctcatctatcacccttgactgatggctgctgagttaggcatccataacggtgggattataatagggaaagcggagtcttcctttgaggacttttcaggactctacttgtcatctccattttccactttactaagttattagtcatattttaccttttattatctattctatttcctcactgttactttcagatcaagaatttataagttggtcttccccttccaacttttctggtttccgctactgtgattgctaatcttgttgggaacctctgtcctaaccactttccctggtactgctttttctgttctgttatatttgcttttcgtttttatgttttgtatctgtttttctttccaggtaaaagtttcctggtttagggaaagtgggaactggggatggctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtaaacctcacaggctgaaaaaatcccactctcccattcccttgttttctgtttgt

SEQ ID NO: 312577 - DNA, 2594 bp, Homo sapiens
  misc_feature (2551)..(2553): n is a, c, g, or t
  misc_feature (2561)..(2561): n is a, c, g, or t
  misc_feature (2580)..(2580): n is a, c, g, or t
catcggccataacaacagaaatggccagtcagtcccaaggtatccagcagcttctgcaagctgagaagcgggcagctgagaaggtggcagatgccagaaagaggaaggcccggcgactgaagcaggcaaaggaggaggcacagatggaggtggagcaataccgcagagagcgagagcacgaattccagagcaagcagcaggcgacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttaggtaagctttggccttcgctacaatccgtttccatctgcgcttctccgcacccatcccgtcacatgggttcctgatacccttttcacaggcgatggtctggtcgctggggcctagttggttcgctatttccttagcttgcatccctttcgagagcaaagagctcctgggggaaggaagggaagctaaggggggacccaatccaagatggtgtcctcggcgccattgtgttcgttttgctcccttcttccaatgggttcttctcatattggaggcctcagcatcaatgagaggcggtgctcggcgtcccttggtcttggtatttgcggagggcggggctcttctcaccttccttgttctttcttgagctctttttcggccctcggtgggactgggaggaggagctggtttctgggcccagttggatttttctcaccttgacttgcccaacttaatttggagtgccttccaagtgtttacgatacgattggtgtcattgtatgtttctccaaaaggagtctcaccttcgtagcgtaacagtgatgtgagaccacttggtaaagatcctgttaaagcctgggcggggattgcctttctctgtcacctattagctttcttattgtagggtggagacatgaattttgtttttttgtggccgagccatttgtcttgcaccgcccctcccccccatgctaattacacaaggcttgcttaaacagcggaagggaggatactgagaagtgggaggctgagagctatgggaggtggacggcggccatatgatgttttcttttcgaaaggtgagcgctttgcgcagtgatgaccctcatctatcacccttgactgatggctgctgagttaggcatccataacggtgggattataatagggaaagcggagtcttcctttgaggacttttcaggactctacttgtcatctccattttccactttactaagttattagtcatattttaccttttattatctattctatttcctcactgttactttcagatcaagaatttataagttggtcttccccttccaacttttctggtttccgctactgtgattgctaatcttgttgggaacctctgtcctaaccactttccctggtactgctttttctgttctgttatatttgcttttcgtttttatgttttgtatctgtttttctttccaggtaaaagtttcctggtttagggaaagtgggaactggggatggctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatcgctctcacattaacccgaccagtcttccggagtttcctgcacccgcgcagccctacnnnagctgtcnctgcttctgtatgtctctnataagatcctgtat

SEQ ID NO: 312578 - DNA, 2869 bp, Homo sapiens
catcggccataacaacagaaatggccagtcagtcccaaggtatccagcagcttctgcaagctgagaagcgggcagctgagaaggtggcagatgccagaaagaggaaggcccggcgactgaagcaggcaaaggaggaggcacagatggaggtggagcaataccgcagagagcgagagcacgaattccagagcaagcagcaggcgacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttaggtaagctttggccttcgctacaatccgtttccatctgcgcttctccgcacccatcccgtcacatgggttcctgatacccttttcacaggcgatggtctggtcgctggggcctagttggttcgctatttccttagcttgcatccctttcgagagcaaagagctcctgggggaaggaagggaagctaaggggggacccaatccaagatggtgtcctcggcgccattgtgttcgttttgctcccttcttccaatgggttcttctcatattggaggcctcagcatcaatgagaggcggtgctcggcgtcccttggtcttggtatttgcggagggcggggctcttctcaccttccttgttctttcttgagctctttttcggccctcggtgggactgggaggaggagctggtttctgggcccagttggatttttctcaccttgacttgcccaacttaatttggagtgccttccaagtgtttacgatacgattggtgtcattgtatgtttctccaaaaggagtctcaccttcgtagcgtaacagtgatgtgagaccacttggtaaagatcctgttaaagcctgggcggggattgcctttctctgtcacctattagctttcttattgtagggtggagacatgaattttgtttttttgtggccgagccatttgtcttgcaccgcccctcccccccatgctaattacacaaggcttgcttaaacagcggaagggaggatactgagaagtgggaggctgagagctatgggaggtggacggcggccatatgatgttttcttttcgaaaggtgagcgctttgcgcagtgatgaccctcatctatcacccttgactgatggctgctgagttaggcatccataacggtgggattataatagggaaagcggagtcttcctttgaggacttttcaggactctacttgtcatctccattttccactttactaagttattagtcatattttaccttttattatctattctatttcctcactgttactttcagatcaagaatttataagttggtcttccccttccaacttttctggtttccgctactgtgattgctaatcttgttgggaacctctgtcctaaccactttccctggtactgctttttctgttctgttatatttgcttttcgtttttatgttttgtatctgtttttctttccaggtaaaagtttcctggtttagggaaagtgggaactggggatggctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggtaagccaaggtaaagagacctgagagtgagggtgtggcaagttggagggataagaaacttgtaggccaatagtctctttaattttggagaagctttagtttgctgtggtgtaacagagtgttgagttcctatgtaacaggaggattcgtaattgggctatggatgatgcttaacacaagaccacccttttcttactactttatactgactttgaatcatatcagtttaataattttggggtatgtggcagagaaagccggaaactttaaaacagctccagtggtgtgtgaatattgaggattctggccaagtgcacaatggcttacacctgtaatctcagcagtttgggaggccaaggcgtgtggattatttgaggtcaggagtttaagaccaatgtggccaacaggatgaaaccctctctctactaaaaatgcaaaaattagccgtgcatggtggcacacacctatagtcccacctgcttgggaggctgaggcaggggaatcgcttgaacccaggaagcagaggttgtagtgagctgagattgtgccattacactccagcctgggtggcagagtgagactcccatctcatccctttttcctctttcctttcctttcgtccgctttgtcccatccccctttagatctcagcttgtttatcctgcttcctcatctcccc

SEQ ID NO: 312579 - DNA, 323 bp, Homo sapiens
taagagcctcaacctcaaacacattaaacactttattttggatgaatgtgataagatgcttgaacagctcggtgagtggcagtgctggggcttggctaatgctggggagttgttctttggagccaaatgatgtttatttgaaacaggagcacctcagtgcaaggacgactcttatctatcacccatgactgatggctctgggttccctggttggtctttattatgcttttaagcacagtaaagggtgtcatctatcatctttctatgatttttgtttttaacctttgagaataggggactttgataattttaggcataagtca

SEQ ID NO: 312580 - DNA, 800 bp, Homo sapiens
tagtgttagggcctgcgcgggtgccagggaaactccggaagacttggtcgggttaatgtgagagcgggtagtgttcgactttttcataaatcacaacatttttgaacctcttctcccttcgggggagggcaggatttttctgccctaccacccacccatccatcgtctcttacatgcaccctacagccacgcaccctcaaggtggcatcgagcatacagctggagccttctgctcaccaaaactcctacttcccggtggcaggagagcaagagagggacagacagatggcagggcatgtccaaaagaagagcatcagcacaaatgaatcctccccttccccacctccaggggtgggggcctttggcacctcaatccccgataccctactccttcccacccacatctccttgcacccatctggaacctcggttgatgtgagccggcaacagagaagcaccgtggcgcggcgagggaatgcagacggcacccagcggtggatggcggcagcggaggccgcggggaaacctgaccaggaagctgaggaccaaaccagcctctttttccgttcccggtttttttcctgaacccaacgcgtgccgtgccccgtttcccccaatatgtgttggggaggggtgtcctgaatggggtggtagattttttttcttaaaaaaatttttttgttttttttaatactcagaggagagggacataggaaaggtaaagtggatgtaatcgggtggttgttagggtttggggctaggtggggccaattgcataagcagtggagtgtgttcttccc

SEQ ID NO: 312581 - DNA, 1274 bp, Homo sapiens
catcggccataacaacagaaatggccagtcagtcccaaggtatccagcagcttctgcaagctgagaagcgggcagctgagaaggtggcagatgccagaaagaggaaggcccggcgactgaagcaggcaaaggaggaggcacagatggaggtggagcaataccgcagagagcgagagcacgaattccagagcaagcagcaggcggccatgggctcccaggggaacctgtctgctgaggtggagcaggctacaaggcgccaggtgcagggcatgcagagctcccagcagagaaaccgagagcgtgtcctggcccagcttcttggcatggtctgcgacgtcaggccccaggtccaccccaactaccggatttctgcctagggccaccgtagggcctgactccttctgccagttccctccctcaaagaaatcctccaatcaaaatcacctcccaccataatccctgtcttctttccatcccctagaaatcctgggaggcaggatccaataattttcctgtgacacttataaatatcctgctcacatctgaatctccttgttgttctttaaccctcactgggactttgtaaacttccaagtcattctcacctaaaccctctgtgaaatttgtaatatggggaagtaggaatgtggaaaacatcctgacttcagtgtctggccgatgtgggtccctctcttgaccctgtcacttgctggctgtgaaaccaggacaagctacttaacttggtagcctcgatgtcctcctctgtgaaactgggatgataataatgcctaccttgtgagggttgcttcaatgattaggaatcattctgtaaagtctagcacagttccttgcatgttgtagcagtgattcagtaagtagcaaccctgtgatactattaccaccacctgctcactggtcaaaacctacacagctgtttcctcacgtccatcactggctctctaattccacttgttcattctgtgaccctagttattttctgaaaaattggttcttctcttttcccagagaccttctgatctccaaaaagaggagatgactacatttagcccctctcttataattccaggtagataactgcattttgtagcctctctttgtttttcttttgctgatctttgtctttattagattttcctcctttcctatttccccaaagacttatcagatgctcattgctttctaagatctaaaatgatactgtgttccctcatatgcatgcccttcctttctatatccttgacaccttactttcc

SEQ ID NO: 312582 - DNA, 2654 bp, Homo sapiens
catcggccataacaacagaaatggccagtcagtcccaaggtatccagcagcttctgcaagctgagaagcgggcagctgagaaggtggcagatgccagaaagaggaaggcccggcgactgaagcaggcaaaggaggaggcacagatggaggtggagcaataccgcagagagcgagagcacgaattccagagcaagcagcaggcgacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttaggtaagctttggccttcgctacaatccgtttccatctgcgcttctccgcacccatcccgtcacatgggttcctgatacccttttcacaggcgatggtctggtcgctggggcctagttggttcgctatttccttagcttgcatccctttcgagagcaaagagctcctgggggaaggaagggaagctaaggggggacccaatccaagatggtgtcctcggcgccattgtgttcgttttgctcccttcttccaatgggttcttctcatattggaggcctcagcatcaatgagaggcggtgctcggcgtcccttggtcttgttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataagtgcttcgtccctttattgtatttggggtgaggttattttagggcatggtccagggtgaattcctataaggcctgggtgccctgcctgctgtgagatcaaaggggaatgggactaagactgcagagccctggctcccccactgcctgccaattgcctgcggtttgtggtctcttccactttctctggcctgggaagacgctggggtgtttatgatcccaaggctcctggtgggtggtgcgtgtattttcagtgccggagggtgctgtgggcactgggggaaacttaggcacctcctccaaggctctcttggtgcctcctcatctgttccttcagcttctggatcttgagcaccagggcttgggcctcccaggctccctcctgcccttcaaggagggcctggtacagctccagctgctgctccaacaactctt

SEQ ID NO: 312583 - DNA, 5009 bp, Homo sapiens
catcggccataacaacagaaatggccagtcagtcccaaggtatccagcagcttctgcaagctgagaagcgggcagctgagaaggtggcagatgccagaaagaggaaggcccggcgactgaagcaggcaaaggaggaggcacagatggaggtggagcaataccgcagagagcgagagcacgaattccagagcaagcagcaggcgacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttaggtaagctttggccttcgctacaatccgtttccatctgcgcttctccgcacccatcccgtcacatgggttcctgatacccttttcacaggcgatggtctggtcgctggggcctagttggttcgctatttccttagcttgcatccctttcgagagcaaagagctcctgggggaaggaagggaagctaaggggggacccaatccaagatggtgtcctcggcgccattgtgttcgttttgctcccttcttccaatgggttcttctcatattggaggcctcagcatcaatgagaggcggtgctcggcgtcccttggtcttggtatttgcggagggcggggctcttctcaccttccttgttctttcttgagctctttttcggccctcggtgggactgggaggaggagctggtttctgggcccagttggatttttctcaccttgacttgcccaacttaatttggagtgccttccaagtgtttacgatacgattggtgtcattgtatgtttctccaaaaggagtctcaccttcgtagcgtaacagtgatgtgagaccacttggtaaagatcctgttaaagcctgggcggggattgcctttctctgtcacctattagctttcttattgtagggtggagacatgaattttgtttttttgtggccgagccatttgtcttgcaccgcccctcccccccatgctaattacacaaggcttgcttaaacagcggaagggaggatactgagaagtgggaggctgagagctatgggaggtggacggcggccatatgatgttttcttttcgaaaggtgagcgctttgcgcagtgatgaccctcatctatcacccttgactgatggctgctgagttaggcatccataacggtgggattataatagggaaagcggagtcttcctttgaggacttttcaggactctacttgtcatctccattttccactttactaagttattagtcatattttaccttttattatctattctatttcctcactgttactttcagatcaagaatttataagttggtcttccccttccaacttttctggtttccgctactgtgattgctaatcttgttgggaacctctgtcctaaccactttccctggtactgctttttctgttctgttatatttgcttttcgtttttatgttttgtatctgtttttctttccaggtaaaagtttcctggtttagggaaagtgggaactggggatggctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtcagttagacgtccagtagggggatgagcattggagcactccagctgtagcagaaacctggatattaagtacacttttattgaggaaatcacatgtgtgatgtgggagagaataatgagggtataaatatcttaggggctgagcatgagtaaggtgggagctgcttttctattctatggctggcacgggtatgtcctcaataacctcaaggaaaataaacttcaaaaattaagatccttggccaggcacggtggcttatgtgtgtaatcccagcacttggggaggctgagggaggtggatcacttgagtccaggagtttgagaccagtctgggcaacatggcgaaacttcatcactaccaaagaagaaaaaaattagccaggtgtggtggtgtatgcctgtagtcccagatactctggtggctgaggtgagaggatagcttgagcccaggaaattgaggctgcagtgaactatgattgcactactgtgctccagcttgggcaacagagtgagatcttgtctcccatgttagggttcttgaatgtttaattcctctaataactgcttattcaagagaagcatttctgactgggtgcagggcagtggctcatgcccataatcccagtactttgggaggctgaggcaggagcattgcttgagcccaggacttcaagaccagcctgggtaacatagggagacgcccgtctctacaaatagtaaaaataaaaaataaaaaaagtagctgggcgtggtggtgtgcacctgtggtcccagctgcttgggatgctgaggtggaaggatctcttaaacccaggagggtggaggctgcagtgacttgcgattgcaccactgcactccagtctgggggacagagtgagaccccatctcaaaaaagtgtttaattaatatacttgtgagtggtctatttgcatttaaaactgctttctagaattaggatagctcccttaggtttaatgttttggtgagcaggaatatcagttacccctccagatcttaattctagttttttatcactttttcatgaggtgatctcatcctcatctcctagcatgtctggcaattttgatttctgaactctgtgctacctcagaggccagcttccttagggaaaaatcagtgctgaaataaagttatatttccttttctgctctaaatatatagtgggggaataagagaaatgaagaggaattcctgagaacgtaattactagaaactcccctctcccacgtaatgtctctcacacaccatggacccctattcccccaatttgcgaccccccaccccaccccacaacaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataagtgcttcgtccctttattgtatttggggtgaggttattttagggcatggtccagggtgaattcctataaggcctgggtgccctgcctgctgtgagatcaaaggggaatgggactaagactgcagagccctggctcccccactgcctgccaattgcctgcggtttgtggtctcttccactttctctggcctgggaagacgctggggtgtttatgatcccaaggctcctggtgggtggtgcgtgtattttcagtgccggagggtgctgtgggcactgggggaaacttaggcacctcctccaaggctctcttggtgcctcctcatctgttccttcagcttctggatcttgagcaccagggcttgggcctcccaggctccctcctgcccttcaaggagggcctggtacagctccagctgctgctccaacaactctt

SEQ ID NO: 312584 - DNA, 5276 bp, Homo sapiens
catcggccataacaacagaaatggccagtcagtcccaaggtatccagcagcttctgcaagctgagaagcgggcagctgagaaggtggcagatgccagaaagaggaaggcccggcgactgaagcaggcaaaggaggaggcacagatggaggtggagcaataccgcagagagcgagagcacgaattccagagcaagcagcaggcgacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttaggtaagctttggccttcgctacaatccgtttccatctgcgcttctccgcacccatcccgtcacatgggttcctgatacccttttcacaggcgatggtctggtcgctggggcctagttggttcgctatttccttagcttgcatccctttcgagagcaaagagctcctgggggaaggaagggaagctaaggggggacccaatccaagatggtgtcctcggcgccattgtgttcgttttgctcccttcttccaatgggttcttctcatattggaggcctcagcatcaatgagaggcggtgctcggcgtcccttggtcttggtatttgcggagggcggggctcttctcaccttccttgttctttcttgagctctttttcggccctcggtgggactgggaggaggagctggtttctgggcccagttggatttttctcaccttgacttgcccaacttaatttggagtgccttccaagtgtttacgatacgattggtgtcattgtatgtttctccaaaaggagtctcaccttcgtagcgtaacagtgatgtgagaccacttgctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagattaaatacccttctaccttctctccctccactccccgcccgctgcctcctccccttcctcgccctcttcctcagactcccttgtcattcaagtgccaagaaggcggcttgtgcccaactgggagtaatgactccttgaagagacatacagaagcagagacagctagtgttagggcctgcgcgggtgccagggaaactccggaagacttggtcgggttaatgtgagagcgggtagtgttcgactttttcataaatcacaacatttttgaacctcttctcccttcgggggagggcaggatttttctgccctaccacccacccatccatcgtctcttacatgcaccctacagccacgcaccctcaaggtggcatcgagcatacagctggagccttctgctcaccaaaactcctacttcccggtggcaggagagcaagagagggacagacagatggcagggcatgtccaaaagaagagcatcagcacaaatgaatcctccccttccccacctccaggggtgggggcctttggcacctcaatccccgataccctactccttcccacccacatctccttgcacccatctggaacctcggttgatgtgagccggcaacagagaagcaccgtggcgcggcgagggaatgcagacggcacccagcggtggatggcggcagcggaggccgcggggaaacctgaccaggaagctgaggaccaaaccagcctctttttccgttcccggtttttttcctgaacccaacgcgtgccgtgccccgtttcccccaatatgtgttggggaggggtgtcctgaatggggtggtagattttttttcttaaaaaaatttttttgttttttttaatactcagaggagagggacataggaaagccaatggagatcttcgtggatgatgagacgaagttgacgctgcatgggttgcagcagtactacgtgaaactgaaggacaacgagaagaaccggaagctctttgaccttctggatgtccttgagttcaaccaggtcagttagacgtccagtagggggatgagcattggagcactccagctgtagcagaaacctggatattaagtacacttttattgaggaaatcacatgtgtgatgtgggagagaataatgagggtataaatatcttaggggctgagcatgagtaaggtgggagctgcttttctattctatggctggcacgggtatgtcctcaataacctcaaggaaaataaacttcaaaaattaagatccttggccaggcacggtggcttatgtgtgtaatcccagcacttggggaggctgagggaggtggatcacttgagtccaggagtttgagaccagtctgggcaacatggcgaaacttcatcactaccaaagaagaaaaaaattagccaggtgtggtggtgtatgcctgtagtcccagatactctggtggctgaggtgagaggatagcttgagcccaggaaattgaggctgcagtgaactatgattgcactactgtgctccagcttgggcaacagagtgagatcttgtctccaaaagtccttgaaggattttaggaagttgttaaaagtcttgaaacgatgtttgggggcatgttagggttcttgaatgtttaattcctctaataactgcttattcaagagaagcatttctgactgggtgcagggcagtggctcatgcccataatcccagtactttgggaggctgaggcaggagcattgcttgagcccaggacttcaagaccagcctgggtaacatagggagacgcccgtctctacaaatagtaaaaataaaaaataaaaaaagtagctgggcgtggtggtgtgcacctgtggtcccagctgcttgggatgctgaggtggaaggatctcttaaacccaggagggtggaggctgcagtgacttgcgattgcaccactgcactccagtctgggggacagagtgagaccccatctcaaaaaagtgtttaattaatatacttgtgagtggtctatttgcatttaaaactgctttctagaattaggatagctcccttaggtttaatgttttggtgagcaggaatatcagttacccctccagatcttaattctagttttttatcactttttcatgaggtgatctcatcctcatctcctagcatgtctggcaattttgatttctgaactctgtgctacctcagaggccagcttccttagggaaaaatcagtgctgaaataaagttatatttccttttctgctctaaatatatagtgggggaataagagaaatgaagaggaattcctgagaacgtaattactagaaactcccctctcccacgtaatgtctctcacacaccatggacccctattcccccaatttgcgaccccccaccccaccccacaacaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataagtgcttcgtccctttattgtatttggggtgaggttattttagggcatggtccagggtgaattcctataaggcctgggtgccctgcctgctgtgagatcaaaggggaatgggactaagactgcagagccctggctcccccactgcctgccaattgcctgcggtttgtggtctcttccactttctctggcctgggaagacgctggggtgtttatgatcccaaggctcctggtgggtggtgcgtgtattttcagtgccggagggtgctgtgggcactgggggaaacttaggcacctcctccaaggctctcttggtgcctcctcatctgttccttcagcttctggatcttgagcaccagggcttgggcctcccaggctccctcctgcccttcaaggagggcctggtacagctccagctgctgctccaacaactctt

SEQ ID NO: 312585 - DNA, 4572 bp, Homo sapiens
catcggccataacaacagaaatggccagtcagtcccaaggtatccagcagcttctgcaagctgagaagcgggcagctgagaaggtggcagatgccagaaagaggaaggcccggcgactgaagcaggcaaaggaggaggcacagatggaggtggagcaataccgcagagagcgagagcacgaattccagagcaagcagcaggcgacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttaggtaagctttggccttcgctacaatccgtttccatctgcgcttctccgcacccatcccgtcacatgggttcctgatacccttttcacaggcgatggtctggtcgctggggcctagttggttcgctatttccttagcttgcatccctttcgagagcaaagagctcctgggggaaggaagggaagctaaggggggacccaatccaagatggtgtcctcggcgccattgtgttcgttttgctcccttcttccaatgggttcttctcatattggaggcctcagcatcaatgagaggcggtgctcggcgtcccttggtcttggtatttgcggagggcggggctcttctcaccttccttgttctttcttgagctctttttcggccctcggtgggactgggaggaggagctggtttctgggcccagttggatttttctcaccttgacttgcccaacttaatttggagtgccttccaagtgtttacgatacgattggtgtcattgtatgtttctccaaaaggagtctcaccttcgtagcgtaacagtgatgtgagaccacttggtaaagatcctgttaaagcctgggcggggattgcctttctctgtcacctattagctttcttattgtagggtggagacatgaattttgtttttttgtggccgagccatttgtcttgcaccgcccctcccccccatgctaattacacaaggcttgcttaaacagcggaagggaggatactgagaagtgggaggctgagagctatgggaggtggacggcggccatatgatgttttcttttcgaaaggtgagcgctttgcgcagtgatgaccctcatctatcacccttgactgatggctgctgagttaggcatccataacggtgggattataatagggaaagcggagtcttcctttgaggacttttcaggactctacttgtcatctccattttccactttactaagttattagtcatattttaccttttattatctattctatttcctcactgttactttcagatcaagaatttataagttggtcttccccttccaacttttctggtttccgctactgtgattgctaatcttgttgggaacctctgtcctaaccactttccctggtactgctttttctgttctgttatatttgcttttcgtttttatgttttgtatctgtttttctttccaggtaaaagtttcctggtttagggaaagtgggaactggggatggctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagattaaatacccttctaccttctctccctccactccccgcccgctgcctcctccccttcctcgccctcttcctcagactcccttgtcattcaagtgccaagaaggcggcttgtgcccaactgggagtaatgactccttgaagagacatacagaagcagagacagctagtgttagggcctgcgcgggtgccagggaaactccggaagacttggtcgggttaatgtgagagcgggtagtgttcgactttttcataaatcacaacatttttgaacctcttctcccttcgggggagggcaggatttttctgccctaccacccacccatccatcgtctcttacatgcaccctacagccacgcaccctcaaggtggcatcgagcatacagctggagccttctgctcaccaaaactcctacttcccggtggcaggagagcaagagagggacagacagatggcagggcatgtccaaaagaagagcatcagcacaaatgaatcctccccttccccacctccaggggtgggggcctttggcacctcaatccccgataccctactccttcccacccacatctccttgcacccatctggaacctcggttgatgtgagccggcaacagagaagcaccgtggcgcggcgagggaatgcagacggcacccagcggtggatggcggcagcggaggccgcggggaaacctgaccaggaagctgaggaccaaaccagcctctttttccgttcccggtttttttcctgaacccaacgcgtgccgtgccccgtttcccccaatatgtgttggggaggggtgtcctgaatggggtggtagattttttttcttaaaaaaatttttttgttttttttaatactcagaggagagggacataggaaagccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataagtgcttcgtccctttattgtatttggggtgaggttattttagggcatggtccagggtgaattcctataaggcctgggtgccctgcctgctgtgagatcaaaggggaatgggactaagactgcagagccctggctcccccactgcctgccaattgcctgcggtttgtggtctcttccactttctctggcctgggaagacgctggggtgtttatgatcccaaggctcctggtgggtggtgcgtgtattttcagtgccggagggtgctgtgggcactgggggaaacttaggcacctcctccaaggctctcttggtgcctcctcatctgttccttcagcttctggatcttgagcaccagggcttgggcctcccaggctccctcctgcccttcaaggagggcctggtacagctccagctgctgctccaacaactctt

SEQ ID NO: 312586 - DNA, 3329 bp, Homo sapiens
catcggccataacaacagaaatggccagtcagtcccaaggtatccagcagcttctgcaagctgagaagcgggcagctgagaaggtggcagatgccagaaagaggaaggcccggcgactgaagcaggcaaaggaggaggcacagatggaggtggagcaataccgcagagagcgagagcacgaattccagagcaagcagcaggcgacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttaggtaagctttggccttcgctacaatccgtttccatctgcgcttctccgcacccatcccgtcacatgggttcctgatacccttttcacaggcgatggtctggtcgctggggcctagttggttcgctatttccttagcttgcatccctttcgagagcaaagagctcctgggggaaggaagggaagctaaggggggacccaatccaagatggtgtcctcggcgccattgtgttcgttttgctcccttcttccaatgggttcttctcatattggaggcctcagcatcaatgagaggcggtgctcggcgtcccttggtcttggtatttgcggagggcggggctcttctcaccttccttgttctttcttgagctctttttcggccctcggtgggactgggaggaggagctggtttctgggcccagttggatttttctcaccttgacttgcccaacttaatttggagtgccttccaagtgtttacgatacgattggtgtcattgtatgtttctccaaaaggagtctcaccttcgtagcgtaacagtgatgtgagaccacttggtaaagatcctgttaaagcctgggcggggattgcctttctctgtcacctattagctttcttattgtagggtggagacatgaattttgtttttttgtggccgagccatttgtcttgcaccgcccctcccccccatgctaattacacaaggcttgcttaaacagcggaagggaggatactgagaagtgggaggctgagagctatgggaggtggacggcggccatatgatgttttcttttcgaaaggtgagcgctttgcgcagtgatgaccctcatctatcacccttgactgatggctgctgagttaggcatccataacggtgggattataatagggaaagcggagtcttcctttgaggacttttcaggactctacttgtcatctccattttccactttactaagttattagtcatattttaccttttattatctattctatttcctcactgttactttcagatcaagaatttataagttggtcttccccttccaacttttctggtttccgctactgtgattgctaatcttgttgggaacctctgtcctaaccactttccctggtactgctttttctgttctgttatatttgcttttcgtttttatgttttgtatctgtttttctttccaggtaaaagtttcctggtttagggaaagtgggaactggggatggctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggataaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataagtgcttcgtccctttattgtatttggggtgaggttattttagggcatggtccagggtgaattcctataaggcctgggtgccctgcctgctgtgagatcaaaggggaatgggactaagactgcagagccctggctcccccactgcctgccaattgcctgcggtttgtggtctcttccactttctctggcctgggaagacgctggggtgtttatgatcccaaggctcctggtgggtggtgcgtgtattttcagtgccggagggtgctgtgggcactgggggaaacttaggcacctcctccaaggctctcttggtgcctcctcatctgttccttcagcttctggatcttgagcaccagggcttgggcctcccaggctccctcctgcccttcaaggagggcctggtacagctccagctgctgctccaacaactctt

SEQ ID NO: 312587 - DNA, 4019 bp, Homo sapiens
catcggccataacaacagaaatggccagtcagtcccaaggtatccagcagcttctgcaagctgagaagcgggcagctgagaaggtggcagatgccagaaagaggaaggcccggcgactgaagcaggcaaaggaggaggcacagatggaggtggagcaataccgcagagagcgagagcacgaattccagagcaagcagcaggcgacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttaggtaagctttggccttcgctacaatccgtttccatctgcgcttctccgcacccatcccgtcacatgggttcctgatacccttttcacaggcgatggtctggtcgctggggcctagttggttcgctatttccttagcttgcatccctttcgagagcaaagagctcctgggggaaggaagggaagctaaggggggacccaatccaagatggtgtcctcggcgccattgtgttcgttttgctcccttcttccaatgggttcttctcatattggaggcctcagcatcaatgagaggcggtgctcggcgtcccttggtcttggtatttgcggagggcggggctcttctcaccttccttgttctttcttgagctctttttcggccctcggtgggactgggaggaggagctggtttctgggcccagttggatttttctcaccttgacttgcccaacttaatttggagtgccttccaagtgtttacgatacgattggtgtcattgtatgtttctccaaaaggagtctcaccttcgtagcgtaacagtgatgtgagaccacttggtaaagatcctgttaaagcctgggcggggattgcctttctctgtcacctattagctttcttattgtagggtggagacatgaattttgtttttttgtggccgagccatttgtcttgcaccgcccctcccccccatgctaattacacaaggcttgcttaaacagcggaagggaggatactgagaagtgggaggctgagagctatgggaggtggacggcggccatatgatgttttcttttcgaaaggtgagcgctttgcgcagtgatgaccctcatctatcacccttgactgatggctgctgagttaggcatccataacggtgggattataatagggaaagcggagtcttcctttgaggacttttcaggactctacttgtcatctccattttccactttactaagttattagtcatattttaccttttattatctattctatttcctcactgttactttcagatcaagaatttataagttggtcttccccttccaacttttctggtttccgctactgtgattgctaatcttgttgggaacctctgtcctaaccactttccctggtactgctttttctgttctgttatatttgcttttcgtttttatgttttgtatctgtttttctttccaggtaaaagtttcctggtttagggaaagtgggaactggggatggctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacagtgagtactgatctcatgaaaccctttaggtcctccctgttccttagtgtgtttgtcctaaatcccatcacataggtcatgggcatctgatgcataatggacacttgactggttcatgccccctggtctttgatgctgtgttgggatgtttttctgacctttatgtggggtttctgtcttctctcatcatattacatcccttccctcacccccacgtccgtcctctgaacccaggcagtacaccagtgtctgcatgtgtgccgtgtgttcctgcctcactttccccttttcatgccttattctgaccatgctacgttttcttctcagttgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataagtgcttcgtccctttattgtatttggggtgaggttattttagggcatggtccagggtgaattcctataaggcctgggtgccctgcctgctgtgagatcaaaggggaatgggactaagactgcagagccctggctcccccactgcctgccaattgcctgcggtttgtggtctcttccactttctctggcctgggaagacgctggggtgtttatgatcccaaggctcctggtgggtggtgcgtgtattttcagtgccggagggtgctgtgggcactgggggaaacttaggcacctcctccaaggctctcttggtgcctcctcatctgttccttcagcttctggatcttgagcaccagggcttgggcctcccaggctccctcctgcccttcaaggagggcctggtacagctccagctgctgctccaacaactctt

SEQ ID NO: 312588 - DNA, 3690 bp, Homo sapiens
  misc_feature (2729)..(2729): n is a, c, g, or t
  misc_feature (2737)..(2737): n is a, c, g, or t
  misc_feature (2742)..(2742): n is a, c, g, or t
  misc_feature (2753)..(2753): n is a, c, g, or t
  misc_feature (2755)..(2755): n is a, c, g, or t
  misc_feature (2759)..(2759): n is a, c, g, or t
  misc_feature (2772)..(2772): n is a, c, g, or t
  misc_feature (2775)..(2776): n is a, c, g, or t
  misc_feature (2778)..(2778): n is a, c, g, or t
  misc_feature (2782)..(2782): n is a, c, g, or t
  misc_feature (2804)..(2804): n is a, c, g, or t
  misc_feature (2813)..(2813): n is a, c, g, or t
  misc_feature (2817)..(2817): n is a, c, g, or t
  misc_feature (2821)..(2821): n is a, c, g, or t
  misc_feature (2830)..(2830): n is a, c, g, or t
  misc_feature (2833)..(2836): n is a, c, g, or t
  misc_feature (2840)..(2840): n is a, c, g, or t
  misc_feature (2843)..(2843): n is a, c, g, or t
  misc_feature (2854)..(2855): n is a, c, g, or t
  misc_feature (2861)..(2861): n is a, c, g, or t
  misc_feature (2867)..(2867): n is a, c, g, or t
  misc_feature (2874)..(2874): n is a, c, g, or t
  misc_feature (2885)..(2885): n is a, c, g, or t
  misc_feature (2887)..(2887): n is a, c, g, or t
  misc_feature (2903)..(2903): n is a, c, g, or t
  misc_feature (2933)..(2933): n is a, c, g, or t
  misc_feature (2936)..(2936): n is a, c, g, or t
  misc_feature (2938)..(2938): n is a, c, g, or t
  misc_feature (2960)..(2960): n is a, c, g, or t
  misc_feature (2964)..(2964): n is a, c, g, or t
  misc_feature (2968)..(2969): n is a, c, g, or t
  misc_feature (2975)..(2976): n is a, c, g, or t
  misc_feature (2982)..(2982): n is a, c, g, or t
  misc_feature (3007)..(3007): n is a, c, g, or t
  misc_feature (3020)..(3020): n is a, c, g, or t
catcggccataacaacagaaatggccagtcagtcccaaggtatccagcagcttctgcaagctgagaagcgggcagctgagaaggtggcagatgccagaaagaggaaggcccggcgactgaagcaggcaaaggaggaggcacagatggaggtggagcaataccgcagagagcgagagcacgaattccagagcaagcagcaggcgacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttaggtaagctttggccttcgctacaatccgtttccatctgcgcttctccgcacccatcccgtcacatgggttcctgatacccttttcacaggcgatggtctggtcgctggggcctagttggttcgctatttccttagcttgcatccctttcgagagcaaagagctcctgggggaaggaagggaagctaaggggggacccaatccaagatggtgtcctcggcgccattgtgttcgttttgctcccttcttccaatgggttcttctcatattggaggcctcagcatcaatgagaggcggtgctcggcgtcccttggtcttggtatttgcggagggcggggctcttctcaccttccttgttctttcttgagctctttttcggccctcggtgggactgggaggaggagctggtttctgggcccagttggatttttctcaccttgacttgcccaacttaatttggagtgccttccaagtgtttacgatacgattggtgtcattgtatgtttctccaaaaggagtctcaccttcgtagcgtaacagtgatgtgagaccacttggtaaagatcctgttaaagcctgggcggggattgcctttctctgtcacctattagctttcttattgtagggtggagacatgaattttgtttttttgtggccgagccatttgtcttgcaccgcccctcccccccatgctaattacacaaggcttgcttaaacagcggaagggaggatactgagaagtgggaggctgagagctatgggaggtggacggcggccatatgatgttttcttttcgaaaggtgagcgctttgcgcagtgatgaccctcatctatcacccttgactgatggctgctgagttaggcatccataacggtgggattataatagggaaagcggagtcttcctttgaggacttttcaggactctacttgtcatctccattttccactttactaagttattagtcatattttaccttttattatctattctatttcctcactgttactttcagatcaagaatttataagttggtcttccccttccaacttttctggtttccgctactgtgattgctaatcttgttgggaacctctgtcctaaccactttccctggtactgctttttctgttctgttatatttgcttttcgtttttatgttttgtatctgtttttctttccaggtaaaagtttcctggtttagggaaagtgggaactggggatggctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccaccccacccaccctcaatcccccaaaacnacaccctntctcnctatcaccacntnaaanattatcaacaacnaanncntctngccaccaacccatttcccccanccatccacncccncccncccaacatnccnnnnaacnatnacacccctgannaccccnacaccnacccccnccccccccccncnccacccccccttcccnccaagcccctcccaatcacattcctccccnatnanaataatcccaaaacccccaatnatgngcannaccccnntgaccncaatattactgagctccctgatganatacacacccccncctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataagtgcttcgtccctttattgtatttggggtgaggttattttagggcatggtccagggtgaattcctataaggcctgggtgccctgcctgctgtgagatcaaaggggaatgggactaagactgcagagccctggctcccccactgcctgccaattgcctgcggtttgtggtctcttccactttctctggcctgggaagacgctggggtgtttatgatcccaaggctcctggtgggtggtgcgtgtattttcagtgccggagggtgctgtgggcactgggggaaacttaggcacctcctccaaggctctcttggtgcctcctcatctgttccttcagcttctggatcttgagcaccagggcttgggcctcccaggctccctcctgcccttcaaggagggcctggtacagctccagctgctgctccaacaactctt

SEQ ID NO: 312589 - DNA, 2808 bp, Homo sapiens
catcggccataacaacagaaatggccagtcagtcccaaggtatccagcagcttctgcaagctgagaagcgggcagctgagaaggtggcagatgccagaaagaggaaggcccggcgactgaagcaggcaaaggaggaggcacagatggaggtggagcaataccgcagagagcgagagcacgaattccagagcaagcagcaggcgacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttaggtaagctttggccttcgctacaatccgtttccatctgcgcttctccgcacccatcccgtcacatgggttcctgatacccttttcacaggcgatggtctggtcgctggggcctagttggttcgctatttccttagcttgcatccctttcgagagcaaagagctcctgggggaaggaagggaagctaaggggggacccaatccaagatggtgtcctcggcgccattgtgttcgttttgctcccttcttccaatgggttcttctcatattggaggcctcagcatcaatgagaggcggtgctcggcgtcccttggtcttggtatttgcggagggcggggctcttctcaccttccttgttctttcttgagctctttttcggccctcggtgggactgggaggaggagctggtttctgggcccagttggatttttctcaccttgacttgcccaacttaatttggagtgccttccaagtgtttacgatacgattggtgtcattgtatgtttctccaaaaggagtctcaccttcgtagcgtaacagtgatgtgagaccacttggtaaagatcctgttaaagcctgggcggggattgcctttctctgtcacctattagctttcttattgtagggtggagacatgaattttgtttttttgtggccgagccatttgtcttgcaccgcccctcccccccatgctaattacacaaggcttgcttaaacagcggaagggaggatactgagaagtgggaggctgagagctatgggaggtggacggcggccatatgatgttttcttttcgaaaggtgagcgctttgcgcagtgatgaccctcatctatcacccttgactgatggctgctgagttaggcatccataacggtgggattataatagggaaagcggagtcttcctttgaggacttttcaggactctacttgtcatctccattttccactttactaagttattagtcatattttaccttttattatctattctatttcctcactgttactttcagatcaagaatttataagttggtcttccccttccaacttttctggtttccgctactgtgattgctaatcttgttgggaacctctgtcctaaccactttccctggtactgctttttctgttctgttatatttgcttttcgtttttatgttttgtatctgtttttctttccaggtaaaagtttcctggtttagggaaagtgggaactggggatggctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatttgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataagtgcttcgtccctttattgtatttggggtgaggttattttagggcatggtccagggtgaattcctataaggcctgggtgccctgcctgctgtgagatcaaaggggaatgggactaagactgcagagccctggctcccccactgcctgccaattgcctgcggtttgtggtctcttccactttctctggcctgggaagacgctggggtgtttatgatcccaaggctcctggtgggtggtgcgtgtattttcagtgccggagggtgctgtgggcactgggggaaacttaggcacctcctccaaggctctcttggtgcctcctcatctgttccttcagcttctggatcttgagcaccagggcttgggcctcccaggctccctcctgcccttcaaggagggcctggtacagctccagctgctgctccaacaactctt

SEQ ID NO: 312590 - DNA, 2692 bp, Homo sapiens
catcggccataacaacagaaatggccagtcagtcccaaggtatccagcagcttctgcaagctgagaagcgggcagctgagaaggtggcagatgccagaaagaggaaggcccggcgactgaagcaggcaaaggaggaggcacagatggaggtggagcaataccgcagagagcgagagcacgaattccagagcaagcagcaggcgacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttaggtaagctttggccttcgctacaatccgtttccatctgcgcttctccgcacccatcccgtcacatgggttcctgatacccttttcacaggcgatggtctggtcgctggggcctagttggttcgctatttccttagcttgcatccctttcgagagcaaagagctcctgggggaaggaagggaagctaaggggggacccaatccaagatggtgtcctcggcgccattgtgttcgttttgctcccttcttccaatgggttcttctcatattggaggcctcagcatcaatgagaggcggtgctcggcgtcccttggtcttggtatttgcggagggcggggctcttctcaccttccttgttctttcttgagctctttttcggccctcggtgggactgggaggaggagctggtttctgggcccagttggatttttctcaccttgacttgcccaacttaatttggagtgccttccaagtgtttacgatacgattggtgtcattgtatgtttctccaaaaggagtctcaccttcgtagcgtaacagtgatgtgagaccacttggtaaagatcctgttaaagcctgggcggggattgcctttctctgtcacctattagctttcttattgtagggtggagacatgaattttgtttttttgtggccgagccatttgtcttgcaccgcccctcccccccatgctaattacacaaggcttgcttaaacagcggaagggaggatactgagaagtgggaggctgagagctatgggaggtggacggcggccatatgatgttttcttttcgaaaggtgagcgctttgcgcagtgatgaccctcatctatcacccttgactgatggctgctgagttaggcatccataacggtgggattataatagggaaagcggagtcttcctttgaggacttttcaggactctacttgtcatctccattttccactttactaagttattagtcatattttaccttttattatctattctatttcctcactgttactttcagatcaagaatttataagttggtcttccccttccaacttttctggtttccgctactgtgattgctaatcttgttgggaacctctgtcctaaccactttccctggtactgctttttctgttctgttatatttgcttttcgtttttatgttttgtatctgtttttctttccaggtaaaagtttcctggtttagggaaagtgggaactggggatggctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaagtgctgtaataagcgggtctggtctatcaagaacgcgatgaacgagggtgcctgcagaaagaacggcaccagaatatcaggacgatgagaggactccaagggccgaaaatccgtcagccctcggagctcggaaacaagaagccgtcaagccgcgaaaaacaataagacacggtaagcggcctgacctgtgccaccggacggctgaaccagcgctggaccagtgggatgaggggatgtgcaccaagggaacgatcaagagcgacaagagaacgacgcccgacagaagggaaaggcgggggcacggaaagtgtacaagatgcaaaacgcgcggcaagcaaaggaagcaggcggtcaaggacggcagagcacgagatcactggcaagggaccgcaaatgagaggacactctccggggcagtcacgggagaagcgaagacggcgagccagcacacggggcggcgaagacagagaagaggcaggcacagcgagagacacacgaagaga

SEQ ID NO: 312591 - DNA, 1194 bp, Homo sapiens
ataaatggggaggggagagcccactgggtagaaggaacagggagcggccaggatgctgaatctgctgctgctggcgctgcccgtcctggcgagccgcgcctacgcggcccctgccccaggccaggccctgcagcgagtgggcatcgttgggggtcaggaggcccccaggagcaagtggccctggcaggtgagcctgagagtccacggcccatactggatgcacttctgcgggggctccctcatccacccccagtgggtgctgaccgcagcgcactgcgtgggaccggacgtcaaggatctggccgccctcagggtgcaactgcgggagcagcacctctactaccaggaccagctgctgccggtcagcaggatcatcgtgcacccacagttctacaccgcccagatcggagcggacatcgccctgctggagctggaggagccggtgaacgtctccagccacgtccacacggtcaccctgccccctgcctcagagaccttccccccggggatgccgtgctgggtcactggctggggcgatgtggacaatgatgagcgcctcccaccgccatttcctctgaagcaggtgaaggtccccataatggaaaaccacatttgtgacgcaaaataccaccttggcgcctacacgggagacgacgtccgcatcgtccgtgacgacatgctgtgtgccgggaacacccggagggactcatgccagggcgactccggagggcccctggtgtgcaaggtgaatggcacctggctgcaggcgggcgtggtcagctggggcgagggctgtgcccagcccaaccggcctggcatctacacccgtgtcacctactacttggactggatccaccactatgtccccaaaaagccgtgagtcaggcctggggtgtccacctgggtcactggaggaccaacccctgctgtccaaaacaccactgcttcctacccaggtggcgactgccccccacaccttccctgccccgtcctgagtgccccttcctgtcctaagccccctgctctcttctgagccccttcccctgtcctgaggacccttccccatcctgagcccccttccctgtcctaagcctgacgcctgcactgggccctccggccctcccctgcccaggcagctggtggtgggcgctaatcctcctgagtgctggacctcattaaagtgcatggaaatca

SEQ ID NO: 312592 - DNA, 1321 bp, Homo sapiens
ataaatggggaggggagagcccactgggtagaaggaacagggagcggccaggatgctgaatctgctgctgctggcgctgcccgtcctggcgagccgcgcctacgcggcccctgccccaggccaggccctgcagcgagtgggcatcgttgggggtcaggaggcccccaggagcaagtggccctggcaggtgagcctgagagtccacggcccatactggatgcacttctgcgggggctccctcatccacccccagtgggtgctgaccgcagcgcactgcgtgggaccggacgtcaaggatctggccgccctcagggtgcaactgcgggagcagcacctctactaccaggaccagctgctgccggtcagcaggatcatcgtgcacccacagttctacaccgcccagatcggagcggacatcgccctgctggagctggaggagccggtgaacgtctccagccacgtccacacggtcaccctgccccctgcctcagagaccttccccccggggatgccgtgctgggtcactggctggggcgatgtggacaatgatggtgggtctggggacagtggaggtggggccagggtcttagccacagcccagcccctgggctccctctgggctccaggtgggggttgcccggccccctcctgaggctgcaccctcttccccacctgcagagcgcctcccaccgccatttcctctgaagcaggtgaaggtccccataatggaaaaccacatttgtgacgcaaaataccaccttggcgcctacacgggagacgacgtccgcatcgtccgtgacgacatgctgtgtgccgggaacacccggagggactcatgccagggcgactccggagggcccctggtgtgcaaggtgaatggcacctggctgcaggcgggcgtggtcagctggggcgagggctgtgcccagcccaaccggcctggcatctacacccgtgtcacctactacttggactggatccaccactatgtccccaaaaagccgtgagtcaggcctggggtgtccacctgggtcactggaggaccaacccctgctgtccaaaacaccactgcttcctacccaggtggcgactgccccccacaccttccctgccccgtcctgagtgccccttcctgtcctaagccccctgctctcttctgagccccttcccctgtcctgaggacccttccccatcctgagcccccttccctgtcctaagcctgacgcctgcactgggccctccggccctcccctgcccaggcagctggtggtgggcgctaatcctcctgagtgctggacctcattaaagtgcatggaaatca

SEQ ID NO: 312593 - DNA, 1243 bp, Homo sapiens
ataaatggggaggggagagcccactgggtagaaggaacagggagcggccaggatgctgaatctgctgctgctggcgctgcccgtcctggcgagccgcgcctacgcggcccctgccccaggccaggccctgcagcgagtgggcatcgttgggggtcaggaggcccccaggagcaagtggccctggcaggtgagcctgagagtccacggcccatactggatgcacttctgcgggggctccctcatccacccccagtgggtgctgaccgcagcgcactgcgtgggaccggacgtcaaggatctggccgccctcagggtgcaactgcgggagcagcacctctactaccaggaccagctgctgccggtcagcaggatcatcgtgcacccacagttctacaccgcccagatcggagcggacatcgccctgctggagctggaggagccggtgaacgtctccagccacgtccacacggtcaccctgccccctgcctcagagaccttccccccggggatgccgtgctgggtcactggctggggcgatgtggacaatgatgagcgcctcccaccgccatttcctctgaagcaggtgaaggtccccataatggaaaaccacatttgtgacgcaaaataccaccttggcgcctacacgggagacgacgtccgcatcgtccgtgacgacatgctgtgtgccgggaacacccggagggactcatgccagggcgactccggagggcccctggtgtgcaaggtgaatggcacctggctgcaggcgggcgtggtcagctggggcgagggctgtgcccagcccaaccggcctggcatctacacccgtgtcacctactacttggactggatccaccactatgtccccaaaaagccgtgagtcaggcctggggtgtccacctgggtcactggaggaccaacccctgctgtccaaaacaccactgcttcctacccaggtggcgactgccccccacaccttccctgccccgtcctgagtgccccttcctgtcctaagccccctgctctcttctgagccccttcccctgtcctgaggacccttccccatcctgagcccccttccctgtcctaagcctgacgcctgcactgggccctccggccctcccctgcccaggcagctggtggtgggcgctaatcctcctgagtgctggacctcattaaagtgcatggaaatcaaaaaaaaaaagtcgacgcggccgcgaatttagtagtagtaggcggccgc

SEQ ID NO: 312594 - DNA, 778 bp, Homo sapiens
  misc_feature (741)..(742): n is a, c, g, or t
  misc_feature (745)..(745): n is a, c, g, or t
cagagtggcccagcctcagactcagagcaccaagacccaggcccgcaggcctggacccaccccggtccccccgtcccagctccattcttcaccccacaatctgtagcccccagccctgccctgtgaggcccggccaggcccacgatgctcctccttgctccccagatgctgaatctgctgctgctggcgctgcccgtcctggcgagccgcgcctacgcggcccctgccccaggccaggccctgcagcgagtgggcatcgttgggggtcaggaggcccccaggagcaagtggccctggcaggtgagcctgagagtccgcgaccgatactggatgcacttctgcgggggctccctcatccacccccagtgggtgctgaccgcagcgcactgcgtgggaccggacgtcaaggatctggccgccctcagggtgcaactgcgggagcagcacctctactaccaggaccagctgctgccggtcagcaggatcatcgtgcacccacagttctacaccgcccagatcggagcggacatcgccctgctggagctggaggagccggtgaacgtctccagccacgtccacacggtcaccctgccccctgcctcagagaccttccccccggggatgccgtgctgggtcactggctggggcgatgtggacaatgatgagcgcctcccaccgccatttcctctgaagcaggtgaaggtccccataatggaaaacaacatttgtgacgcagaacgnnacntaatggggatcttagagtcgaccagcagaatgc

SEQ ID NO: 312595 - DNA, 1194 bp, Homo sapiens
ataaatggggaggggagagcccactgggtagaaggaacagggagcggccaggatgctgaatctgctgctgctggcgctgcccgtcctggcgagccgcgcctacgcggcccctgccccaggccaggccctgcagcgagtgggcatcgttgggggtcaggaggcccccaggagcaagtggccctggcaggtgagcctgagagtccacggcccatactggatgcacttctgcgggggctccctcatccacccccagtgggtgctgaccgcagcgcactgcgtgggaccggacgtcaaggatctggccgccctcagggtgcaactgcgggagcagcacctctactaccaggaccagctgctgccggtcagcaggatcatcgtgcacccacagttctacaccgcccagatcggagcggacatcgccctgctggagctggaggagccggtgaacgtctccagccacgtccacacggtcaccctgccccctgcctcagagaccttccccccggggatgccgtgctgggtcactggctggggcgatgtggacaatgatgagcgcctcccaccgccatttcctctgaagcaggtgaaggtccccataatggaaaaccacatttgtgacgcaaaataccaccttggcgcctacacgggagacgacgtccgcatcgtccgtgacgacatgctgtgtgccgggaacacccggagggactcatgccagggcgactccggagggcccctggtgtgcaaggtgaatggcacctggctgcaggcgggcgtggtcagctggggcgagggctgtgcccagcccaaccggcctggcatctacacccgtgtcacctactacttggactggatccaccactatgtccccaaaaagccgtgagtcaggcctgggttggccacctgggtcactggaggaccaacccctgctgtccaaaacaccactgcttcctacccaggtggcgactgccccccacaccttccctgccccgtcctgagtgccccttcctgtcctaagccccctgctctcttctgagccccttcccctgtcctgaggacccttccccatcctgagcccccttccctgtcctaagcctgacgcctgcaccgggccctccggccctcccctgcccaggcagctggtggtgggcgctaatcctcctgagtgctggacctcattaaagtgcatggaaatca

SEQ ID NO: 312596 - DNA, 1167 bp, Homo sapiens
ataaatggggaggggagagcccactgggtagaaggaacagggagcggccaggatgctgaatctgctgctgctggcgctgcccgtcctggcgagccgcgcctacgcggcccctgccccaggccaggccctgcagcgagtgggcatcgttgggggtcaggaggcccccaggagcaagtggccctggcaggtgagcctgagagtccacggcccatactggatgcacttctgcgggggctccctcatccacccccagtgggtgctgaccgcagcgcactgcgtgggaccggtgcaactgcgggagcagcacctctactaccaggaccagctgctgccggtcagcaggatcatcgtgcacccacagttctacaccgcccagatcggagcggacatcgccctgctggagctggaggagccggtgaacgtctccagccacgtccacacggtcaccctgccccctgcctcagagaccttccccccggggatgccgtgctgggtcactggctggggcgatgtggacaatgatgagcgcctcccaccgccatttcctctgaagcaggtgaaggtccccataatggaaaaccacatttgtgacgcaaaataccaccttggcgcctacacgggagacgacgtccgcatcgtccgtgacgacatgctgtgtgccgggaacacccggagggactcatgccagggcgactccggagggcccctggtgtgcaaggtgaatggcacctggctgcaggcgggcgtggtcagctggggcgagggctgtgcccagcccaaccggcctggcatctacacccgtgtcacctactacttggactggatccaccactatgtccccaaaaagccgtgagtcaggcctggggtgtccacctgggtcactggaggaccaacccctgctgtccaaaacaccactgcttcctacccaggtggcgactgccccccacaccttccctgccccgtcctgagtgccccttcctgtcctaagccccctgctctcttctgagccccttcccctgtcctgaggacccttccccatcctgagcccccttccctgtcctaagcctgacgcctgcactgggccctccggccctcccctgcccaggcagctggtggtgggcgctaatcctcctgagtgctggacctcattaaagtgcatggaaatca

SEQ ID NO: 312597 - DNA, 1167 bp, Homo sapiens
ataaatggggaggggagagcccactgggtagaaggaacagggagcggccaggatgctgaatctgctgctgctggcgctgcccgtcctggcgagccgcgcctacgcggcccctgccccaggccaggccctgcagcgagtgggcatcgttgggggtcaggaggcccccaggagcaagtggccctggcaggtgagcctgagagtccacggcccatactggatgcacttctgcgggggctccctcatccacccccagtgggtgctgaccgcagcgcactgcgtgggaccggtgcaactgcgggagcagcacctctactaccaggaccagctgctgccggtcagcaggatcatcgtgcacccacagttctacaccgcccagatcggagcggacatcgccctgctggagctggaggagccggtgaacgtctccagccacgtccacacggtcaccctgccccctgcctcagagaccttccccccggggatgccgtgctgggtcactggctggggcgatgtggacaatgatgagcgcctcccaccgccatttcctctgaagcaggtgaaggtccccataatggaaaaccacatttgtgacgcaaaataccaccttggcgcctacacgggagacgacgtccgcatcgtccgtgacgacatgctgtgtgccgggaacacccggagggactcatgccagggcgactccggagggcccctggtgtgcaaggtgaatggcacctggctgcaggcgggcgtggtcagctggggcgagggctgtgcccagcccaaccggcctggcatctacacccgtgtcacctactacttggactggatccaccactatgtccccaaaaagccgtgagtcaggcctgggttggccacctgggtcactggaggaccaacccctgctgtccaaaacaccactgcttcctacccaggtggcgactgccccccacaccttccctgccccgtcctgagtgccccttcctgtcctaagccccctgctctcttctgagccccttcccctgtcctgaggacccttccccatcctgagcccccttccctgtcctaagcctgacgcctgcaccgggccctccggccctcccctgcccaggcagctggtggtgggcgctaatcctcctgagtgctggacctcattaaagtgcatggaaatca

SEQ ID NO: 312598 - DNA, 2268 bp, Homo sapiens
aggccgggccggagcggggcgaagggggccgagcggcgggccgggccgggccgggcagggccggggcgtgggccggcaggaagatggcgaacgtggggctgcagttccaggcgagcgcgggggactcggacccacagagccggcccctgctgctgctcgggcagctgcaccacctgcaccgcgtgccctggagccacgtccgcgggaagctgcagccccgggtcaccgaggagctctggcaggctgccctgagcacgctcaaccccaaccccacggacagctgtcccctctacctgaactacgccaccgtggctgccctgccctgcagggtgagccggcacaacagcccctcggccgcccacttcatcacgcggctggtgcggacctgcctgccgcccggagcgcatcgctgcattgtgatggtctgcgagcagccggaggtctttgcttccgcctgtgccctggcccgggccttcccgctgttcacccaccgctcaggtgcctctcggcgcttggagaagaagacggtcaccgtggagtttttcctggtgggacaagacaacgggccggtggaggtgtccacattgcagtgcttagcgaatgccacagacggcgtgcggctagcagcccgcatcgtggacacaccctgcaatgagatgaacaccgacaccttcctcgaggagattaacaaagttggaaaggagctggggatcatcccaaccatcatccgggatgaggaactgaagacgagaggatttggaggaatctatggggttggcaaagccgccctgcatcccccagccctggccgtcctcagccacaccccagatggagccacgcagaccatcgcctgggtgggcaaaggcatcgtctatgacactggaggcctcagcatcaaagggaagactaccatgccggggatgaagcgagactgcgggggtgctgcggccgtcctgggggccttcagagccgcaatcaagcagggtttcaaagacaacctccacgctgtgttctgcttggctgagaactcggtggggcccaatgcgacaaggccagatgacatccacctgctgtactcagggaagacggtggaaatcaacaacacggatgccgagggcaggctggtgctggcagatggcgtgtcctatgcttgcaaggacctgggggccgacatcatcctggacatggccaccctgaccggggctcagggcattgccacagggaagtaccacgccgcggtgctcaccaacagcgctgagtgggaggccgcctgtgtgaaggcgggcaggaagtgtggggacctggtgcacccgctggtctactgccccgagctgcacttcagcgagttcacctcagctgtggcggacatgaagaactcagtggcggaccgagacaacagccccagctcctgtgctggcctcttcatcgcctcacacatcggcttcgactggcccggagtctgggtccacctggacattgctgcaccggtgcatgctggtgagcgagccacaggcttcggtgtggccctcctgctggcgctcttcggccgtgcctctgaggaccctctgctgaacctggtgtccccactgggctgtgaggtggatgtcgaggagggggacctggggagggactccaagagacgcaggcttgtgtgagcctcctgcctcggccctgacaaacggggatcttttacctcactttgcactgattaattttaagcaattgaaagattgcccttcatatgggttttggtttgtctttctggtcgtcagcgtggtggtggaaacagctgaagttttaggagacagcttagggtttggtgcgggccacggggaggggaccgggaagcgctggggcttgtttctgtttgttacttacaggactgagacatcttctgtaaactgctacccctggggccttctgcaccccggggtgaggcctcctgcctgcctggtgccctgtcccagccccaggtcccgtgcagggcacctgcgtggctgacagccaggctcttactccagccggggctgccagcgcatccagccagcccagccctgtgaaagatggagctgacttgctgcaggggacctgatttatagggcaagagaagtcacactctggcctctcagaattcacttgaggttcaattaaatacagtcacaccgcaaaaaaaaaaaatttccgggtggatcggcaaaggcgaccttgggggggcggcaccttgtccttagaggtaatcgaccggaaatgccacgccggggaagtccc

SEQ ID NO: 312599 - DNA, 2485 bp, Homo sapiens
aagggctcagccgccaggccagtcctcgcccgcggaggcccagccccaggccccgtcgccggtgcggcgcggtggtcctcctgtcagcccagccctgcgccccgcgaggccgcgacacctgcggacggcggggggggagacgtggccgctcccagggccgcgcgtcggccccgcctggcgacaggccctggcttccagaagttcccatggcagtgtccccagctgcctttccttggggacacctggcccctgccccctctctggtggaagccgcctaagccctatccgagtgttggaagcaaagcagcccccagcctggcccttccaggcttggtggcttcatcccaccagggggatgcgagccagcctagagacagttagctctgcagagaggcgacacatctccctaaggatgggaaaacggtggccgggagctgcgcagtgcccttccaggactgcaggagtggttgtggccgtggctgcagggcagggcctcctggcacgtggccgctgtttgaagcctctgtgtcttgtctctcccttctgatctagctctggcaggctgccctgagcacgctcaaccccaaccccacggacagctgtcccctctacctgaactacgccaccgtggctgccctgccctgcagggtgagccggcacaacagcccctcggccgcccacttcatcacgcggctggtgcggacctgcctgccgcccggagcgcatcgctgcattgtgatggtctgcgagcagccggaggtctttgcttccgcctgtgccctggcccgggccttcccgctgttcacccaccgctcaggtgcctctcggcgcttggagaagaagacggtcaccgtggagtttttcctggtgggacaagacaacgggccggtggaggtgtccacattgcagtgcttagcgaatgccacagacggcgtgcggctagcagcccgcatcgtggacacaccctgcaatgagatgaacaccgacaccttcctcgaggagattaacaaagttggaaaggagctggggatcatcccaaccatcatccgggatgaggaactgaagacgagaggatttggaggaatctatggggttggcaaagccgccctgcatcccccagccctggccgtcctcagccacaccccagatggagccacgcagaccatcgcctgggtgggcaaaggcatcgtctatgacactggaggcctcagcatcaaagggaagactaccatgccggggatgaagcgagactgcgggggtgctgcggccgtcctgggggccttcagagccgcaatcaagcagggtttcaaagacaacctccacgctgtgttctgcttggctgagaactcggtggggcccaatgcgacaaggccagatgacatccacctgctgtactcagggaagacggtggaaatcaacaacacggatgccgagggcaggctggtgctggcagatggcgtgtcctatgcttgcaaggacctgggggccgacatcatcctggacatggccaccctgaccggggctcagggcattgccacagggaagtaccacgccgcggtgctcaccaacagcgctgagtgggaggccgcctgtgtgaaggcgggcaggaagtgtggggacctggtgcacccgctggtctactgccccgagctgcacttcagcgagttcacctcagctgtggcggacatgaagaactcagtggcggaccgagacaacagccccagctcctgtgctggcctcttcatcgcctcacacatcggcttcgactggcccggagtctgggtccacctggacattgctgcaccggtgcatgctggtgagcgagccacaggcttcggtgtggccctcctgctggcgctcttcggccgtgcctctgaggaccctctgctgaacctggtgtccccactgggctgtgaggtggatgtcgaggagggggacctggggagggactccaagagacgcaggcttgtgtgagcctcctgcctcggccctgacaaacggggatcttttacctcactttgcactgattaattttaagcaattgaaagattgcccttcatatgggttttggtttgtctttctggtcgtcagcgtggtggtggaaacagctgaagttttaggagacagcttagggtttggtgcgggccacggggaggggaccgggaagcgctggggcttgtttctgtttgttacttacaggactgagacatcttctgtaaactgctacccctggggccttctgcaccccggggtgaggcctcctgcctgcctggtgccctgtcccagccccaggtcccgtgcagggcacctgcgtggctgacagccaggctcttactccagccggggctgccagcgcatccagccagcccagccctgtgaaagatggagctgacttgctgcaggggacctgatttatagggcaagagaagtcacactctggcctctcagaattcacttgaggttcaattaaatacagtcacaccgc

SEQ ID NO: 312600 - DNA, 3097 bp, Homo sapiens
aggccgggccggagcggggcgaagggggccgagcggcgggccgggccgggccgggcagggccggggcgtgggccggcaggaagatggcgaacgtggggctgcagttccaggcgagcgcgggggactcggacccacagagccggcccctgctgctgctcgggcagctgcaccacctgcaccgcgtgccctggagccacgtccgcgggaagctgcagccccgggtcaccgaggagctctggcaggctgccctgagcacgctcaaccccaaccccacggacagctgtcccctctacctgaactacgccaccgtggctgccctgccctgcagggtgagccggcacaacagcccctcggccgcccacttcatcacgcggctggtgcggacctgcctgccgcccggagcgcatcgctgcattgtgatggtctgcgagcagccggaggtctttgcttccgcctgtgccctggcccgggccttcccgctgttcacccaccgctcaggtgcctctcggcgcttggagaagaagacggtcaccgtggagtttttcctggtgggacaagacaacgggccggtggaggtgtccacattgcagtgcttagcgaatgccacagacggcgtgcggctagcagcccgcatcgtggacacaccctgcaatgagatgaacaccgacaccttcctcgaggagattaacaaagttggaaaggagctggggatcatcccaaccatcatccgggatgaggaactgaagacgagaggatttggaggaatctatggggttggcaaagccgccctgcatcccccagccctggccgtcctcagccacaccccagatggagccacgcagaccatcgcctgggtgggcaaaggcatcgtctatgacactggaggcctcagcatcaaagggaagtgaaggaacgcaggttccgcgtcttcgttttgaccatcccgcactctcgtgttttattttgggtcctctgtttcgacaccgggaggtaggaaatcatgggccctggaggccccgactgtgcccagagccagcccacaggatctgactgtcagagcgattctcagaaggaatgtgggtagtagattttgtgtcgggtcattgctaacgtccatgtaatgttactttcaggataagtaacaacgatatgcgaatttgaagcttttgtttgtgtgattaaaacgcaaccgtagccacagcaattttttaaacttcaatcaacaacagattttcggaggaggaatatgttattgctgactttgttcagagataccggcacacggtggtaataagcaaactgacttctagtcggttatgattcctaaattcgccacagatagtgcaccccctactgcctgcacctggtactggctgctcccaccctcgcacgcaccctcaatacccacggtcaccctggaagccgctacattctggctggtagagtcgtggaccctcttctccttggatcagatgcttgtttttgatgtcggcttgttgtggaccaatgtgagaagatgagcttcctgggaattcattcgtttgcttgtggcactaactctagtcacttagggaaaatatcgttgcacctgacttcatctcatgtggctgtgggtagacctgtgcagttagtcagctcccggcctggaaattaacacaaaggaaaaacctgaccacacaggccttccctagaggccacagctgcacagccttcagggaagctgtggtctgagggtggctggtagaactgccagagagtagggcattttccatggctccagatcaccttctgaaaatgcgactatagcccctgcctattcccggggtccacctggtctgcagaccccataataccaggaagagctgggtgttctggcaccagtgaaacaatacctggttttttattttaaaccagcccatcttccccgctgcagttggaaccgttctacgtggatttgggatcaaccagcaggcctttcctgagctgttactgtgtggagtgggcgctgaggctccagccattgatgcaaagaccccaatcctgacctgaaggcgctcacaatctctccccaacggcctggtgtgaaacgcagacgcaacgcagcaggcattctccccagtggctgcctgtagagcaaatggtgcagaaatggtcactcctcaaaaagcaagccggctggagccagcccagctcccagttttgcaagaaaaaaaaaatcacagctccattttcaaagatttcaagggcagctcaagaccagcctggactagcaggcctcaaatgcattactggagacccctttacgctcttaacaagtaccgaccccaaagaggctttttgtataacaatgtctattgatatttactctactggaaattaaaagtgagaaatttataacatgtataattcattaaaaataacatataaatccattgcatgttatcataaataattttatgaagataagcatcttccaaaatgaaaaaataatttactgagagagtagcattgttgtacattttcacaaatcctgtcagtgtctggcttaatagaagacagctagggaccttgcgtctgcttccgatgtagtctatggaaatgtgttgtttcagttgaactgtatcaagaaaatctggcctcacgcattttatagttgaaacagggaaaaggattttagtacctttttcagctaactaactatgaacattctttgctactacaccaaaactcaacaagtggtagcttcttaaaggctggttataacatggaatctgaagcctcatgaatagacttttgggctctgtggcagttaaatccgctgttctctctcactttgaacatgtggtttttcatggaaaaatgaatgttcacttgaaaaatgttggttcacagagttctgcagaaattcaaatttttgacacattacattatatagtatcaaaaaatcacttaatatcaccatccatctcatcagaaaactcattatgaggaagttgtcatggtgataggagaaagtttttcaaaattctgatttttgcttaaaagctcaaatgtataccattggcaataaataatgtcagctgtttctggaaaaaaa

SEQ ID NO: 312601 - DNA, 2227 bp, Homo sapiens
tggccaggaagccggacagttgagttagaaaacatttctctttgaggtttctgaactgctgtttcttctctgccagctgggggcgcaatttctcattgatttctagaatgttcatctctgccttctcgctggacaaagggccggctgataccaccatgctgacgtttgtggcagaagaggtggggccagggactgggagaatgtttagagcatcctgacattcatcatgagaggattctctgtctacaaccagagttgagttgacttcgtcttcctcaaatgtgaatttgaagcttttgtttgtgtgattaaaacgcaaccgtagccacagcaattttttaaacttcaatcaacaacagattttcggaggaggaatatgttattgctgactttgttcagagataccggcacacggtggtaataagcaaactgacttctagtcggttatgattcctaaattcgccacagatagtgcaccccctactgcctgcacctggtactggctgctcccaccctcgcacgcaccctcaatacccacggtcaccctggaagccgctacattctggctggtagagtcgtggaccctcttctccttggatcagatgcttgtttttgatgtcggcttgttgtggaccaatgtgagaagatgagcttcctgggaattcattcgtttgcttgtggcactaactctagtcacttagggaaaatatcgttgcacctgacttcatctcatgtggctgtgggtagacctgtgcagttagtcagctcccggcctggaaattaacacaaaggaaaaacctgaccacacaggccttccctagaggccacagctgcacagccttcagggaagctgtggtctgagggtggctggtagaactgccagagagtagggcattttccatggctccagatcaccttctgaaaatgcgactatagcccctgcctattcccggggtccacctggtctgcagaccccataataccaggaagagctgggtgttctggcaccagtgaaacaatacctggttttttattttaaaccagcccatcttccccgctgcagttggaaccgttctacgtggatttgggatcaaccagcaggcctttcctgagctgttactgtgtggagtgggcgctgaggctccagccattgatgcaaagaccccaatcctgacctgaaggcgctcacaatctctccccaacggcctggtgtgaaacgcagacgcaacgcagcaggcattctccccagtggctgcctgtagagcaaatggtgcagaaatggtcactcctcaaaaagcaagccggctggagccagcccagctcccagttttgcaagaaaaaaaaaatcacagctccattttcaaagatttcaagggcagctcaagaccagcctggactagcaggcctcaaatgcattactggagacccctttacgctcttaacaagtaccgaccccaaagaggctttttgtataacaatgtctattgatatttactctactggaaattaaaagtgagaaatttataacatgtataattcattaaaaataacatataaatccattgcatgttatcataaataattttatgaagataagcatcttccaaaatgaaaaaataatttactgagagagtagcattgttgtacattttcacaaatcctgtcagtgtctggcttaatagaagacagctagggaccttgcgtctgcttccgatgtagtctatggaaatgtgttgtttcagttgaactgtatcaagaaaatctggcctcacgcattttatagttgaaacagggaaaaggattttagtacctttttcagctaactaactatgaacattctttgctactacaccaaaactcaacaagtggtagcttcttaaaggctggttataacatggaatctgaagcctcatgaatagacttttgggctctgtggcagttaaatccgctgttctctctcactttgaacatgtggtttttcatggaaaaatgaatgttcacttgaaaaatgttggttcacagagttctgcagaaattcaaatttttgacacattacattatatagtatcaaaaaatcacttaatatcaccatccatctcatcagaaaactcattatgaggaagttgtcatggtgataggagaaagtttttcaaaattctgatttttgcttaaaagctcaaatgtataccattggcaataaataatgtcagctgtttctggaaaaaaa

SEQ ID NO: 312602 - DNA, 1042 bp, Homo sapiens
gtctgcctcccggtccctcttttgccttgggtgtttctctcctgccgtcccgtccacacgcttcccgggttcctgcccgcccagggcattgccacagggaagtaccacgccgcggtgctcaccaacagcgctgagtgggaggccgcctgtgtgaaggcgggcaggaagtgtggggacctggtgcacccgctggtctactgccccgagctgcacttcagcgagttcacctcagctgtggcggacatgaagaactcagtggcggaccgagacaacagccccagctcctgtgctggcctcttcatcgcctcacacatcggcttcgactggcccggagtctgggtccacctggacattgctgcaccggtgcatgctggtgagcgagccacaggcttcggtgtggccctcctgctggcgctcttcggccgtgcctctgaggaccctctgctgaacctggtgtccccactgggctgtgaggtggatgtcgaggagggggacctggggagggactccaagagacgcaggcttgtgtgagcctcctgcctcggccctgacaaacggggatcttttacctcactttgcactgattaattttaagcaattgaaagattgcccttcatatgggttttggtttgtctttctggtcgtcagcgtggtggtggaaacagctgaagttttaggagacagcttagggtttggtgcgggccacggggaggggaccgggaagcgctggggcttgtttctgtttgttacttacaggactgagacatcttctgtaaactgctacccctggggccttctgcaccccggggtgaggcctcctgcctgcctggtgccctgtcccagccccaggtcccgtgcagggcacctgcgtggctgacagccaggctcttactccagccggggctgccagcgcatccagccagcccagccctgtgaaagatggagctgacttgctgcaggggacctgatttatagggcaagagaagtcacactctggcctctcagaattcacttgaggttcaattaaatacagtcacaccgc

SEQ ID NO: 312603 - DNA, 1248 bp, Homo sapiens
aggccgggccggagcggggcgaagggggccgagcggcgggccgggccgggccgggcagggccggggcgtgggccggcaggaagatggcgaacgtggggctgcagttccaggcgagcgcgggggactcggacccacagagccggcccctgctgctgctcgggcagctgcaccacctgcaccgcgtgccctggagccacgtccgcgggaagctgcagccccgggtcaccgaggagctctggcaggctgccctgagcacgctcaaccccaaccccacggacagctgtcccctctacctgaactacgccaccgtggctgccctgccctgcagggtgagccggcacaacagcccctcggccgcccacttcatcacgcggctggtgcggacctgcctgccgcccggagcgcatcgctgcattgtgatggtctgcgagcagccggaggtctttgcttccgcctgtgccctggcccgggccttcccgctgttcacccaccgctcaggtgcctctcggcgcttggagaagaagacggtcaccgtggagtttttcctggtgggacaagacaacgggccggtggaggtgtccacattgcagtgcttagcgaatgccacagacggcgtgcggctagcagcccgcatcgtggacacaccctgcaatgagatgaacaccgacaccttcctcgaggagattaacaaagttggaaaggagctggggatcatcccaaccatcatccgggatgaggaactgaagacgagaggatttggaggaatctatggggttggcaaagccgccctgcatcccccagccctggccgtcctcagccacaccccagatggagccacgcagaccatcgcctgggtgggcaaaggcatcgtctatgacactggaggcctcagcatcaaagggaagactaccatgccggggatgaagcgagactgcgggggtgctgcggccgtcctgggggccttcagagccgcaatcaagcagggtttcaaagacaacctccacgctgtgttctgcttggctgagaactcggtggggcccaatgcgacaaggccagatgacatccacctgctgtactcagggaagtacgtctggccctcccactccttcctgcccactgttggaactcgcgacccttcccggcctgcaatgcagggtagaccacgagctcctgggccaggcactgcacgggagcctagcaccttcatcgccccctccccttctgctcggcgtaccgagctcgcaattc

SEQ ID NO: 312604 - DNA, 124 bp, Homo sapiens
ggacccaggaggtgaggggtccccaggaacccctcctgtgctgcagccccacgcccagagtctgtgtcctgccctttgcttgcagggtgagcgagccacaggcttcggtgtggccctcctgctg

SEQ ID NO: 312605 - DNA, 2166 bp, Homo sapiens
aggccgggccggagcggggcgaagggggccgagcggcgggccgggccgggccgggcagggccggggcgtgggccggcaggaagatggcgaacgtggggctgcagttccaggcgagcgcgggggactcggacccacagagccggcccctgctgctgctcgggcagctgcaccacctgcaccgcgtgccctggagccacgtccgcgggaagctgcagccccgggtcaccgaggagctctggcaggctgccctgagcacgctcaaccccaaccccacggacagctgtcccctctacctgaactacgccaccgtggctgccctgccctgcagggtgagccggcacaacagcccctcggccgcccacttcatcacgcggctggtgcggacctgcctgccgcccggagcgcatcgctgcattgtgatggtctgcgagcagccggaggtctttgcttccgcctgtgccctggcccgggccttcccgctgttcacccaccgctcaggtgcctctcggcgcttggagaagaagacggtcaccgtggagtttttcctggtgggacaagacaacgggccggtggaggtgtccacattgcagtgcttagcgaatgccacagacggcgtgcggctagcagcccgcatcgtggacacaccctgcaatgagatgaacaccgacaccttcctcgaggagattaacaaagttggaaaggagctggggatcatcccaaccatcatccgggatgaggaactgaagacgagaggatttggaggaatctatggggttggcaaagccgccctgcatcccccagccctggccgtcctcagccacaccccagatggagccacgcagaccatcgcctgggtgggcaaaggcatcgtctatgacactggaggcctcagcatcaaagggaagactaccatgccggggatgaagcgagactgcgggggtgctgcggccgtcctgggggccttcagagccgcaatcaagcagggtttcaaagacaacctccacgctgtgttctgcttggctgagaactcggtggggcccaatgcgacaaggccagatgacatccacctgctgtactcagggaagacggtggaaatcaacaacacggatgccgagggcaggctggtgctggcagatggcgtgtcctatgcttgcaaggacctgggggccgacatcatcctggacatggccaccctgaccggggctcagggcattgccacagggaagtaccacgccgcggtgctcaccaacagcgctgagtgggaggccgcctgtgtgaaggcgggcaggaagtgtggggacctggtgcacccgctggtctactgccccgagctgcacttcagcgagttcacctcagctgtggcggacatgaagaactcagtggcggaccgagacaacagccccagctcctgtgctggcctcttcatcgcctcacacatcggcttcgactggcccggagtctgggtccacctggacattgctgcaccggtgcatgctggtgagcgagccacaggcttcggtgtggccctcctgctggcgctcttcggccgtgcctctgaggaccctctgctgaacctggtgtccccactgggctgtgaggtggatgtcgaggagggggacctggggagggactccaagagacgcaggcttgtgtgagcctcctgcctcggccctgacaaacggggatcttttacctcactttgcactgattaattttaagcaattgaaagattgcccttcatatgggttttggtttgtctttctggtcgtcagcgtggtggtggaaacagctgaagttttaggagacagcttagggtttggtgcgggccacggggaggggaccgggaagcgctggggcttgtttctgtttgttacttacaggactgagacatcttctgtaaactgctacccctggggccttctgcaccccggggtgaggcctcctgcctgcctggtgccctgtcccagccccaggtcccgtgcagggcacctgcgtggctgacagccaggctcttactccagccggggctgccagcgcatccagccagcccagccctgtgaaagatggagctgacttgctgcaggggacctgatttatagggcaagagaagtcacactctggcctctcagaattcacttgaggttcaattaaatacagtcacaccgc

SEQ ID NO: 312606 - DNA, 3161 bp, Homo sapiens
aggccgggccggagcggggcgaagggggccgagcggcgggccgggccgggccgggcagggccggggcgtgggccggcaggaagatggcgaacgtggggctgcagttccaggcgagcgcgggggactcggacccacagagccggcccctgctgctgctcgggcagctgcaccacctgcaccgcgtgccctggagccacgtccgcgggaagctgcagccccgggtcaccgaggagctctggcaggctgccctgagcacgctcaaccccaaccccacggacagctgtcccctctacctgaactacgccaccgtggctgccctgccctgcagggtgagccggcacaacagcccctcggccgcccacttcatcacgcggctggtgcggacctgcctgccgcccggagcgcatcgctgcattgtgatggtctgcgagcagccggaggtctttgcttccgcctgtgccctggcccgggccttcccgctgttcacccaccgctcaggtgcctctcggcgcttggagaagaagacggtcaccgtggagtttttcctggtgggacaagacaacgggccggtggaggtgtccacattgcagtgcttagcgaatgccacagacggcgtgcggctagcagcccgcatcgtggacacaccctgcaatgagatgaacaccgacaccttcctcgaggagattaacaaagttggaaaggagctggggatcatcccaaccatcatccgggatgaggaactgaagacgagaggatttggaggaatctatggggttggcaaagccgccctgcatcccccagccctggccgtcctcagccacaccccagatggagccacgcagaccatcgcctgggtgggcaaaggcatcgtctatgacactggaggcctcagcatcaaagggaagatgtctgcagaacaaaagcattttggacacagtaactccaagtgttcacatggaatgagggaagtgaaggaacgcaggttccgcgtcttcgttttgaccatcccgcactctcgtgttttattttgggtcctctgtttcgacaccgggaggtaggaaatcatgggccctggaggccccgactgtgcccagagccagcccacaggatctgactgtcagagcgattctcagaaggaatgtgggtagtagattttgtgtcgggtcattgctaacgtccatgtaatgttactttcaggataagtaacaacgatatgcgaatttgaagcttttgtttgtgtgattaaaacgcaaccgtagccacagcaattttttaaacttcaatcaacaacagattttcggaggaggaatatgttattgctgactttgttcagagataccggcacacggtggtaataagcaaactgacttctagtcggttatgattcctaaattcgccacagatagtgcaccccctactgcctgcacctggtactggctgctcccaccctcgcacgcaccctcaatacccacggtcaccctggaagccgctacattctggctggtagagtcgtggaccctcttctccttggatcagatgcttgtttttgatgtcggcttgttgtggaccaatgtgagaagatgagcttcctgggaattcattcgtttgcttgtggcactaactctagtcacttagggaaaatatcgttgcacctgacttcatctcatgtggctgtgggtagacctgtgcagttagtcagctcccggcctggaaattaacacaaaggaaaaacctgaccacacaggccttccctagaggccacagctgcacagccttcagggaagctgtggtctgagggtggctggtagaactgccagagagtagggcattttccatggctccagatcaccttctgaaaatgcgactatagcccctgcctattcccggggtccacctggtctgcagaccccataataccaggaagagctgggtgttctggcaccagtgaaacaatacctggttttttattttaaaccagcccatcttccccgctgcagttggaaccgttctacgtggatttgggatcaaccagcaggcctttcctgagctgttactgtgtggagtgggcgctgaggctccagccattgatgcaaagaccccaatcctgacctgaaggcgctcacaatctctccccaacggcctggtgtgaaacgcagacgcaacgcagcaggcattctccccagtggctgcctgtagagcaaatggtgcagaaatggtcactcctcaaaaagcaagccggctggagccagcccagctcccagttttgcaagaaaaaaaaaatcacagctccattttcaaagatttcaagggcagctcaagaccagcctggactagcaggcctcaaatgcattactggagacccctttacgctcttaacaagtaccgaccccaaagaggctttttgtataacaatgtctattgatatttactctactggaaattaaaagtgagaaatttataacatgtataattcattaaaaataacatataaatccattgcatgttatcataaataattttatgaagataagcatcttccaaaatgaaaaaataatttactgagagagtagcattgttgtacattttcacaaatcctgtcagtgtctggcttaatagaagacagctagggaccttgcgtctgcttccgatgtagtctatggaaatgtgttgtttcagttgaactgtatcaagaaaatctggcctcacgcattttatagttgaaacagggaaaaggattttagtacctttttcagctaactaactatgaacattctttgctactacaccaaaactcaacaagtggtagcttcttaaaggctggttataacatggaatctgaagcctcatgaatagacttttgggctctgtggcagttaaatccgctgttctctctcactttgaacatgtggtttttcatggaaaaatgaatgttcacttgaaaaatgttggttcacagagttctgcagaaattcaaatttttgacacattacattatatagtatcaaaaaatcacttaatatcaccatccatctcatcagaaaactcattatgaggaagttgtcatggtgataggagaaagtttttcaaaattctgatttttgcttaaaagctcaaatgtataccattggcaataaataatgtcagctgtttctggaaaaaaa

SEQ ID NO: 312607 - DNA, 3106 bp, Homo sapiens
aggccgggccggagcggggcgaagggggccgagcggcgggccgggccgggccgggcagggccggggcgtgggccggcaggaagatggcgaacgtggggctgcagttccaggcgagcgcgggggactcggacccacagagccggcccctgctgctgctcgggcagctgcaccacctgcaccgcgtgccctggagccacgtccgcgggaagctgcagccccgggtcaccgaggagctctggcaggctgccctgagcacgctcaaccccaaccccacggacagctgtcccctctacctgaactacgccaccgtggctgccctgccctgcagggtgagccggcacaacagcccctcggccgcccacttcatcacgcggctggtgcggacctgcctgccgcccggagcgcatcgctgcattgtgatggtctgcgagcagccggaggtctttgcttccgcctgtgccctggcccgggccttcccgctgttcacccaccgctcaggtgcctctcggcgcttggagaagaagacggtcaccgtggagtttttcctggtgggacaagacaacgggccggtggaggtgtccacattgcagtgcttagcgaatgccacagacggcgtgcggctagcagcccgcatcgtggacacaccctgcaatgagatgaacaccgacaccttcctcgaggagattaacaaagttggaaaggagctggggatcatcccaaccatcatccgggatgaggaactgaagacgagaggatttggaggaatctatggggttggcaaagccgccctgcatcccccagccctggccgtcctcagccacaccccagatggagccacgcagaccatcgcctgggtgggcaaaggcatcgtctatgacactggaggcctcagcatcaaagggaagatgtctgcagaacaaaagcattttggacacagtaactccaagtgttcacatggaatgagggaagtgaaggaacgcaggttccgcgtcttcgttttgaccatcccgcactctcgtgttttattttgggtcctctgtttcgacaccgggaggtaggaaatcatgggccctggaggccccgactgtgcccagagccagcccacaggatctgactgtcagagcgattctcagaaggaatgtgggtagtagattttgtgtcgggtcattgctaacgtccatgtaatgttactttcaggataagtaacaacgatatgcgaatttgaagcttttgtttgtgtgattaaaacgcaaccgtagccacagcaattttttaaacttcaatcaacaacagattttcggaggaggaatatgttattgctgactttgttcagagataccggcacacggtggtaataagcaaactgacttctagtcggttatgattcctaaattcgccacagatagtgcaccccctactgcctgcacctggtactggctgctcccaccctcgcacgcaccctcaatacccacggtcaccctggaagccgctacattctggctggtagagtcgtggaccctcttctccttggatcagatgcttgtttttgatgtcggcttgttgtggaccaatgtgagaagatgagcttcctgggaattcattcgtttgcttgtggcactaactctagtcacttagggaaaatatcgttgcacctgacttcatctcatgtggctgtgggtagacctgtgcagttagtcagctcccggcctggaaattaacacaaaggaaaaacctgaccacacaggccttccctagaggccacagctgcacagccttcagggaagctgtggtctgagggtggctggtagaactgccagagagtagggcattttccatggctccagatcaccttcccataataccaggaagagctgggtgttctggcaccagtgaaacaatacctggttttttattttaaaccagcccatcttccccgctgcagttggaaccgttctacgtggatttgggatcaaccagcaggcctttcctgagctgttactgtgtggagtgggcgctgaggctccagccattgatgcaaagaccccaatcctgacctgaaggcgctcacaatctctccccaacggcctggtgtgaaacgcagacgcaacgcagcaggcattctccccagtggctgcctgtagagcaaatggtgcagaaatggtcactcctcaaaaagcaagccggctggagccagcccagctcccagttttgcaagaaaaaaaaaatcacagctccattttcaaagatttcaagggcagctcaagaccagcctggactagcaggcctcaaatgcattactggagacccctttacgctcttaacaagtaccgaccccaaagaggctttttgtataacaatgtctattgatatttactctactggaaattaaaagtgagaaatttataacatgtataattcattaaaaataacatataaatccattgcatgttatcataaataattttatgaagataagcatcttccaaaatgaaaaaataatttactgagagagtagcattgttgtacattttcacaaatcctgtcagtgtctggcttaatagaagacagctagggaccttgcgtctgcttccgatgtagtctatggaaatgtgttgtttcagttgaactgtatcaagaaaatctggcctcacgcattttatagttgaaacagggaaaaggattttagtacctttttcagctaactaactatgaacattctttgctactacaccaaaactcaacaagtggtagcttcttaaaggctggttataacatggaatctgaagcctcatgaatagacttttgggctctgtggcagttaaatccgctgttctctctcactttgaacatgtggtttttcatggaaaaatgaatgttcacttgaaaaatgttggttcacagagttctgcagaaattcaaatttttgacacattacattatatagtatcaaaaaatcacttaatatcaccatccatctcatcagaaaactcattatgaggaagttgtcatggtgataggagaaagtttttcaaaattctgatttttgcttaaaagctcaaatgtataccattggcaataaataatgtcagctgtttctggaaaaaaa

SEQ ID NO: 312608 - DNA, 1311 bp, Homo sapiens
aggccgggccggagcggggcgaagggggccgagcggcgggccgggccgggccgggcagggccggggcgtgggccggcaggaagatggcgaacgtggggctgcagttccaggcgagcgcgggggactcggacccacagagccggcccctgctgctgctcgggcagctgcaccacctgcaccgcgtgccctggagccacgtccgcgggaagctgcagccccgggtcaccgaggagctctggcaggctgccctgagcacgctcaaccccaaccccacggacagctgtcccctctacctgaactacgccaccgtggctgccctgccctgcagggtgagccggcacaacagcccctcggccgcccacttcatcacgcggctggtgcggacctgcctgccgcccggagcgcatcgctgcattgtgatggtctgcgagcagccggaggtctttgcttccgcctgtgccctggcccgggccttcccgctgttcacccaccgctcaggtgcctctcggcgcttggagaagaagacggtcaccgtggagtttttcctggtgggacaagacaacgggccggtggaggtgtccacattgcagtgcttagcgaatgccacagacggcgtgcggctagcagcccgcatcgtggacacaccctgcaatgagatgaacaccgacaccttcctcgaggagattaacaaagttggaaaggagctggggatcatcccaaccatcatccgggatgaggaactgaagacgagaggatttggaggaatctatggggttggcaaagccgccctgcatcccccagccctggccgtcctcagccacaccccagatggagccacgcagaccatcgcctgggtgggcaaaggcatcgtctatgacactggaggcctcagcatcaaagggaagactaccatgccggggatgaagcgagactgcgggggtgctgcggccgtcctgggggccttcagagccgcaatcaagcagggtttcaaagacaacctccacgctgtgttctgcttggctgagaactcggtggggcccaatgcgacaaggccagatgacatccacctgctgtactcagggaagacggtggaaatcaacaacacggatgccgagggcaggctggtgagggcacctgcgtggctgacagccaggctcttactccagccggggctgccagcgcatccagccagcccagccctgtgaaagatggagctgacttgctgcaggggacctgatttatagggcaagagaagtcacactctggcctctcagaattcacttgaggttcaattaaatacagtcacaccgc

SEQ ID NO: 312609 - DNA, 2896 bp, Homo sapiens
agtgctggcacgagggagagtcgaacccggagcagggtcccatccgagcgtggactggcggcaggatgttcagctggatggggcggcaggcgggcgggcgcgaacgcgctggcggcgcggacgcggtgcagacggtgacgggcgggctgcgctcgctctacctgcgcaaggtgctgccgctggaggaggcgtaccgcttccacgagttccactcgcctgcgctggaggacgccgacttcgagaacaagcccatgatcctgctggtgggccagtacagcaccggcaagaccaccttcatcagatacctactggagcaggatttcccaggcatgaggattggtccggagcccaccacagactccttcatcgccgtgatgtatggagagactgagggcagcaccccagggaatgctttagtcgtggaccccaaaaagccgtttagaaagctcagtcgctttggaaacgctttcctgaatcgattcatgtgctcacagctccccaatcaggtcctgaagagcatcagcgtcatcgacagccccggcatcctttctggggagaagcagcgcatcagccgaggctatgacttctgccaggtcctgcagtggtttgccgagagggtggacaggatcatcctgctctttgacgctcacaagctggacatctcagatgaattctcagaggccatcaaggccttccggggccaggacgacaagatccgtgtcgtgctgaacaaggccgaccaagtggacacgcagcagctgatgcgggtctacggggccctcatgtggtccctaggcaaggtcatcaacacgcccgaggtactgcgcgtctacattggctccttctgggcgcagcccctgcagaacacggacaaccgccggctcttcgaggctgaggcccaggacctctttagagacatccagagcctcccccagaaggcagcggtgcgcaagctcaacgacctcatcaagcgagcgaggctggccaaggtgcatgcctacatcatcagctacctgaagaaggagatgccaagtgtatttggaaaggaaaacaagaagagagagcttatcagcaggctaccggaaatctacattcagctacagcgagaataccagatttctgcaggggacttccctgaggtcaaggctatgcaggaacagcttgagaactatgacttcaccaaattccactcgctgaagcccaagctgatcgaggcagtggacaacatgctgagcaacaagatctcgcccctcatgaacctcatcagccaggaggagacgagcacgcccacgcagctggtgcagggcggcgccttcgatggcaccaccgagggccccttcaaccagggctacggggagggtgccaaggagggcgccgacgaggaggagtgggtcgtggccaaagacaagcccgtctacgacgagctcttctacactctgtcgcccatcaatggcaagatatcaggtgtcaacgccaagaaggagatggtgacctccaagctgcccaacagcgtcctgggcaagatctggaagctggccgactgcgactgcgacggcatgcttgatgaggaggagttcgcgctggccaagcacctcatcaagatcaagctcgacggctacgagctgcccagcagcctgcccccccacctcgtgcccccctcgcacaggaagtccctgcccaaggccgactgaggggtgggctgcagaacggggtgggaactgggggacctgggcctcaggcctgctccaccactgactcaccgaatgaccttgggcaaggcactgccctctctgtgccttggtttccccatctgtagaatggggagggtggacactggaaactagatgacttctttcacctccaaaattcccttagtttctatgaaaatattgggggtaggggggtggattaggagattgaagggttgagaagaaagagaaattgtccaaagagtcctcagaacctgcctggagaaatgcgcatgggggtgggcctggtaagtcccaggaaccacaggaagtgagctaaggctcacccagagcagctgggtctccaggctgcctgggctttttgtcctcatgaacaactctggagcagctgtctgtccctcagagggcacctggaggcagcaaagattatcttatttattttattttgttttctgctatatttagagtggcaaaaaaatagagcagagggtttctgctgtctccagactgtctaccaaagagaaggcgacagatgcctcctgggtttggaagggggatgcactgtggatctgccatccattctgcagtctccagcagagcaggcagtcaggccccagcgtgcctccatcccagtgccccgatgaccatctggtcagccctcccaacctcccttccagggggcttaccagcaaagccatattcggctaggaatttggaattcacaacctttattaacccctggcaaaacttcccgtttgcatgtcaaatcacattgaagcctgaagattagcttttcttactggtttttccaataagtaatagcaaagcccacttatcatacttaaactacagtaaagaaaagaggtggttctctgcagtgatcgtttagtgtggccctcaaacattaaatatccccaggtctccttggtgggtggcaggatttaaattcaatcaaatcctgtcctagtgtgtgcagtgtcttcggccctgtggacacaggtgaatgagggaccagccctgccctgggctgttgagaagagatcagtccacccagagttagacattgtttttgtagaaaacaggcatttattatgtctagggttttgtgttttttttttttccttacaggataaaagcctttatacagaaacaaaatggaacctttcatataaaaccttttctttaaa

SEQ ID NO: 312610 - DNA, 2976 bp, Homo sapiens
agtgctggcacgagggagagtcgaacccggagcagggtcccatccgagcgtggactggcggcaggatgttcagctggatggggcggcaggcgggcgggcgcgaacgcgctggcggcgcggacgcggtgcagacggtgacgggcgggctgcgctcgctctacctgcgcaaggtgctgccgctggaggaggcgtaccgcttccacgagttccactcgcctgcgctggaggacgccgacttcgagaacaagcccatgatcctgctggtgggccagtacagcaccggcaagaccaccttcatcagatacctactggagcaggatttcccaggcatgaggattggtccggagcccaccacagactccttcatcgccgtgatgtatggagagactgagggcagcaccccagggaatgctttagtcgtggaccccaaaaagccgtttagaaagctcagtcgctttggaaacgctttcctgaatcgattcatgtgctcacagctccccaatcaggtcctgaagagcatcagcgtcatcgacagccccggcatcctttctggggagaagcagcgcatcagccgaggctatgacttctgccaggtcctgcagtggtttgccgagagggtggacaggatcatcctgctctttgacgctcacaagctggacatctcagatgaattctcagaggccatcaaggccttccggggccaggacgacaagatccgtgtcgtgctgaacaaggccgaccaagtggacacgcagcagctgatgcgggtctacggggccctcatgtggtccctaggcaaggtcatcaacacgcccgaggtactgcgcgtctacattggctccttctgggcgcagcccctgcagaacacggacaaccgccggctcttcgaggctgaggcccaggacctctttagagacatccagagcctcccccagaaggcagcggtgcgcaagctcaacgacctcatcaagcgagcgaggctggccaaggtgcatgcctacatcatcagctacctgaagaaggagatgccaagtgtatttggaaaggaaaacaagaagagagagcttatcagcaggctaccggaaatctacattcagctacagcgagaataccagatttctgcaggggacttccctgaggtcaaggctatgcaggaacagcttgagaactatgacttcaccaaattccactcgctgaagcccaagctgatcgaggcagtggacaacatgctgagcaacaagatctcgcccctcatgaacctcatcagccaggaggagacgagcacgcccacgcagctggtgcagggcggcgccttcgatggcaccaccgagggccccttcaaccagggctacggggagggtgccaaggagggcgccgacgaggaggagtgggtcgtggccaaagacaagcccgtctacgacgagctcttctacactctgtcgcccatcaatggcaagatatcaggtgtcaacgccaagaaggagatggtgacctccaagctgcccaacagcgtcctgggcaagatctggaagctggccgactgcgactgcgacggcatgcttgatgaggaggagttcgcgctggccaagcacctcatcaagatcaagctcgacggctacgagctgcccagcagcctgcccccccacctcgtgcccccctcgcacaggaagtccctgcccaaggccgactgaggggtgggctgcagaacggggtgggaactgggggacctgggcctcaggcctgctccaccactgactcaccgaatgaccttgggcaaggcactgccctctctgtgccttggtttccccatctgtagaatggggagggtggacactggaaactagatgacttctttcacctccaaaattcccttagtttctatgaaaatattgggggtaggggggtggattaggagattgaagggttgagaagaaagagaaattgtccaaagagtcctcagaacctgcctggagaaatgcgcatgggggtgggcctggtaagtcccaggaaccacaggaagtgagctaaggctcacccagagcagctgggtctccaggctgcctgggctttttgtcctcatgaacaactctggagcagctgtctgtccctcagagggcacctggaggcagcaaagattatcttatttattttattttgttttctgctatatttagagtggcaaaaaaatagagcagagggtttctgctgtctccagactgtctaccaaagagaaggcgacagatgcctcctgggtttggaagggggatgcactgtggatctgccatccattctgcagtctccagcagagcaggcagtcaggccccagcgtgcctccatcccagtgccccgatgaccatctggtcagccctcccaacctcccttccagggggcttaccagcaaagccatattcggctaggaatttggaattcacaacctttattaacccctggcaaaacttcccgtttgcatgtcaaatcacattgaagcctgaagattagcttttcttactggtttttccaataagtaatagcaaagcccacttatcatacttaaactacagtaaagaaaagaggtggttctctgcagtgatcgtttagtgtggccctcaaacattaaatatccccaggtctccttggtgggtggcaggatttaaattcaatcaaatcctgtcctagtgtgtgcagtgtcttcggccctgtggacacaggtgaatgagggaccagccctgccctgggctgttgagaagagatcagtccacccagagttagacattgtttttgtagaaaacaggcatttattatgtctagggcgtggggttttccttaaggaaaaagctttagaaacaatgacttttttaaacttttttaaaaaaaaaggcggggctaaatcccggggccctactccctttgaaagccaaagggtataaaagcggtaagggggaagctgcttgaccctggttgaacccaccgctattt

SEQ ID NO: 312611 - DNA, 854 bp, Homo sapiens
  misc_feature (241)..(241): n is a, c, g, or t
gaatgtgtcaaaatcccggtccatttttacccccgtattgccggttggttccgctattaccccgtaaagttttaatttcccctggcgcgtttaatatctgttgtgggttggtgtcccattgttgctccccccccccagagttatgggggttgcctctcccagagggtcccccggacgcgcggttgttcccacctgcccggcgccgttgtggtttacgtcgcggtccccgtggtcttggtgntttttgtaattccccctcccccttattgggggccgcccttgtgtgcccaaaaaaccggggttacccctaaattggggcccccccggggaaattttttccccccccccctttttttttttatttttttgttcatttattattttattatttttatttttattttgagaggaagtctctgtcacccaggctggagtgcagtggcgcaatctcagttcactgcaacctccgcctcccaggttcaagtgattcccctgcctcagcctcccaagtagctgggactacaggcacccgccaccacgcccggctaatttttgtattttagtagagatggggttttaccatgttggtcaatatggtctcgatctcctgacctcgtgatctacccacctcggcctcccaaagtgctgtaacctaagcagacagttctgtgaatgcgtgaggaccacctgaagtctgcagccacggtggaggtcaccaaagggtgaactgagagagaagagggaattcacttgcccaaaggtttacagatgcccaggcaaactgatttttccatccagaattatcttgttctttaactctcctcaattgtcatatataaacatgaatttatata

SEQ ID NO: 312612 - DNA, 298 bp, Homo sapiens
aaagctaatcttcaggcttcaatgtgatttgacatgcaaacgggaagttttgccaggggttaataaaggttgtgaattccaaattcctagccgaatatggctttgctggtaagccccctggaagggaggttgggagggctgttgagaagagatcagtccacccagagttagacattgtttttgtagaaaacaggcatttattatgtctagggttttgtgttttttttttttccttacaggataaaagcctttatacagaaacaaaatggaacctttcatataaaaccttttctttaaa

SEQ ID NO: 312613 - DNA, 4174 bp, Homo sapiens
agtgctggcacgagggagagtcgaacccggagcagggtcccatccgagcgtggactggcggcaggatgttcagctggatggggcggcaggcgggcgggcgcgaacgcgctggcggcgcggacgcggtgcagacggtgacgggcgggctgcgctcgctctacctgcgcaaggtgctgccgctggaggaggcgtaccgcttccacgagttccactcgcctgcgctggaggacgccgacttcgagaacaagcccatgatcctgctggtgggccagtacagcaccggcaagaccaccttcatcagatacctactggagcaggatttcccaggcatgaggattggtccggagcccaccacagactccttcatcgccgtgatgtatggagagactgagggcagcaccccagggaatgctttagtcgtggaccccaaaaagccgtttagaaagctcagtcgctttggaaacgctttcctgaatcgattcatgtgctcacagctccccaatcaggtcctgaagagcatcagcgtcatcgacagccccggcatcctttctggggagaagcagcgcatcagccgaggctatgacttctgccaggtcctgcagtggtttgccgagagggtggacaggatcatcctgctctttgacgctcacaagctggacatctcagatgaattctcagaggccatcaaggccttccggggccaggacgacaagatccgtgtcgtgctgaacaaggccgaccaagtggacacgcagcagctgatgcgggtctacggggccctcatgtggtccctaggcaaggtcatcaacacgcccgaggtactgcgcgtctacattggctccttctgggcgcagcccctgcagaacacggacaaccgccggctcttcgaggctgaggcccaggacctctttagagacatccagagcctcccccagaaggcagcggtgcgcaagctcaacgacctcatcaagcgagcgaggctggccaaggtgcatgcctacatcatcagctacctgaagaaggagatgccaagtgtatttggaaaggaaaacaagaagagagagcttatcagcaggctaccggaaatctacattcagctacagcgagaataccagatttctgcaggggacttccctgaggtcaaggctatgcaggaacagcttgagaactatgacttcaccaaattccactcgctgaagcccaagctgatcgaggcagtggacaacatgctgagcaacaagatctcgcccctcatgaacctcatcagccaggaggagacgagcacgcccacgcagctggtgcagggcggcgccttcgatggcaccaccgagggccccttcaaccagggctacggggagggtgccaaggagggcgccgacgaggaggagtgggtcgtggccaaagacaagcccgtctacgacgagctcttctacactctgtcgcccatcaatggcaagatatcaggtgtcaacgccaagaaggagatggtgacctccaagctgcccaacagcgtcctgggcaagatctggaagctggccgactgcgactgcgacggcatgcttgatgaggaggagttcgcgctggccaagcacctcatcaagatcaagctcgacggctacgagctgcccagcagcctgcccccccacctcgtgcccccctcgcacaggaagtccctgcccaaggccgactgaggggtgggctgcagaacggggtgggaactgggggacctgggcctcaggcctgctccaccactgactcaccgaatgaccttgggcaaggcactgccctctctgtgccttggtttccccatctgtagaatggggagggtggacactggaaactagatgacttctttcacctccaaaattcccttagtttctatgaaaatattgggggtaggggggtggattaggagattgaagggttgagaagaaagagaaattgtccaaagagtcctcagaacctgcctggagaaatgcgcatgggggtgggcctggtaagtcccaggaaccacaggaagtgagctaaggctcacccagagcagctgggtctccaggctgcctgggctttttgtcctcatgaacaactctggagcagctgtctgtccctcagagggcacctggaggcagcaaagattatcttatttattttattttgttttctgctatatttagagtggcaaaaaaatagagcagagggtttctgctgtctccagactgtctaccaaagagaaggcgacagatgcctcctgggtttggaagggggatgcactgtggatctgccatccattctgcagtctccagcagagcaggcagtcaggccccagcgtgcctccatcccagtgccccgatgaccatctggtcagccctcccaacctcccttccagggggcttaccagcaaagccatattcggctaggaatttggaattcacaacctttattaacccctggcaaaacttcccgtttgcatgtcaaatcacattgaagcctgaagattagcttttcttactggtttttccaataagtaatagcaaagcccacttatcatacttaaactacagtaaagaaaagaggtggttctctgcagtgatcgtttagtgtggccctcaaacattaaatatccccaggtctccttggtgggtggcaggatttaaattcaatcaaatcctgtcctagtgtgtgcagtgtcttcggccctgtggacacaggtgaatgagggaccagccctgccctgggctgttgagaagagatcagtccacccagagttagacattgtttttgtagaaaacaggcatttattatgtctagggttttgtgttttttttttttccttacaggataaaagcctttatacagaaacaaaatggaacctttcatataaaaccttttctttaaaggctgtgtggttcgtatcatgaatgcccatcacgaggcaggattcgggcacatacctgtacttctgctccagagtgtgcgctccccaaatcccctgagtaaacctctctggactgctgctcagacacctgcgtcaggtggaggtgcctccccctctgtgggcaccagcttggggaggtaggtgacttttccttgcaaatctccctgcctcatctccagaaaattgcatacctgcatggcctctctgcattatttatgcaggaagagacacgaaacagcaatggccacatggtatgggggcctgctggcaccagaagtgaatgaaatcagaaccgtcccactgagtcttccaaaaggcacataattttttttttctgtcacctgcctttggtgacagggtcaaaggcacagattgaagagaaaatcttgatttgggagaagcatttatatccagatgcctacccttacactccctagcttactttctacataatttagttttaagagcaggaaatgcataacatggtttttagtcttaacaagcacttaaattcattagacgcatagaaaagaaccatttattattttattatttttatttttattttgagaggaagtctctgtcacccaggctggagtgcagtggcgcaatctcagttcactgcaacctccgcctcccaggttcaagtgattcccctgcctcagcctcccaagtagctgggactacaggcacccgccaccacgcccggctaatttttgtattttagtagagatggggttttaccatgttggtcaatatggtctcgatctcctgacctcgtgatctacccacctcggcctcccaaagtgctgtaacctaagcagacagttctgtgaatgcgtgaggaccacctgaagtctgcagccacggtggaggtcaccaaagggtgaactgagagagaagagggaattcacttgcccaaaggtttacagatgcccaggcaaactgatttttccatccagaattatcttgttctttaactctcctcaattgtcatatataaacatgaatttatatacatgtgtgtcacatgagtatgtcgttttaaaacaacgtgtacatatgtaagttttgtctggatacagaaagctgctttagagggcagcaggttgaggtctctgatttctccgtggaggaaaacctctcaggcactgtgatctccctacctctgcgctctcaggtgggagaggcgtcaggcagcggagtcctttccctgctggcacctggtaatgttcttgg

SEQ ID NO: 312614 - DNA, 3187 bp, Homo sapiens
agtgctggcacgagggagagtcgaacccggagcagggtcccatccgagcgtggactggcggcaggatgttcagctggatggggcggcaggcgggcgggcgcgaacgcgctggcggcgcggacgcggtgcagacggtgacgggcgggctgcgctcgctctacctgcgcaaggtgctgccgctggaggaggcgtaccgcttccacgagttccactcgcctgcgctggaggacgccgacttcgagaacaagcccatgatcctgctggtgggccagtacagcaccggcaagaccaccttcatcagatacctactggagcaggatttcccaggcatgaggattggtccggagcccaccacagactccttcatcgccgtgatgtatggagagactgagggcagcaccccagggaatgctttagtcgtggaccccaaaaagccgtttagaaagctcagtcgctttggaaacgctttcctgaatcgattcatgtgctcacagctccccaatcaggtcctgaagagcatcagcgtcatcgacagccccggcatcctttctggggagaagcagcgcatcagccgaggctatgacttctgccaggtcctgcagtggtttgccgagagggtggacaggatcatcctgctctttgacgctcacaagctggacatctcagatgaattctcagaggccatcaaggccttccggggccaggacgacaagatccgtgtcgtgctgaacaaggccgaccaagtggacacgcagcagctgatgcgggtctacggggccctcatgtggtccctaggcaaggtcatcaacacgcccgaggtactgcgcgtctacattggctccttctgggcgcagcccctgcagaacacggacaaccgccggctcttcgaggctgaggcccaggacctctttagagacatccagagcctcccccagaaggcagcggtgcgcaagctcaacgacctcatcaagcgagcgaggctggccaaggtgcatgcctacatcatcagctacctgaagaaggagatgccaagtgtatttggaaaggaaaacaagaagagagagcttatcagcaggctaccggaaatctacattcagctacagcgagaataccagatttctgcaggggacttccctgaggtcaaggctatgcaggaacagcttgagaactatgacttcaccaaattccactcgctgaagcccaagctgatcgaggcagtggacaacatgctgagcaacaagatctcgcccctcatgaacctcatcagccaggaggagacgagcacgcccacgcagctggtgcagggcggcgccttcgatggcaccaccgagggccccttcaaccagggctacggggagggtgccaaggagggcgccgacgaggaggagtgggtcgtggccaaagacaagcccgtctacgacgagctcttctacactctgtcgcccatcaatggcaagatatcaggtgtcaacgccaagaaggagatggtgacctccaagctgcccaacagcgtcctgggcaagatctggaagctggccgactgcgactgcgacggcatgcttgatgaggaggagttcgcgctggccaagcacctcatcaagatcaagctcgacggctacgagctgcccagcagcctgcccccccacctcgtgcccccctcgcacaggaagtccctgcccaaggccgactgaggggtgggctgcagaacggggtgggaactgggggacctgggcctcaggcctgctccaccactgactcaccgaatgaccttgggcaaggcactgccctctctgtgccttggtttccccatctgtagaatggggagggtggacactggaaactagatgacttctttcacctccaaaattcccttagtttctatgaaaatattgggggtaggggggtggattaggagattgaagggttgagaagaaagagaaattgtccaaagagtcctcagaacctgcctggagaaatgcgcatgggggtgggcctggtaagtcccaggaaccacaggaagtgagctaaggctcacccagagcagctgggtctccaggctgcctgggctttttgtcctcatgaacaactctggagcagctgtctgtccctcagagggcacctggaggcagcaaagattatcttatttattttattttgttttctgctatatttagagtggcaaaaaaatagagcagagggtttctgctgtctccagactgtctaccaaagagaaggcgacagatgcctcctgggtttggaagggggatgcactgtggatctgccatccattctgcagtctccagcagagcaggcagtcaggccccagcgtgcctccatcccagtgccccgatgaccatctggtcagccctcccaacctcccttccagggggcttaccagcaaagccatattcggctaggaatttggaattcacaacctttattaacccctggcaaaacttcccgtttgcatgtcaaatcacattgaagcctgaagattagcttttcttactggtttttccaataagtaatagcaaagcccacttatcatacttaaactacagtaaagaaaagaggtggttctctgcagtgatcgtttagtgtggccctcaaacattaaatatccccaggtctccttggtgggtggcaggatttaaattcaatcaaatcctgtcctagtgtgtgcagtgtcttcggccctgtggacacaggtgaatgagggaccagccctgccctgggctgttgagaagagatcagtccacccagagttagacattgtttttgtagaaaacaggcatttattatgtctagggttttgtgttttttttttttccttacaggataaaagcctttatacagaaacaaaatggaacctttcatataaaaccttttctttaaaaaaaaaaaaaaaaaaaaaaaaaaaaaaaaaaaaaaaaaaagggggggggtcatatagagagcggggggagcgggaaaaagagagaggcagagagagaagaggggccaagcagagggcgcaaaccgatggtggtgctgcggagagccccaccgattttctgtggcaacacagaaggggggaaaaaaataaggcggcgggagacaccctataagagggggggggagggataaataataggtcgcgaaaaaagacgcgcggggtaaaaccgcgggtaaaaagaaagggggagaa

SEQ ID NO: 312615 - DNA, 3899 bp, Homo sapiens
agtgctggcacgagggagagtcgaacccggagcagggtcccatccgagcgtggactggcggcaggatgttcagctggatggggcggcaggcgggcgggcgcgaacgcgctggcggcgcggacgcggtgcagacggtgacgggcgggctgcgctcgctctacctgcgcaaggtgctgccgctggaggaggcgtaccgcttccacgagttccactcgcctgcgctggaggacgccgacttcgagaacaagcccatgatcctgctggtgggccagtacagcaccggcaagaccaccttcatcagatacctactggagcaggatttcccaggcatgaggattggtccggagcccaccacagactccttcatcgccgtgatgtatggagagactgagggcagcaccccagggaatgctttagtcgtggaccccaaaaagccgtttagaaagctcagtcgctttggaaacgctttcctgaatcgattcatgtgctcacagctccccaatcaggtcctgaagagcatcagcgtcatcgacagccccggcatcctttctggggagaagcagcgcatcagccgaggctatgacttctgccaggtcctgcagtggtttgccgagagggtggacaggatcatcctgctctttgacgctcacaagctggacatctcagatgaattctcagaggccatcaaggccttccggggccaggacgacaagatccgtgtcgtgctgaacaaggccgaccaagtggacacgcagcagctgatgcgggtctacggggccctcatgtggtccctaggcaaggtcatcaacacgcccgaggtactgcgcgtctacattggctccttctgggcgcagcccctgcagaacacggacaaccgccggctcttcgaggctgaggcccaggacctctttagagacatccagagcctcccccagaaggcagcggtgcgcaagctcaacgacctcatcaagcgagcgaggctggccaaggtgcatgcctacatcatcagctacctgaagaaggagatgccaagtgtatttggaaaggaaaacaagaagagagagcttatcagcaggctaccggaaatctacattcagctacagcgagaataccagatttctgcaggggacttccctgaggtcaaggctatgcaggaacagcttgagaactatgacttcaccaaattccactcgctgaagcccaagctgatcgaggcagtggacaacatgctgagcaacaagatctcgcccctcatgaacctcatcagccaggaggagacgagcacgcccacgcagctggtgcagggcggcgccttcgatggcaccaccgagggccccttcaaccagggctacggggagggtgccaaggagggcgccgacgaggaggagtgggtcgtggccaaagacaagcccgtctacgacgagctcttctacactctgtcgcccatcaatggcaagatatcaggtgtcaacgccaagaaggagatggtgacctccaagctgcccaacagcgtcctgggcaagatctggaagctggccgactgcgactgcgacggcatgcttgatgaggaggagttcgcgctggccaagcacctcatcaagatcaagctcgacggctacgagctgcccagcagcctgcccccccacctcgtgcccccctcgcacaggaagtccctgcccaaggccgactgaggggtgggctgcagaacggggtgggaactgggggacctgggcctcaggcctgctccaccactgactcaccgaatgaccttgggcaaggcactgccctctctgtgccttggtttccccatctgtagaatggggagggtggacactggaaactagatgacttctttcacctccaaaattcccttagtttctatgaaaatattgggggtaggggggtggattaggagattgaagggttgagaagaaagagaaattgtccaaagagtcctcagaacctgcctggagaaatgcgcatgggggtgggcctggtaagtcccaggaaccacaggaagtgagctaaggctcacccagagcagctgggtctccaggctgcctgggctttttgtcctcatgaacaactctggagcagctgtctgtccctcagagggcacctggaggcagcaaagattatcttatttattttattttgttttctgctatatttagagtggcaaaaaaatagagcagagggtttctgctgtctccagactgtctaccaaagagaaggcgacagatgcctcctgggtttggaagggggatgcactgtggatctgccatccattctgcagtctccagcagagcaggcagtcaggccccagcgtgcctccatcccagtgccccgatgaccatctggtcagccctcccaacctcccttccagggggcttaccagcaaagccatattcggctaggaatttggaattcacaacctttattaacccctggcaaaacttcccgtttgcatgtcaaatcacattgaagcctgaagattagcttttcttactggtttttccaataagtaatagcaaagcccacttatcatacttaaactacagtaaagtccccaggtctccttggtgggtggcaggatttaaattcaatcaaatcctgtcctagtgtgtgcagtgtcttcggccctgtggacacaggtgaatgagggaccagccctgccctgggctgttgagaagagatcagtccacccagagttagacattgtttttgtagaaaacaggcatttattatgtctagggttttgtgttttttttttttccttacaggataaaagcctttatacagaaacaaaatggaacctttcatataaaaccttttctttaaaggctgtgtggttcgtatcatgaatgcccatcacgaggcaggattcgggcacatacctgtacttctgctccagagtgtgcgctccccaaatcccctgagtaaacctctctggactgctgctcagacacctgcgtcaggtggaggtgcctccccctctgtgggcaccagcttggggaggtaggtgacttttccttgcaaatctccctgcctcatctccagaaaattgcatacctgcatggcctctctgcattatttatgcaggaagagacacgaaacagcaatggccacatggtatgggggcctgctggcaccagaagtgaatgaaatcagaaccgtcccactgagtcttccaaaaggcacataattttttttttctgtcacctgcctttggtgacagggtcaaaggcacagattgaagagaaaatcttgatttgggagaagcatttatatccagatgcctacccttacactccctagcttactttctacataatttagttttaagagcaggaaatgcataacatggtttttagtcttaacaagcacttaaattcattagacgcatagaaaagaaccatttattattttattatttttatttttattttgagaggaagtctctgtcacccaggctggagtgcagtggcgcaatctcagttcactgcaacctccgcctcccaggttcaagtgattcccctgcctcagcctcccaagtagctgggactacaggcacccgccaccacgcccggctaatttttgtattttagtagagatggggttttaccatgttggtcaatatggtctcgatctcctgacctcgtgatctacccacctcggcctcccaaagtgctgtaacctaagcagacagttctgtgaatgcgtgaggaccacctgaagtctgcagccacggtggaggtcaccaaagggtgaactgagagagaagagggaattcacttgcccaaaggtttacagatgcccaggcaaactgatttttccatccagaattatcttgttctttaactctcctcaattgtcatatataaacatgaatttatata

SEQ ID NO: 312616 - DNA, 1721 bp, Homo sapiens
agtgctggcacgagggagagtcgaacccggagcagggtcccatccgagcgtggactggcggcaggatgttcagctggatggggcggcaggcgggcgggcgcgaacgcgctggcggcgcggacgcggtgcagacggtgacgggcgggctgcgctcgctctacctgcgcaaggtgctgccgctggaggaggcgtaccgcttccacgagttccactcgcctgcgctggaggacgccgacttcgagaacaagcctcttctacactctgtcgcccatcaatggcaagatatcaggtgtcaacgccaagaaggagatggtgacctccaagctgcccaacagcgtcctgggcaagatctggaagctggccgactgcgactgcgacggcatgcttgatgaggaggagttcgcgctggccaagcacctcatcaagatcaagctcgacggctacgagctgcccagcagcctgcccccccacctcgtgcccccctcgcacaggaagtccctgcccaaggccgactgaggggtgggctgcagaacggggtgggaactgggggacctgggcctcaggcctgctccaccactgactcaccgaatgaccttgggcaaggcactgccctctctgtgccttggtttccccatctgtagaatggggagggtggacactggaaactagatgacttctttcacctccaaaattcccttagtttctatgaaaatattgggggtaggggggtggattaggagattgaagggttgagaagaaagagaaattgtccaaagagtcctcagaacctgcctggagaaatgcgcatgggggtgggcctggtaagtcccaggaaccacaggaagtgagctaaggctcacccagagcagctgggtctccaggctgcctgggctttttgtcctcatgaacaactctggagcagctgtctgtccctcagagggcacctggaggcagcaaagattatcttatttattttattttgttttctgctatatttagagtggcaaaaaaatagagcagagggtttctgctgtctccagactgtctaccaaagagaaggcgacagatgcctcctgggtttggaagggggatgcactgtggatctgccatccattctgcagtctccagcagagcaggcagtcaggccccagcgtgcctccatcccagtgccccgatgaccatctggtcagccctcccaacctcccttccagggggcttaccagcaaagccatattcggctaggaatttggaattcacaacctttattaacccctggcaaaacttcccgtttgcatgtcaaatcacattgaagcctgaagattagcttttcttactggtttttccaataagtaatagcaaagcccacttatcatacttaaactacagtaaagaaaagaggtggttctctgcagtgatcgtttagtgtggccctcaaacattaaatatccccaggtctccttggtgggtggcaggatttaaattcaatcaaatcctgtcctagtgtgtgcagtgtcttcggccctgtggacacaggtgaatgagggaccagccctgccctgggctgttgagaagagatcagtccacccagagttagacattgtttttgtagaaaacaggcatttattatgtctagggttttgtgttttttttttttccttacaggataaaagcctttatacagaaacaaaatggaacctttcatataaaaccttttctttaaa

SEQ ID NO: 312617 - DNA, 694 bp, Homo sapiens
  misc_feature (2)..(2): n is a, c, g, or t
  misc_feature (6)..(7): n is a, c, g, or t
  misc_feature (10)..(10): n is a, c, g, or t
tnattnnctncctgcagtcgatctagaggatccccgagtgggtcagtgtcttctggaagggggatgcactgtggatctgccatccattctgcagtctccagcagagcaggcagtcaggccccagcgtgcctccatcccagtgccccgatgaccatctggtcagccctcccaacctcccttccagggggcttaccagcaaagccatattcggctaggaatttggaattcacaacctttattaacccctggcaaaacttcccgtttgcatgtcaaatcacattgaagcctgaagattagcttttcttactggtttttccaataagtaatagcaaagcccacttatcatacttaaactacagtaaagaaaagaggtggttctctgcagtgatcgtttagtgtggccctcaaacattaaatatccccaggtctccttggtgggtggcaggatttaaattcaatcaaatcctgtcctagtgtgtgcagtgtcttcggccctgtggacacaggtgaatgagggaccagccctgccctgggctgttgagaagagatcagtccacccagagttagacattgtttttgtagaaaacaggcatttattatgtctagggttttgtgttttttttttttccttacaggataaaagcctttatacagaaacaaaatggaacctttcatataaaaccttttctttaaa

SEQ ID NO: 312618 - DNA, 2055 bp, Homo sapiens
agtgctggcacgagggagagtcgaacccggagcagggtcccatccgagcgtggactggcggcaggatgttcagctggatggggcggcaggcgggcgggcgcgaacgcgctggcggcgcggacgcggtgcagacggtgacgggcgggctgcgctcgctctacctgcgcaaggtgctgccgctggaggaggcgtaccgcttccacgagttccactcgcctgcgctggaggacgccgacttcgagaacaagcccatgatcctgctggtgggccagtacagcaccggcaagaccaccttcatcagatacctactggagcaggatttcccaggcatgaggattggtccggagcccaccacagactccttcatcgccgtgatgtatggagagactgagggcagcaccccagggaatgctttagtcgtggaccccaaaaagccgtttagaaagctcagtcgctttggaaacgctttcctgaatcgattcatgtgctcacagctccccaatcaggtcctgaagagcatcagcgtcatcgacagccccggcatcctttctggggagaagcagcgcatcagccgaggctatgacttctgccaggtcctgcagtggtttgccgagagggtggacaggatcatcctgctctttgacgctcacaagctggacatctcagatgaattctcagaggccatcaaggccttccggggccaggacgacaagatccgtgtcgtgctgaacaaggccgaccaagtggacacgcagcagctgatgcgggtctacggggccctcatgtggtccctaggcaaggtcatcaacacgcccgaggtactgcgcgtctacattggctccttctgggcgcagcccctgcagaacacggacaaccgccggctcttcgaggctgaggcccaggacctctttagagacatccagagcctcccccagaaggcagcggtgcgcaagctcaacgacctcatcaagcgagcgaggctggccaaggtgcatgcctacatcatcagctacctgaagaaggagatgccaagtgtatttggaaaggaaaacaagaagagagagcttatcagcaggctaccggaaatctacattcagctacagcgagaataccagatttctgcaggggacttccctgaggtcaaggctatgcaggaacagcttgagaactatgacttcaccaaattccactcgctgaagcccaagctgatcgaggcagtggacaacatgctgagcaacaagatctcgcccctcatgaacctcatcagccaggaggagacgagcacgcccacgcagctggtgcagggcggcgccttcgatggcaccaccgagggccccttcaaccagggctacggggagggtgccaaggagggcgccgacgaggaggagtgggtcgtggccaaagacaagcccgtctacgacgagctcttctacactctgtcgcccatcaatggcaagatatcaggtgtcaacgccaagaaggagatggtgacctccaagctgcccaacagcgtcctgggcaagatctggaagctggccgactgcgactgcgacggcatgcttgatgaggaggagttcgcgctggccaagcacctcatcaagatcaagctcgacggctacgagctgcccagcagcctgcccccccacctcgtgcccccctcgcacaggaagtccctgcccaaggccgactgaggggtgggctgcagaacggggtgggaactgggggacctgggcctcaggcctgctccaccactgactcaccgaatgaccttgggcaaggcactgccctctctgtgccttggtttccccatctgtagaatggggagggtggacactggaaactagatgacttctttcacctccaaaattcccttagtttctatgaaaatattgggggtaggggggtggattaggagatggcaggacctggacccttgaagaccagctaaacgggaactggatagcaggcctgaagttagactggagtgaatggtaagagagcaccacggacagcatgcagcacgtaaaatggcagccacgcagacctatgatagga

SEQ ID NO: 312619 - DNA, 689 bp, Homo sapiens
aaagaaaaggttttatatgaaaggttccattttgtttctgtataaaggcttttatcctgtaaggaaaaaaaaaaaaacacaaaaccctagacataataaatgcctgttttctacaaaaacaatgtctaactctgggtggactgatctcttctcatcagccctcccaacctcccttccagggggcttaccagcaaagccatattcggctaggaatttggaattcacaacctttattaacccctggcaaaacttcccgtttgcatgtcaaatcacattgaagcctgaagattagcttttcttactggtttttccaataagtaatagcaaagcccacttatcatacttaaactacagtaaagaaaagaggtggttctctgcagtgatcgtttagtgtggccctcaaacattaaatatccccaggtctccttggtgggtggcaggatttaaattcaatcaaatcctgtcctagtgtgtgcagtgtcttcggccctgtggacacaggtgaatgagggaccagccctgccctgggctgttgagaagagatcagtccacccagagttagacattgtttttgtagaaaacaggcatttattatgtctagggttttgtgttttttttttttccttacaggataaaagcctttatacagaaacaaaatggaacctttcatataaaaccttttctttaaa

SEQ ID NO: 312620 - DNA, 1386 bp, Homo sapiens
caatggtacacttacctgtacccacccgggtgaaaatcgatggccccgggcgctccccaggtctccttggtgggtggcaggatttaaattcaatcaaatcctgtcctagtgtgtgcagtgtcttcggccctgtggacacaggtgaatgagggaccagccctgccctgggctgttgagaagagatcagtccacccagagttagacattgtttttgtagaaaacaggcatttattatgtctagggttttgtgttttttttttttccttacaggataaaagcctttatacagaaacaaaatggaacctttcatataaaaccttttctttaaaggctgtgtggttcgtatcatgaatgcccatcacgaggcaggattcgggcacatacctgtacttctgctccagagtgtgcgctccccaaatcccctgagtaaacctctctggactgctgctcagacacctgcgtcaggtggaggtgcctccccctctgtgggcaccagcttggggaggtaggtgacttttccttgcaaatctccctgcctcatctccagaaaattgcatacctgcatggcctctctgcattatttatgcaggaagagacacgaaacagcaatggccacatggtatgggggcctgctggcaccagaagtgaatgaaatcagaaccgtcccactgagtcttccaaaaggcacataattttttttttctgtcacctgcctttggtgacagggtcaaaggcacagattgaagagaaaatcttgatttgggagaagcatttatatccagatgcctacccttacactccctagcttactttctacataatttagttttaagagcaggaaatgcataacatggtttttagtcttaacaagcacttaaattcattagacgcatagaaaagaaccatttattattttattatttttatttttattttgagaggaagtctctgtcacccaggctggagtgcagtggcgcaatctcagttcactgcaacctccgcctcccaggttcaagtgattcccctgcctcagcctcccaagtagctgggactacaggcacccgccaccacgcccggctaatttttgtattttagtagagatggggttttaccatgttggtcaatatggtctcgatctcctgacctcgtgatctacccacctcggcctcccaaagtgctgtaacctaagcagacagttctgtgaatgcgtgaggaccacctgaagtctgcagccacggtggaggtcaccaaagggtgaactgagagagaagagggaattcacttgcccaaaggtttacagatgcccaggcaaactgatttttccatccagaattatcttgttctttaactctcctcaattgtcatatataaacatgaatttatata

SEQ ID NO: 312621 - DNA, 2086 bp, Homo sapiens
agtgctggcacgagggagagtcgaacccggagcagggtcccatccgagcgtggactggcggcaggatgttcagctggatggggcggcaggcgggcgggcgcgaacgcgctggcggcgcggacgcggtgcagacggtgcgcaagctcaacgacctcatcaagcgagcgaggctggccaaggtgcatgcctacatcatcagctacctgaagaaggagatgccaagtgtatttggaaaggaaaacaagaagagagagcttatcagcaggctaccggaaatctacattcagctacagcgagaataccagatttctgcaggggacttccctgaggtcaaggctatgcaggaacagcttgagaactatgacttcaccaaattccactcgctgaagcccaagctgatcgaggcagtggacaacatgctgagcaacaagatctcgcccctcatgaacctcatcagccaggaggagacgagcacgcccacgcagctggtgcagggcggcgccttcgatggcaccaccgagggccccttcaaccagggctacggggagggtgccaaggagggcgccgacgaggaggagtgggtcgtggccaaagacaagcccgtctacgacgagctcttctacactctgtcgcccatcaatggcaagatatcaggtgtcaacgccaagaaggagatggtgacctccaagctgcccaacagcgtcctgggcaagatctggaagctggccgactgcgactgcgacggcatgcttgatgaggaggagttcgcgctggccaagcacctcatcaagatcaagctcgacggctacgagctgcccagcagcctgcccccccacctcgtgcccccctcgcacaggaagtccctgcccaaggccgactgaggggtgggctgcagaacggggtgggaactgggggacctgggcctcaggcctgctccaccactgactcaccgaatgaccttgggcaaggcactgccctctctgtgccttggtttccccatctgtagaatggggagggtggacactggaaactagatgacttctttcacctccaaaattcccttagtttctatgaaaatattgggggtaggggggtggattaggagattgaagggttgagaagaaagagaaattgtccaaagagtcctcagaacctgcctggagaaatgcgcatgggggtgggcctggtaagtcccaggaaccacaggaagtgagctaaggctcacccagagcagctgggtctccaggctgcctgggctttttgtcctcatgaacaactctggagcagctgtctgtccctcagagggcacctggaggcagcaaagattatcttatttattttattttgttttctgctatatttagagtggcaaaaaaatagagcagagggtttctgctgtctccagactgtctaccaaagagaaggcgacagatgcctcctgggtttggaagggggatgcactgtggatctgccatccattctgcagtctccagcagagcaggcagtcaggccccagcgtgcctccatcccagtgccccgatgaccatctggtcagccctcccaacctcccttccagggggcttaccagcaaagccatattcggctaggaatttggaattcacaacctttattaacccctggcaaaacttcccgtttgcatgtcaaatcacattgaagcctgaagattagcttttcttactggtttttccaataagtaatagcaaagcccacttatcatacttaaactacagtaaagaaaagaggtggttctctgcagtgatcgtttagtgtggccctcaaacattaaatatccccaggtctccttggtgggtggcaggatttaaattcaatcaaatcctgtcctagtgtgtgcagtgtcttcggccctgtggacacaggtgaatgagggaccagccctgccctgggctgttgagaagagatcagtccacccagagttagacattgtttttgtagaaaacaggcatttattatgtctagggttttgtgttttttttttttccttacaggataaaagcctttatacagaaacaaaatggaacctttcatataaaaccttttctttaaa

SEQ ID NO: 312622 - DNA, 3953 bp, Homo sapiens
agtgctggcacgagggagagtcgaacccggagcagggtcccatccgagcgtggactggcggcaggatgttcagctggatggggcggcaggcgggcgggcgcgaacgcgctggcggcgcggacgcggtgcagacggtgacgggcgggctgcgctcgctctacctgcgcaaggtgctgccgctggaggaggcgtaccgcttccacgagttccactcgcctgcgctggaggacgccgacttcgagaacaagcccatgatcctgctggtgggccagtacagcaccggcaagaccaccttcatcagatacctactggagcaggatttcccaggcatgaggattggtccggagcccaccacagactccttcatcgccgtgatgtatggagagactgagggcagcaccccagggaatgctttagtcgtggaccccaaaaagccgtttagaaagctcagtcgctttggaaacgctttcctgaatcgattcatgtgctcacagctccccaatcaggtcctgaagagcatcagcgtcatcgacagccccggcatcctttctggggagaagcagcgcatcagccgaggctatgacttctgccaggtcctgcagtggtttgccgagagggtggacaggatcatcctgctctttgacgctcacaagctggacatctcagatgaattctcagaggccatcaaggccttccggggccaggacgacaagatccgtgtcgtgctgaacaaggccgaccaagtggacacgcagcagctgatgcgggtctacggggccctcatgtggtccctaggcaaggtcatcaacacgcccgaggtactgcgcgtctacattggctccttctgggcgcagcccctgcagaacacggacaaccgccggctcttcgaggctgaggcccaggacctctttagagacatccagagcctcccccagaaggcagcggtgcgcaagctcaacgacctcatcaagcgagcgaggctggccaaggtgcatgcctacatcatcagctacctgaagaaggagatgccaagtgtatttggaaaggaaaacaagaagagagagcttatcagcaggctaccggaaatctacattcagctacagcgagaataccagatttctgcaggggacttccctgaggtcaaggctatgcaggaacagcttgagaactatgacttcaccaaattccactcgctgaagcccaagctgatcgaggcagtggacaacatgctgagcaacaagatctcgcccctcatgaacctcatcagccaggaggagacgagcacgcccacgcagctggtgcagggcggcgccttcgatggcaccaccgagggccccttcaaccagggctacggggagggtgccaaggagggcgccgacgaggaggagtgggtcgtggccaaagacaagcccgtctacgacgagctcttctacactctgtcgcccatcaatggcaagatatcaggtgtcaacgccaagaaggagatggtgacctccaagctgcccaacagcgtcctgggcaagatctggaagctggccgactgcgactgcgacggcatgcttgatgaggaggagttcgcgctggccaagcacctcatcaagatcaagctcgacggctacgagctgcccagcagcctgcccccccacctcgtgcccccctcgcacaggaagtccctgcccaaggccgactgaggggtgggctgcagaacggggtgggaactgggggacctgggcctcaggcctgctccaccactgactcaccgaatgaccttgggcaaggcactgccctctctgtgccttggtttccccatctgtagaatggggagggtggacactggaaactagatgacttctttcacctccaaaattcccttagtttctatgaaaatattgggggtaggggggtggattaggagattgaagggttgagaagaaagagaaattgtccaaagagtcctcagaacctgcctggagaaatgcgcatgggggtgggcctggtaagtcccaggaaccacaggaagtgagctaaggctcacccagagcagctgggtctccaggctgcctgggctttttgtcctcatgaacaactctggagcagctgtctgtccctcagagggcacctggaggcagcaaagattatcttatttattttattttgttttctgctatatttagagtggcaaaaaaatagagcagagggtttctgctgtctccagactgtctaccaaagagaaggcgacagatgcctcctgggtttggaagggggatgcactgtggatctgccatccattctgcagtctccagcagagcaggcagtcaggccccagcgtgcctccatcccagtgccccgatgaccatctggtcagccctcccaacctcccttccagggggcttaccagcaaagccatattcggctaggaatttggaattcacaacctttattaacccctggcaaaacttcccgtttgcatgtcaaatcacattgaagcctgaagattagcttttcttactggtttttccaataagtaatagcaaagcccacttatcatacttaaactacagtaaagaaaagaggtggttctctgcagtgatcgtttagtgtggccctcaaacattaaatatccccaggtctccttggtgggtggcaggatttaaattcaatcaaatcctgtcctagtgtgtgcagtgtcttcggccctgtggacacaggtgaatgagggaccagccctgccctgggctgttgagaagagatcagtccacccagagttagacattgtttttgtagaaaacaggcatttattatgtctagggttttgtgttttttttttttccttacaggataaaagcctttatacagaaacaaaatggaacctttcatataaaaccttttctttaaaggctgtgtggttcgtatcatgaatgcccatcacgaggcaggattcgggcacatacctgtacttctgctccagagtgtgcgctccccaaatcccctgagtaaacctctctggactgctgctcagacacctgcgtcaggtggaggtgcctccccctctgtgggcaccagcttggggaggtaggtgacttttccttgcaaatctccctgcctcatctccagaaaattgcatacctgcatggcctctctgcattatttatgcaggaagagacacgaaacagcaatggccacatggtatgggggcctgctggcaccagaagtgaatgaaatcagaaccgtcccactgagtcttccaaaaggcacataattttttttttctgtcacctgcctttggtgacagggtcaaaggcacagattgaagagaaaatcttgatttgggagaagcatttatatccagatgcctacccttacactccctagcttactttctacataatttagttttaagagcaggaaatgcataacatggtttttagtcttaacaagcacttaaattcattagacgcatagaaaagaaccatttattattttattatttttatttttattttgagaggaagtctctgtcacccaggctggagtgcagtggcgcaatctcagttcactgcaacctccgcctcccaggttcaagtgattcccctgcctcagcctcccaagtagctgggactacaggcacccgccaccacgcccggctaatttttgtattttagtagagatggggttttaccatgttggtcaatatggtctcgatctcctgacctcgtgatctacccacctcggcctcccaaagtgctgtaacctaagcagacagttctgtgaatgcgtgaggaccacctgaagtctgcagccacggtggaggtcaccaaagggtgaactgagagagaagagggaattcacttgcccaaaggtttacagatgcccaggcaaactgatttttccatccagaattatcttgttctttaactctcctcaattgtcatatataaacatgaatttatata

SEQ ID NO: 312623 - DNA, 3529 bp, Homo sapiens
agtgctggcacgagggagagtcgaacccggagcagggtcccatccgagcgtggactggcggcaggatgttcagctggatggggcggcaggcgggcgggcgcgaacgcgctggcggcgcggacgcggtgcagacggtgacgggcgggctgcgctcgctctacctgcgcaaggtgctgccgctggaggaggcgtaccgcttccacgagttccactcgcctgcgctggaggacgccgacttcgagaacaagcccatgatcctgctggtgggccagtacagcaccggcaagaccaccttcatcagatacctactggagcaggatttcccaggcatgaggattggtccggagcccaccacagactccttcatcgccgtgatgtatggagagactgagggcagcaccccagggaatgctttagtcgtggaccccaaaaagccgtttagaaagctcagtcgctttggaaacgctttcctgaatcgattcatgtgctcacagctccccaatcaggtcctgaagagcatcagcgtcatcgacagccccggcatcctttctggggagaagcagcgcatcagccgaggctatgacttctgccaggtcctgcagtggtttgccgagagggtggacaggatcatcctgctctttgacgctcacaagctggacatctcagatgaattctcagaggccatcaaggccttccggggccaggacgacaagatccgtgtcgtgctgaacaaggccgaccaagtggacacgcagcagctgatgcgggtctacggggccctcatgtggtccctaggcaaggtcatcaacacgcccgaggtactgcgcgtctacattggctccttctgggcgcagcccctgcagaacacggacaaccgccggctcttcgaggctgaggcccaggacctctttagagacatccagagcctcccccagaaggcagcggtgcgcaagctcaacgacctcatcaagcgagcgaggctggccaaggtgcatgcctacatcatcagctacctgaagaaggagatgccaagtgtatttggaaaggaaaacaagaagagagagcttatcagcaggctaccggaaatctacattcagctacagcgagaataccagatttctgcaggggacttccctgaggtcaaggctatgcaggaacagcttgagaactatgacttcaccaaattccactcgctgaagcccaagctgatcgaggcagtggacaacatgctgagcaacaagatctcgcccctcatgaacctcatcagccaggaggagacgagcacgcccacgcagctggtgcagggcggcgccttcgatggcaccaccgagggccccttcaaccagggctacggggagggtgccaaggagggcgccgacgaggaggagtgggtcgtggccaaagacaagcccgtctacgacgagctcttctacactctgtcgcccatcaatggcaagatatcaggtgtcaacgccaagaaggagatggtgacctccaagctgcccaacagcgtcctgggcaagatctggaagctggccgactgcgactgcgacggcatgcttgatgaggaggagttcgcgctggccaagcacctcatcaagatcaagctcgacggctacgagctgcccagcagcctgcccccccacctcgtgcccccctcgcacaggaagtccctgcccaaggccgactgaggggtgggctgcagaacggggtgggaactgggggacctgggcctcaggcctgctccaccactgactcaccgaatgaccttgggcaaggcactgccctctctgtgccttggtttccccatctgtagaatggggagggtggacactggaaactagatgacttctttcacctccaaaattcccttagtttctatgaaaatattgggggtaggggggtggattaggagattgaagggttgagaagaaagagaaattgtccaaagagtcctcagaacctgcctggagaaatgcgcatgggggtgggcctggtaagtcccaggaaccacaggaagtgagctaaggctcacccagagcagctgggtctccaggctgcctgggctttttgtcctcatgaacaactctggagcagctgtctgtccctcagagggcacctggaggcagcaaagattatcttatttattttattttgttttctgctatatttagagtggcaaaaaaatagagcagagggtttctgctgtctccagactgtctaccaaagagaaggcgacagatgcctcctgggtttggaagggggatgcactgtggatctgccatccattctgcagtctccagcagagcaggcagtcaggccccagcgtgcctccatcccagtgccccgatgaccatctggtcagccctcccaacctcccttccagggggcttaccagcaaagccatattcggctaggaatttggaattcacaacctttattaacccctggcaaaacttcccgtttgcatgtcaaatcacattgaagcctgaagattagcttttcttactggtttttccaataagtaatagcaaagcccacttatcatacttaaactacagtaaagaaaagaggtggttctctgcagtgatcgtttagtgtggccctcaaacattaaatatccccaggtctccttggtgggtggcaggatttaaattcaatcaaatcctgtcctagtgtgtgcagtgtcttcggccctgtggacacaggtgaatgagggaccagccctgccctgggctgttgagaagagatcagtccacccagagttagacattgtttttgtagaaaacaggcatttattatgtctagggttttgtgttttttttttttccttacaggataaaagcctttatacagaaacaaaatggaacctttcatataaaaccttttctttaaaaaaaaaaaaaaaaaaaaaaaaaaaaaaaaaaaaaaaaaaagggggggatttggggggggggaaaaaggaaaaggggaggaaggtgtcacacagagcaccaagacttttttgtaacaacagggtagaagactatcgagcgcgggcaccccaataaaagggaaggcagcaaaatatacgcgaaagacaccaggaggtaacccttgtttaatagctcctgggaccacaaacaccaagaaaaccaacgaaagaaaaacgatacgagcaagaaggacaacacagagacagcaatatgacaacgacaagcaccgagtactaaacagacaaacacaacagacagagcagacaccgacgaaaaacagagaggagcagccagaaagagcacaaacagaagacgacaaggaaacagaggagaaaagaaaaaagagacacaacaaaaagaaggaagaagaagaacaagaaaccaaaaagaaaaggaaaaagaacaagcaacgcgaaaaacagacagaacacaggaaccaaggacgagagaagaagaacagcggaaaaaacaaaagcagctcacagacacaacaccaaggaagaaaaacgaagcagaaagcaaaaacagagcaagagacgcaacacgcgagacca

SEQ ID NO: 312624 - DNA, 2559 bp, Homo sapiens
gcatgccatccatagactattttatcgactctgactgtatagacatactagactgtgcagacacgccaggcaatgcttacttcttaattggaaaaaccctgccggaaaactcagtcgctttggaaacgctttcctgaatcgattcatgtgctcacagctccccaatcaggtcctgaagagcatcagcgtcatcgacagccccggcatcctttctggggagaagcagcgcatcagccgaggctatgacttctgccaggtcctgcagtggtttgccgagagggtggacaggatcatcctgctctttgacgctcacaagctggacatctcagatgaattctcagaggccatcaaggccttccggggccaggacgacaagatccgtgtcgtgctgaacaaggccgaccaagtggacacgcagcagctgatgcgggtctacggggccctcatgtggtccctaggcaaggtcatcaacacgcccgaggtactgcgcgtctacattggctccttctgggcgcagcccctgcagaacacggacaaccgccggctcttcgaggctgaggcccaggacctctttagagacatccagagcctcccccagaaggcagcggtgcgcaagctcaacgacctcatcaagcgagcgaggctggccaaggtgcatgcctacatcatcagctacctgaagaaggagatgccaagtgtatttggaaaggaaaacaagaagagagagcttatcagcaggctaccggaaatctacattcagctacagcgagaataccagatttctgcaggggacttccctgaggtcaaggctatgcaggaacagcttgagaactatgacttcaccaaattccactcgctgaagcccaagctgatcgaggcagtggacaacatgctgagcaacaagatctcgcccctcatgaacctcatcagccaggaggagacgagcacgcccacgcagctggtgcagggcggcgccttcgatggcaccaccgagggccccttcaaccagggctacggggagggtgccaaggagggcgccgacgaggaggagtgggtcgtggccaaagacaagcccgtctacgacgagctcttctacactctgtcgcccatcaatggcaagatatcaggtgtcaacgccaagaaggagatggtgacctccaagctgcccaacagcgtcctgggcaagatctggaagctggccgactgcgactgcgacggcatgcttgatgaggaggagttcgcgctggccaagcacctcatcaagatcaagctcgacggctacgagctgcccagcagcctgcccccccacctcgtgcccccctcgcacaggaagtccctgcccaaggccgactgaggggtgggctgcagaacggggtgggaactgggggacctgggcctcaggcctgctccaccactgactcaccgaatgaccttgggcaaggcactgccctctctgtgccttggtttccccatctgtagaatggggagggtggacactggaaactagatgacttctttcacctccaaaattcccttagtttctatgaaaatattgggggtaggggggtggattaggagattgaagggttgagaagaaagagaaattgtccaaagagtcctcagaacctgcctggagaaatgcgcatgggggtgggcctggtaagtcccaggaaccacaggaagtgagctaaggctcacccagagcagctgggtctccaggctgcctgggctttttgtcctcatgaacaactctggagcagctgtctgtccctcagagggcacctggaggcagcaaagattatcttatttattttattttgttttctgctatatttagagtggcaaaaaaatagagcagagggtttctgctgtctccagactgtctaccaaagagaaggcgacagatgcctcctgggtttggaagggggatgcactgtggatctgccatccattctgcagtctccagcagagcaggcagtcaggccccagcgtgcctccatcccagtgccccgatgaccatctggtcagccctcccaacctcccttccagggggcttaccagcaaagccatattcggctaggaatttggaattcacaacctttattaacccctggcaaaacttcccgtttgcatgtcaaatcacattgaagcctgaagattagcttttcttactggtttttccaataagtaatagcaaagcccacttatcatacttaaactacagtaaagaaaagaggtggttctctgcagtgatcgtttagtgtggccctcaaacattaaatatccccaggtctccttggtgggtggcaggatttaaattcaatcaaatcctgtcctagtgtgtgcagtgtcttcggccctgtggacacaggtgaatgagggaccagccctgccctgggctgttgagaagagatcagtccacccagagttagacattgtttttgtagaaaacaggcatttattatgtctagggttttgtgttttttttttttccttacaggataaaagcctttatacagaaacaaaatggaacctttcatataaaaccttttctttaaa

SEQ ID NO: 312625 - DNA, 1192 bp, Homo sapiens
agtgctggcacgagggagagtcgaacccggagcagggtcccatccgagcgtggactggcggcaggatgttcagctggatggggcggcaggcgggcgggcgcgaacgcgctggcggcgcggacgcggtgcagacggtgacgggcgggctgcgctcgctctacctgcgcaaggtgctgccgctggaggaggcgtaccgcttccacgagttccactcgcctgcgctggaggacgccgacttcgagaacaagcccatgatcctgctggtgggccagtacagcaccggcaagaccaccttcatcagatacctactggagcaggatttcccaggcatgaggattggtccggagcccaccacagactccttcatcgccgtgatgtatggagagactgagggcagcaccccagggaatgctttagtcgtggaccccaaaaagccgtttagaaagctcagtcgctttggaaacgctttcctgaatcgattcatgtgctcacagctccccaatcaggtcctgaagagcatcagcgtcatcgacagccccggcatcctttctggggagaagcagcgcatcagccgaggctatgacttctgccaggtcctgcagtggtttgccgagagggtggacaggatcatcctgctctttgacgctcacaagctggtcagccctcccaacctcccttccagggggcttaccagcaaagccatattcggctaggaatttggaattcacaacctttattaacccctggcaaaacttcccgtttgcatgtcaaatcacattgaagcctgaagattagcttttcttactggtttttccaataagtaatagcaaagcccacttatcatacttaaactacagtaaagaaaagaggtggttctctgcagtgatcgtttagtgtggccctcaaacattaaatatccccaggtctccttggtgggtggcaggatttaaattcaatcaaatcctgtcctagtgtgtgcagtgtcttcggccctgtggacacaggtgaatgagggaccagccctgccctgggctgttgagaagagatcagtccacccagagttagacattgtttttgtagaaaacaggcatttattatgtctagggttttgtgttttttttttttccttacaggataaaagcctttatacagaaacaaaatggaacctttcatataaaaccttttctttaaa

SEQ ID NO: 312626 - DNA, 1612 bp, Homo sapiens
agtgctggcacgagggagagtcgaacccggagcagggtcccatccgagcgtggactggcggcaggatgttcagctggatggggcggcaggcgggcgggcgcgaacgcgctggcggcgcggacgcggtgcagacggtgacgggcgggctgcgctcgctctacctgcgcaaggtgctgccgctggaggaggcgtaccgcttccacgagttccactcgcctgcgctggaggacgccgacttcgagaacaagcccatgatcctgctggtgggccagtacagcaccggcaagaccaccttcatcagatacctactggagcaggatttcccaggcatgaggattggtccggagcccaccacagactccttcatcgccgtgatgtatggagagactgagggcagcaccccagggaatgctttagtcgtggaccccaaaaagccgtttagaaagctcagtcgctttggaaacgctttcctgaatcgattcatgtgctcacagctccccaatcaggtcctgaagagcatcagcgtcatcgacagccccggcatcctttctggggagaagcagcgcatcagccgaggctatgacttctgccaggtcctgcagtggtttgccgagagggtggacaggatcatcctgctctttgacgctcacaagctggacatctcagatgaattctcagaggccatcaaggccttccggggccaggacgacaagatccgtgtcgtgctgaacaaggccgaccaagtggacacgcagcagctgatgcgggtctacggggccctcatgtggtccctaggcaaggtcatcaacacgcccgaggtactgcgcgtctacattggctccttctgggcgcagcccctgcagaacacggacaaccgccggctcttcgaggctgaggcccaggacctctttagagacatccagagcctcccccagaaggcagcggtgcgcaagctcaacgacctcatcaagcgagcgaggctggccaaggtgcatgcctacatcatcagctacctgaagaaggagatgccaagtgtatttggaaaggaaaacaagaagagagagcttatcagcaggctaccggaaatctacattcagctacagcgagaataccagatttctgcaggggacttccctgaggtcaaggctatgcaggaacagcttgagaactatgacttcaccaaattccactcgctgaagcccaagctgatcgaggcagtggacaacatgctgagcaacaagatctcgcccctcatgaacctcatcagccaggaggagacgagcacgcccacgcagctggtgcagggcggcgccttcgatggcaccaccgagggccccttcaaccagggctacggggagggtgccaaggagggcgccgacgaggaggagtgggtcgtggccaaagacaagcccgtctacgacgagctcttctacactctgtcgcccatcaatggcaagatatcaggtgtcaacgccaaagggtgaactgagagagaagagggaattcacttgcccaaaggtttacagatgcccaggcaaactgatttttccatccagaattatcttgttctttaactctcctcaattgtcatatataaacatgaatttatata

SEQ ID NO: 312627 - DNA, 3410 bp, Homo sapiens
agctggcgacggcggcggcagcggcagaggtggcggcggcgtgtccgtgagagtggcgtgggggcggggaggagaggcggcggcggcagtgtccaagctacgccactcgggctggggcgttgggagcgggagtgcagagcgtggtcgtggcggcggcggtgagaagagcgaggcggaggagggggtgccatggccgggcagcagttccagtacgatgacagtgggaacaccttcttctacttcctcacctccttcgtggggctcatcgtgatcccggcgacatactacctctggccccgagatcagaatgccgagcaaattcgattaaagaatatcagaaaagtatatggaaggtgtatgtggtatcgtttacggttattaaaaccccagccaaatattattcctacagtaaagaaaatagttctgcttgcaggatgggcattgttcttattccttgcatataaagtttccaaaacagaccgagaataccaagaatacaatccttatgaagtattaaatttggatcctggagccacagtagcagaaattaaaaaacaatatcgtttgctgtcacttaaatatcatccagataaaggaggtgatgaggttatgttcatgaggatagcaaaagcttatgctgctttaacggatgaagagtcccggaaaaattgggaagaatttggaaatccagatgggcctcaagccacaagctttggaattgccctgccagcttggatagttgaccagaaaaattcaattctggttttacttgtatatggattggcatttatggttatccttccagttgttgtgggctcttggtggtatcgctcaatacgctatagtggagaccagattctaatacgcacaacacagatttatacatactttgtttataaaacccgaaatatggatatgaaacgtcttatcatggttttggctggagcttctgaatttgatcctcagtataataaagatgccacaagcagaccaacggataatattctaataccacagctaatcagagaaattggcagcattaatttaaagaagaatgagcctccacttacctgcccatatagcctgaaggccagagttcttttactgtctcatcttgctagaatgaaaattcctgagacccttgaagaagatcagcaattcatgctaaaaaagtgtcctgccctacttcaagaaatggttaatgtaatctgccaactaatagtaatggcccggaaccgtgaagaaagggagtttcgtgctccaactttggcatccctagaaaactgcatgaagctttctcagatggccgttcagggacttcagcaatttaagtctccccttctgcagctccctcatattgaagaggacaatcttagacgggtttctaatcataagaagtataaaattaaaactatccaggatttggtgagtttaaaagaatcagatcgtcacactctactgcacttccttgaagatgaaaaatatgaagaggttatggctgtccttgggagttttccatatgtgaccatggatataaaatcacaggtgttagatgatgaagatagcaacaacatcacagtaggatccttagttacagtgttggttaagttgacaaggcaaacaatggctgaagtatttgaaaaggagcagtccatctgtgctgcagaggaacagccagcagaagatgggcagggtgaaactaacaagaacaggacaaaaggaggatggcaacagaagagtaaaggacccaagaaaactgctaaatcaaaaaaaaagaaacctttaaaaaaaaaacctacacctgtgctattaccacagtcaaagcaacagaaacaaaagcaggcaaatggagtcgttgggaatgaagctgcagtaaaggaagatgaagaagaagtttcagataagggcagtgattctgaagaagaagaaaccaatagagattcccaaagtgagaaagatgatggtagtgacagagactctgatagagagcaagatgaaaaacaaaacaaagatgatgaagcagagtggcaagaattacaacaaagcatacagcgaaaagagagagctctattggaaaccaaatcaaaaataacacatcctgtgtatagcctttactttcctgaggaaaaacaagaatggtggtggctttacattgcagataggaaggagcagacattaatatccatgccatatcatgtgtgtacgctgaaagatacagaggaggtagagctgaagtttcctgcaccaggcaagcctggaaattatcagtatactgtgtttctgagatcagactcctatatgggtttggatcagattaaaccattgaagttggaagttcatgaggctaagcctgtgccagaaaatcacccacagtgggatacagcaatagagggggatgaagaccaggaggacagtgagggctttgaagatagctttgaggaagaagaggaggaagaagaagatgatgactaagcagtactctgaatggaccacagtgtttgcacatatttgcaattttttgctgttttggaagtgtatcataaaccagaaacagtacagaactgatgttgagggaggtgtagtttttttactctagaaatgggtgcataatataactaggcagtggcggtgccttggtacaacctgaaaaatgttaaggcttattgaaacctttcaagtaggggatggtacatttatttcatctgcaaatgataataaatcctttgttattataactgtccagaagtgtgggctatgtattatctgatcagtctatggtcccagtaaaagtaaagatgcaggaaacacagtctgtaaatgagcgacttttctttgttcagctttagttttagcaaacaccacaaatatgttttaagtaacatcgctcaagtttaagtaacatcgctcaagttgataatctcttgataagctctgttgttgacattttgcagtgatacaacagctccactcatagatttaaacttttatttttacttatcttggtcataagttggcattctctcacattccacatgatatagagggctacgttttggaattttccttttcttaattgcccagagttatcagacagattataaaaatggcttttaatggcttaaaccatttctaaacctctatcttagcagatcaatgcaggatctaattcttttgataagttctagctctaaaagtgatagtgggactgtatgttttctgatactggtggcttatgttattaaaccttttttaaaaaaggttcactctaaaagctgaactacatccttagttttcagtctacttgactctatcaggagctttttaaggaaagtaagtataacatgcaaaggaagctttttttgtattcattttggactcctgtcaataaaaatagaagtttgttgactcgt

SEQ ID NO: 312628 - DNA, 1784 bp, Homo sapiens
agctggcgacggcggcggcagcggcagaggtggcggcggcgtgtccgtgagagtggcgtgggggcggggaggagaggcggcggcggcagtgtccaagctacgccactcgggctggggcgttgggagcgggagtgcagagcgtggtcgtggcggcggcggtgagaagagcgaggcggaggagggggtgccatggccgggcagcagttccagtacgatgacagtgggaacaccttcttctacttcctcacctccttcgtggggctcatcgtgatcccggcgacatactacctctggccccgagatcagaatgccgagcaaattcgattaaagaatatcagaaaagtatatggaaggtgtatgtggtatcgtttacggttattaaaaccccagccaaatattattcctacagtaaagaaaatagttctgcttgcaggatgggcattgttcttattccttgcatataaagtttccaaaacagaccgagaataccaagaatacaatccttatgaagtattaaatttggatcctggagccacagtagcagaaattaaaaaacaatatcgtttgctgtcacttaaatatcatccagataaaggaggtgatgaggttatgttcatgaggatagcaaaagcttatgctgctttaacggatgaagagtcccggaaaaattgggaagaatttggaaatccagatgggcctcaagccacaagctttggaattgccctgccagcttggatagttgaccagaaaaattcaattctggttttacttgtatatggattggcatttatggttatccttccagttgttgtgggctcttggtggtatcgctcaatacgctatagtggagaccagattctaatacgcacaacacagatttatacatactttgtttataaaacccgaaatatggatatgaaacgtcttatcatggttttggctggagcttctgaatttgatcctcagtataataaagatgccacaagcagaccaacggataatattctaataccacagctaatcagagaaattggcagcattaatttaaagaagaatgagcctccacttacctgcccatatagcctgaaggccagagttcttttactgtctcatcttgctagaatgaaaattcctgagacccttgaagaagatcagcaattcatgctaaaaaagtgtcctgccctacttcaagaaatggttaatgtaatctgccaactaatagtaatggcccggaaccgtgaagaaagggagtttcgtgctccaactttggcatccctagaaaactgcatgaagctttctcagatggccgttcagggacttcagcaatttaagtctccccttctgcagctccctcatattgaagaggacaatcttagacgggtttctaatcataagaagtataaaattaaaactatccaggatttggtgagtttaaaagaatcagatcgtcacactctactgcacttccttgaagatgaaaaatatgaagaggttatggctgtccttgggagttttccatatgtgaccatggatataaaatcacaggtgttagatgatgaagatagcaacaacatcacagtaggatccttagttacagtgttggttaagttgacaaggcaaacaatggctgaagtatttgaaaaggagcagtccatctgtgctgcagaggaacagccagcagaagatgggcagggtgaaactaacaagaacaggacaaaaggaggatggcaacagaagagtaaaggacccaagaaaactgctaaatcaaaaaaaaagaaaccttt

SEQ ID NO: 312629 - DNA, 643 bp, Homo sapiens
agctggcgacggcggcggcagcggcagaggtggcggcggcgtgtccgtgagagtggcgtgggggcggggaggagaggcggcggcggcagtgtccaagctacgccactcgggctggggcgttgggagcgggagtgcagagcgtggtcgtggcggcggcggtgagaagagcgaggcggaggagggggtgccatggccgggcagcagttccagtacgatgacagtgggaacaccttcttctacttcctcacctccttcgtggggctcatcgtgatcccggcgacatactacctctggccccgagatcagaatgccgcggggagagtctcatttacccaggctggtcttgaacttgcttcaagtcatcctcccgcttcagccccccgagtagctggccttacagacttgagccactgtgtcaggatggatttttgaaatttgaaagtcatattttcatgcccagttgcagtatcttgaatatgaaagagaaatcttgaattactgcctcattcaaagctctgaataaggaacttttttcagaagtttgctgcaaaataatttgccgacttgtactgacaggaggctactgaataatctttatctcacttaataaatagttatgttctgtcttggaatattaatttgt

SEQ ID NO: 312630 - DNA, 347 bp, Homo sapiens
tggagacagagtctcactctgtcgcctaggctggagtgcagtggcgcgatcttggctcactgcaacctccgcctcccagggtcaagtgattctcctgcctcagcctcctgagtagctgggactatttttagtagagacggggtttgatccttagttacagtgttggttaagttgacaaggcaaacaatggctgaagtatttgaaaaggagcagtccatctgtgctgcagaggaacagccagcagaagatgggcagggtgaaactaacaagaacaggacaaaaggaggatggcaacagaagagtaaaggacccaagaaaactgctaaatcaaaaaaaaagaaaccttt

SEQ ID NO: 312631 - DNA, 247 bp, Homo sapiens
aggtcaacttgatagacaagcagctgaaaccaggtattcctcagattattccttagaaagttaacctttgatttgaggattctttgagccagatttaatttattgtgattattttttgatatttatttatttttatcttcattttttgagagacgaagtctcactctgtcagctaggctggagctgcagtgagccgtgaccatgccactgcagcccaacttcgatgacagtaatactccatctctaa

SEQ ID NO: 312632 - DNA, 6461 bp, Homo sapiens
  misc_feature (6415)..(6415): n is a, c, g, or t
  misc_feature (6440)..(6440): n is a, c, g, or t
agctggcgacggcggcggcagcggcagaggtggcggcggcgtgtccgtgagagtggcgtgggggcggggaggagaggcggcggcggcagtgtccaagctacgccactcgggctggggcgttgggagcgggagtgcagagcgtggtcgtggcggcggcggtgagaagagcgaggcggaggagggggtgccatggccgggcagcagttccagtacgatgacagtgggaacaccttcttctacttcctcacctccttcgtggggctcatcgtgatcccggcgacatactacctctggccccgagatcagaatgccgagcaaattcgattaaagaatatcagaaaagtatatggaaggtgtatgtggtatcgtttacggttattaaaaccccagccaaatattattcctacagtaaagaaaatagttctgcttgcaggatgggcattgttcttattccttgcatataaagtttccaaaacagaccgagaataccaagaatacaatccttatgaagtattaaatttggatcctggagccacagtagcagaaattaaaaaacaatatcgtttgctgtcacttaaatatcatccagataaaggaggtgatgaggttatgttcatgaggatagcaaaagcttatgctgctttaacggatgaagagtcccggaaaaattgggaagaatttggaaatccagatgggcctcaagccacaagctttggaattgccctgccagcttggatagttgaccagaaaaattcaattctggttttacttgtatatggattggcatttatggttatccttccagttgttgtgggctcttggtggtatcgctcaatacgctatagtggagaccagattctaatacgcacaacacagatttatacatactttgtttataaaacccgaaatatggatatgaaacgtcttatcatggttttggctggagcttctgaatttgatcctcagtataataaagatgccacaagcagaccaacggataatattctaataccacagctaatcagagaaattggcagcattaatttaaagaagaatgagcctccacttacctgcccatatagcctgaaggccagagttcttttactgtctcatcttgctagaatgaaaattcctgagacccttgaagaagatcagcaattcatgctaaaaaagtgtcctgccctacttcaagaaatggttaatgtaatctgccaactaatagtaatggcccggaaccgtgaagaaagggagtttcgtgctccaactttggcatccctagaaaactgcatgaagctttctcagatggccgttcagggacttcagcaatttaagtctccccttctgcagctccctcatattgaagaggacaatcttagacgggtttctaatcataagaagtataaaattaaaactatccaggatttggtgagtttaaaagaatcagatcgtcacactctactgcacttccttgaagatgaaaaatatgaagaggttatggctgtccttgggagttttccatatgtgaccatggatataaaatcacaggtgttagatgatgaagatagcaacaacatcacagtaggatccttagttacagtgttggttaagttgacaaggcaaacaatggctgaagtatttgaaaaggagcagtccatctgtgctgcagaggaacagccagcagaagatgggcagggtgaaactaacaagaacaggacaaaaggaggatggcaacagaagagtaaaggacccaagaaaactgctaaatcaaaaaaaaagaaacctttaaaaaaaaaacctacacctgtgctattaccacagtcaaagcaacagaaacaaaagcaggcaaatggagtcgttgggaatgaagctgcagtaaaggaagatgaagaagaagtttcagataagggcagtgattctgaagaagaagaaaccaatagagattcccaaagtgagaaagatgatggtagtgacagagactctgatagagagcaagatgaaaaacaaaacaaagatgatgaagcagagtggcaagaattacaacaaagcatacagcgaaaagagagagctctattggaaaccaaatcaaaaataacacatcctgtgtatagcctttactttcctgaggaaaaacaagaatggtggtggctttacattgcagataggaaggagcagacattaatatccatgccatatcatgtgtgtacgctgaaagatacagaggaggtagagctgaagtttcctgcaccaggcaagcctggaaattatcagtatactgtgtttctgagatcagactcctatatgggtttggatcagattaaaccattgaagttggaagttcatgaggctaagcctgtgccagaaaatcacccacagtgggatacagcaatagagggggatgaagaccaggaggacagtgagggctttgaagatagctttgaggaagaagaggaggaagaagaagatgatgactaagcagtactctgaatggaccacagtgtttgcacatatttgcaattttttgctgttttggaagtgtatcataaaccagaaacagtacagaactgatgttgagggaggtgtagtttttttactctagaaatgggtgcataatataactaggcagtggcggtgccttggtacaacctgaaaaatgttaaggcttattgaaacctttcaagtaggggatggtacatttatttcatctgcaaatgataataaatcctttgttattataactgtccagaagtgtgggctatgtattatctgatcagtctatggtcccagtaaaagtaaagatgcaggaaacacagtctgtaaatgagcgacttttctttgttcagctttagttttagcaaacaccacaaatatgttttaagtaacatcgctcaagtttaagtaacatcgctcaagttgataatctcttgataagctctgttgttgacattttgcagtgatacaacagctccactcatagatttaaacttttatttttacttatcttggtcataagttggcattctctcacattccacatgatatagagggctacgttttggaattttccttttcttaattgcccagagttatcagacagattataaaaatggcttttaatggcttaaaccatttctaaacctctatcttagcagatcaatgcaggatctaattcttttgataagttctagctctaaaagtgatagtgggactgtatgttttctgatactggtggcttatgttattaaaccttttttaaaaaaggttcactctaaaagctgaactacatccttagttttcagtctacttgactctatcaggagctttttaaggaaagtaagtataacatgcaaaggaagctttttttgtattcattttggactcctgtcaataaaaatagaagtttgttgactcgttttatgtttcaatggtgtgtgtctttttactatcaggacataaatagggcaatccacttctttatttttcaactaaagattgaatagtattgtacattactgctaaagtgactgctatttctgtatactgtagaaaaacccaggagtgagagggatttcccctcatagtacaactggaaggatagtgcttgtaaagagtagagatgtgtacatgatgaatcattgagggagggtggatatttttattcctagatatggaggaaacataagtctgtagtattataaaactgattgtaataattctttcctatcaaaatctccataggtcaaaatattgttggaatactaaaatttgcaaccttgtttactttaaaaggttgccactttcagtgcagaatactaccggcatcttgttactgcaatagttggaaataaaatgtgaaaattagcaaaaccatgcatggttttttggttctaaatttaagatgtaatatttcctataaaagggtgaaagcagtttctttctctataacctcaatcaccagtttagtgagagcctttcttggcaggcaggaggcagtgtcaccgaggatttttttcatttacttcattgtacaagtaggagggtgggtttaattttcaaatcaggttctgctgtgaagcaccagtgtcttgaggcagctactgattacctaagtgtggtggcagggggtaagccagctggtgtcaagtgaaaggagggattagagaaaacaggtgtggcacaaaggcaaggaaactgagcagacaagacagaacaatgtgtagaatgcatatttcctagttttcttgaaagatttcaagaaaagttttttttttttctagtggctactttgccttaaagaggctttataagttcattcacacagctggcttctctggttttaagattctggagaggatgataacctagtaacaccgcagtgcttaaaaaaaaaaaaaaaactaccatcaccagaaaattccaccagtttgttttccttttctctttgtgtgatgtgtatgtacttcccaactaagtaaaataaaatttcctctagtgagtgctttaggtaacctctttccatatggcagtagtgaaagaactgagccttcagttgatagttcttctctctccagcaagtcgctaaactccacatcccttcgtttttcctctggaatgagaataacaaactatcctagtttgcatttaatctaatggaaacttgagcaaagtttcaattttcttcctataaagaaactgacattttgtcaacaattgatgagcctatagatcatacagtgtataggaagtgaaattgaaacagttaaattatgtgatatttttctctaattggtaaagtacctatttattttagcattataatatttgattgaggccctgaggtgttaatatctcaatctcagagttagatgttcatgtcctttttgaattttttaaacatttttcataattttttttttaagttagggagcacattgagtgaagttctctgtgtagaacaataccttctgctctgcttctcccagctttcactgagggctggaaaaggacaggcctgtccagctgtactgtcccactgtgtatggggaagctcaggctctggtggaagcagggggcatggatgtcaaacaactgatgtggaaacagggagggagagatataatgaggctctctaggcatgttatttttgaccacaagttttgttcagtttgcttcagccaatccaaaccatatactagagtgttctgtagtcacaattcttatttcaaatgtaattcagcaccttacataatttttgagaggttgtcattcatcacatatttactgagtttctatgtgccaggctctgtgactggatactggagctatcaaaatgaaaaaaatagtgttaagaactcactcgctggtgttagagcaggtagatgagtggcaatccatttaaatccatttgccttggctattatttggaatgcctttttttttttttaagtctatctactgtaggcagaagaattatttctttaggggctagctgtttattttgctggcctttttttctctctttctctttttcttcttaagacggagtctcgctctgtcctccaggctgggaggagtgcagtgggcacgatctcagctcactgcaacctcggcctcccagtttcaagcgattcttctgcctcagcctcctgagtagctgggactgcaggtgcatgccaccacacccagctaattttttaatttttagtagagatgggattttgccacgttgtccagcctggtctcgaactcctggcctcaagtgatcagccctcctcagcctcccaaagtgctggcattacaggcatgagtcactgcgcccagcctgttgggtttttttggaaaaaaaccaaaaacaacaaatcatcatcctttcctttaaaatgttttttttttttaagaaacaattttcccacaaacggtctgatttaactccatgaaatcctctatttagactgccttaaagtgaaataactgttggtgaaccataacgacattttaccagctgtgtagtgattagtccaaatatgtctcaagaagttagcaccaagcattctcatccatttaaacttgatgctagggctattttgcaaaacttaaaaagatgcgatcttgtacatatttctgtaacctgagctgaaaacccaaataacaatcattgacatactttagggctattgtttcaggtgggggtgtatacatcccaggggcgtggagatgatcaatccattgaggaagtattaagatgattatttgtatttaatctcatccttttaaatttctatttttgtgtgttttataatgtacataatatattgtacaattgtacacttctattatttataaataaacatttattggtgcattaaaaaaaaaaaaaaaaaaaattcactgaccatcattttacaacatgataactggnaccctgacattacccaacttaatcncctgatcacacatcccccttt

SEQ ID NO: 312633 - DNA, 4905 bp, Homo sapiens
agctggcgacggcggcggcagcggcagaggtggcggcggcgtgtccgtgagagtggcgtgggggcggggaggagaggcggcggcggcagtgtccaagctacgccactcgggctggggcgttgggagcgggagtgcagagcgtggtcgtggcggcggcggtgagaagagcgaggcggaggagggggtgccatggccgggcagcagttccagtacgatgacagtgggaacaccttcttctacttcctcacctccttcgtggggctcatcgtgatcccggcgacatactacctctggccccgagatcagaatgccgagcaaattcgattaaagaatatcagaaaagtatatggaaggtgtatgtggtatcgtttacggttattaaaaccccagccaaatattattcctacagtaaagaaaatagttctgcttgcaggatgggcattgttcttattccttgcatataaagtttccaaaacagaccgagaataccaagaatacaatccttatgaagtattaaatttggatcctggagccacagtagcagaaattaaaaaacaatatcgtttgctgtcacttaaatatcatccagataaaggaggtgatgaggttatgttcatgaggatagcaaaagcttatgctgctttaacggatgaagagtcccggaaaaattgggaagaatttggaaatccagatgggcctcaagccacaagctttggaattgccctgccagcttggatagttgaccagaaaaattcaattctggttttacttgtatatggattggcatttatggttatccttccagttgttgtgggctcttggtggtatcgctcaatacgctatagtggagaccagattctaatacgcacaacacagatttatacatactttgtttataaaacccgaaatatggatatgaaacgtcttatcatggttttggctggagcttctgaatttgatcctcagtataataaagatgccacaagcagaccaacggataatattctaataccacagctaatcagagaaattggcagcattaatttaaagaagaatgagcctccacttacctgcccatatagcctgaaggccagagttcttttactgtctcatcttgctagaatgaaaattcctgagacccttgaagaagatcagcaattcatgctaaaaaagtgtcctgccctacttcaagaaatggttaatgtaatctgccaactaatagtaatggcccggaaccgtgaagaaagggagtttcgtgctccaactttggcatccctagaaaactgcatgaagctttctcagatggccgttcagggacttcagcaatttaagtctccccttctgcagctccctcatattgaagaggacaatcttagacgggtttctaatcataagaagtataaaattaaaactatccaggatttggtgagtttaaaagaatcagatcgtcacactctactgcacttccttgaagatgaaaaatatgaagaggttatggctgtccttgggagttttccatatgtgaccatggatataaaatcacaggtgttagatgatgaagatagcaacaacatcacagtaggatccttagttacagtgttggttaagttgacaaggcaaacaatggctgaagtatttgaaaaggagcagtccatctgtgctgcagaggaacagccagcagaagatgggcagggtgaaactaacaagaacaggacaaaaggaggatggcaacagaagagtaaaggacccaagaaaactgctaaatcaaaaaaaaagaaacctttaaaaaaaaaacctacacctgtgctattaccacagtcaaagcaacagaaacaaaagcaggcaaatggagtcgttgggaatgaagctgcagtaaaggaagatgaagaagaagtttcagataagggcagtgattctgaagaagaagaaaccaatagagattcccaaagtgagaaagatgatggtagtgacagagactctgatagagagcaagatgaaaaacaaaacaaagatgatgaagcagagtggcaagaattacaacaaagcatacagcgaaaagagagagctctattggaaaccaaatcaaaaataacacatcctgtgtatagcctttactttcctgaggaaaaacaagaatggtggtggctttacattgcagataggaaggagcagacattaatatccatgccatatcatgtgtgtacgctgaaagatacagaggaggtagagctgaagtttcctgcaccaggcaagcctggaaattatcagtatactgtgtttctgagatcagactcctatatgggtttggatcagattaaaccattgaagttggaagttcatgaggctaagcctgtgccagaaaatcacccacagtgggatacagcaatagagggggatgaagaccaggaggacagtgagggctttgaagatagctttgaggaagaagaggaggaagaagaagatgatgactaagcagtactctgaatggaccacagtgtttgcacatatttgcaattttttgctgttttggaagtgtatcataaaccagaaacagtacagaactgatgttgagggaggtgtagtttttttactctagaaatgggtgcataatataactaggcagtggcggtgccttggtacaacctgaaaaatgttaaggcttattgaaacctttcaagtaggggatggtacatttatttcatctgcaaatgataataaatcctttgttattataactgtccagaagtgtgggctatgtattatctgatcagtctatggtcccagtaaaagtaaagatgcaggaaacacagtctgtaaatgagcgacttttctttgttcagctttagttttagcaaacaccacaaatatgttttaagtaacatcgctcaagtttaagtaacatcgctcaagttgataatctcttgataagctctgttgttgacattttgcagtgatacaacagctccactcatagatttaaacttttatttttacttatcttggtcataagttggcattctctcacattccacatgatatagagggctacgttttggaattttccttttcttaattgcccagagttatcagacagattataaaaatggcttttaatggcttaaaccatttctaaacctctatcttagcagatcaatgcaggatctaattcttttgataagttctagctctaaaagtgatagtgggactgtatgttttctgatactggtggcttatgttattaaaccttttttaaaaaaggttcactctaaaagctgaactacatccttagttttcagtctacttgactctatcaggagctttttaaggaaagtaagtataacatgcaaaggaagctttttttgtattcattttggactcctgtcaataaaaatagaagtttgttgactcgttttatgtttcaatggtgtgtgtctttttactatcaggacataaatagggcaatccacttctttatttttcaactaaagattgaatagtattgtacattactgctaaagtgactgctatttctgtatactgtagaaaaacccaggagtgagagggatttcccctcatagtacaactggaaggatagtgcttgtaaagagtagagatgtgtacatgatgaatcattgagggagggtggatatttttattcctagatatggaggaaacataagtctgtagtattataaaactgattgtaataattctttcctatcaaaatctccataggtcaaaatattgttggaatactaaaatttgcaaccttgtttactttaaaaggttgccactttcagtgcagaatactaccggcatcttgttactgcaatagttggaaataaaatgtgaaaattagcaaaaccatgcatggttttttggttctaaatttaagatgtaatatttcctataaaagggtgaaagcagtttctttctctataacctcaatcaccagtttagtgagagcctttcttggcaggcaggaggcagtgtcaccgaggatttttttcatttacttcattgtacaagtaggagggtgggtttaattttcaaatcaggttctgctgtgaagcaccagtgtcttgaggcagctactgattacctaagtgtggtggcagggggtaagccagctggtgtcaagtgaaaggagggattagagaaaacaggtgtggcacaaaggcaaggaaactgagcagacaagacagaacaatgtgtagaatgcatatttcctagttttcttgaaagatttcaagaaaagttttttttttttctagtggctactttgccttaaagaggctttataagttcattcacacagctggcttctctggttttaagattctggagaggatgataacctagtaacaccgcagtgcttaaaaaaaaaaaaaaaactaccatcaccagaaaattccaccagtttgttttccttttctctttgtgtgatgtgtatgtacttcccaactaagtaaaataaaatttcctctagtgagtgctttaggtaacctctttccatatggcagtagtgaaagaactgagccttcagttgatagttcttctctctccagcaagtcgctaaactccacatcccttcgtttttcctctggaatgagaataacaaactatcctagtttgcatttaatctaatggaaacttgagcaaagtttcaattttcttcctataaagaaactgacattttgtcaacaattgatgagcctatagatcatacagtgtataggaagtgaaattgaaacagttaaattatgtgatatttttctctaattggtaaagtacctattaaaatacagctgttcatgaggagacttaccacaattcaaagtgtagcagttgtgtattttagcatctaactctgagattgagatattaacacctcagggcctcaat

SEQ ID NO: 312634 - DNA, 6362 bp, Homo sapiens
  misc_feature (6316)..(6316): n is a, c, g, or t
  misc_feature (6341)..(6341): n is a, c, g, or t
agctggcgacggcggcggcagcggcagaggtggcggcggcgtgtccgtgagagtggcgtgggggcggggaggagaggcggcggcggcagtgtccaagctacgccactcgggctggggcgttgggagcgggagtgcagagcgtggtcgtggcggcggcggtgagaagagcgaggcggaggagggggtgccatggccgggcagcagttccagtacgatgacagtgggaacaccttcttctacttcctcacctccttcgtggggctcatcgtgatcccggcgacatactacctctggccccgagatcagaatgccgagcaaattcgattaaagaatatcagaaaagtatatggaaggtgtatgtggtatcgtttacggttattaaaaccccagccaaatattattcctacagtaaagaaaatagttctgcttgcaggatgggcattgttcttattccttgcatataaagtttccaaaacagaccgagaataccaagaatacaatccttatgaagtattaaatttggatcctggagccacagtagcagaaattaaaaaacaatatcgtttgctgtcacttaaatatcatccagataaaggaggtgatgaggttatgttcatgaggatagcaaaagcttatgctgctttaacggatgaagagtcccggaaaaattgggaagaatttggaaatccagatgggcctcaagccacaagctttggaattgccctgccagcttggatagttgaccagaaaaattcaattctggttttacttgtatatggattggcatttatggttatccttccagttgttgtgggctcttggtggtatcgctcaatacgctatagtggagaccagattctaatacgcacaacacagatttatacatactttgtttataaaacccgaaatatggatatgaaacgtcttatcatggttttggctggagcttctgaatttgatcctcagtataataaagatgccacaagcagaccaacggataatattctaataccacagctaatcagagaaattggcagcattaatttaaagaagaatgagcctccacttacctgcccatatagcctgaaggccagagttcttttactgtctcatcttgctagaatgaaaattcctgagacccttgaagaagatcagcaattcatgctaaaaaagtgtcctgccctacttcaagaaatggttaatgtaatctgccaactaatagtaatggcccggaaccgtgaagaaagggagtttcgtgctccaactttggcatccctagaaaactgcatgaagctttctcagatggccgttcagggacttcagcaatttaagtctccccttctgcagctccctcatattgaagaggacaatcttagacgggtttctaatcataagaagtataaaattaaaactatccaggatttggtgagtttaaaagaatcagatcgtcacactctactgcacttccttgaagatgaaaaatatgaagaggttatggctgtccttgggagttttccatatgtgaccatggatataaaatcacaggtgttagatgatgaagatagcaacaacatcacagtaggatccttagttacagtgttggttaagttgacaaggcaaacaatggctgaagtatttgaaaaggagcagtccatctgtgctgcagaggaacagccagcagaagatgggcagggtgaaactaacaagaacaggacaaaaggaggatggcaacagaagagtaaaggacccaagaaaactgctaaatcaaaaaaaaagaaacctttaaaaaaaaaacctacacctgtgctattaccacagtcaaagcaacagaaacaaaagcaggcaaatggagtcgttgggaatgaagctgcagtaaaggaagatgaagaagaagtttcagataagggcagtgattctgaagaagaagaaaccaatagagattcccaaagtgagaaagatgatggtagtgacagagactctgatagagagcaagatgaaaaacaaaacaaagatgatgaagcagagtggcaagaattacaacaaagcatacagcgaaaagagagagctctattggaaaccaaatcaaaaataacacatcctgtgtatagcctttactttcctgaggtagagctgaagtttcctgcaccaggcaagcctggaaattatcagtatactgtgtttctgagatcagactcctatatgggtttggatcagattaaaccattgaagttggaagttcatgaggctaagcctgtgccagaaaatcacccacagtgggatacagcaatagagggggatgaagaccaggaggacagtgagggctttgaagatagctttgaggaagaagaggaggaagaagaagatgatgactaagcagtactctgaatggaccacagtgtttgcacatatttgcaattttttgctgttttggaagtgtatcataaaccagaaacagtacagaactgatgttgagggaggtgtagtttttttactctagaaatgggtgcataatataactaggcagtggcggtgccttggtacaacctgaaaaatgttaaggcttattgaaacctttcaagtaggggatggtacatttatttcatctgcaaatgataataaatcctttgttattataactgtccagaagtgtgggctatgtattatctgatcagtctatggtcccagtaaaagtaaagatgcaggaaacacagtctgtaaatgagcgacttttctttgttcagctttagttttagcaaacaccacaaatatgttttaagtaacatcgctcaagtttaagtaacatcgctcaagttgataatctcttgataagctctgttgttgacattttgcagtgatacaacagctccactcatagatttaaacttttatttttacttatcttggtcataagttggcattctctcacattccacatgatatagagggctacgttttggaattttccttttcttaattgcccagagttatcagacagattataaaaatggcttttaatggcttaaaccatttctaaacctctatcttagcagatcaatgcaggatctaattcttttgataagttctagctctaaaagtgatagtgggactgtatgttttctgatactggtggcttatgttattaaaccttttttaaaaaaggttcactctaaaagctgaactacatccttagttttcagtctacttgactctatcaggagctttttaaggaaagtaagtataacatgcaaaggaagctttttttgtattcattttggactcctgtcaataaaaatagaagtttgttgactcgttttatgtttcaatggtgtgtgtctttttactatcaggacataaatagggcaatccacttctttatttttcaactaaagattgaatagtattgtacattactgctaaagtgactgctatttctgtatactgtagaaaaacccaggagtgagagggatttcccctcatagtacaactggaaggatagtgcttgtaaagagtagagatgtgtacatgatgaatcattgagggagggtggatatttttattcctagatatggaggaaacataagtctgtagtattataaaactgattgtaataattctttcctatcaaaatctccataggtcaaaatattgttggaatactaaaatttgcaaccttgtttactttaaaaggttgccactttcagtgcagaatactaccggcatcttgttactgcaatagttggaaataaaatgtgaaaattagcaaaaccatgcatggttttttggttctaaatttaagatgtaatatttcctataaaagggtgaaagcagtttctttctctataacctcaatcaccagtttagtgagagcctttcttggcaggcaggaggcagtgtcaccgaggatttttttcatttacttcattgtacaagtaggagggtgggtttaattttcaaatcaggttctgctgtgaagcaccagtgtcttgaggcagctactgattacctaagtgtggtggcagggggtaagccagctggtgtcaagtgaaaggagggattagagaaaacaggtgtggcacaaaggcaaggaaactgagcagacaagacagaacaatgtgtagaatgcatatttcctagttttcttgaaagatttcaagaaaagttttttttttttctagtggctactttgccttaaagaggctttataagttcattcacacagctggcttctctggttttaagattctggagaggatgataacctagtaacaccgcagtgcttaaaaaaaaaaaaaaaactaccatcaccagaaaattccaccagtttgttttccttttctctttgtgtgatgtgtatgtacttcccaactaagtaaaataaaatttcctctagtgagtgctttaggtaacctctttccatatggcagtagtgaaagaactgagccttcagttgatagttcttctctctccagcaagtcgctaaactccacatcccttcgtttttcctctggaatgagaataacaaactatcctagtttgcatttaatctaatggaaacttgagcaaagtttcaattttcttcctataaagaaactgacattttgtcaacaattgatgagcctatagatcatacagtgtataggaagtgaaattgaaacagttaaattatgtgatatttttctctaattggtaaagtacctatttattttagcattataatatttgattgaggccctgaggtgttaatatctcaatctcagagttagatgttcatgtcctttttgaattttttaaacatttttcataattttttttttaagttagggagcacattgagtgaagttctctgtgtagaacaataccttctgctctgcttctcccagctttcactgagggctggaaaaggacaggcctgtccagctgtactgtcccactgtgtatggggaagctcaggctctggtggaagcagggggcatggatgtcaaacaactgatgtggaaacagggagggagagatataatgaggctctctaggcatgttatttttgaccacaagttttgttcagtttgcttcagccaatccaaaccatatactagagtgttctgtagtcacaattcttatttcaaatgtaattcagcaccttacataatttttgagaggttgtcattcatcacatatttactgagtttctatgtgccaggctctgtgactggatactggagctatcaaaatgaaaaaaatagtgttaagaactcactcgctggtgttagagcaggtagatgagtggcaatccatttaaatccatttgccttggctattatttggaatgcctttttttttttttaagtctatctactgtaggcagaagaattatttctttaggggctagctgtttattttgctggcctttttttctctctttctctttttcttcttaagacggagtctcgctctgtcctccaggctgggaggagtgcagtgggcacgatctcagctcactgcaacctcggcctcccagtttcaagcgattcttctgcctcagcctcctgagtagctgggactgcaggtgcatgccaccacacccagctaattttttaatttttagtagagatgggattttgccacgttgtccagcctggtctcgaactcctggcctcaagtgatcagccctcctcagcctcccaaagtgctggcattacaggcatgagtcactgcgcccagcctgttgggtttttttggaaaaaaaccaaaaacaacaaatcatcatcctttcctttaaaatgttttttttttttaagaaacaattttcccacaaacggtctgatttaactccatgaaatcctctatttagactgccttaaagtgaaataactgttggtgaaccataacgacattttaccagctgtgtagtgattagtccaaatatgtctcaagaagttagcaccaagcattctcatccatttaaacttgatgctagggctattttgcaaaacttaaaaagatgcgatcttgtacatatttctgtaacctgagctgaaaacccaaataacaatcattgacatactttagggctattgtttcaggtgggggtgtatacatcccaggggcgtggagatgatcaatccattgaggaagtattaagatgattatttgtatttaatctcatccttttaaatttctatttttgtgtgttttataatgtacataatatattgtacaattgtacacttctattatttataaataaacatttattggtgcattaaaaaaaaaaaaaaaaaaaattcactgaccatcattttacaacatgataactggnaccctgacattacccaacttaatcncctgatcacacatcccccttt

SEQ ID NO: 312635 - DNA, 6331 bp, Homo sapiens
  misc_feature (6285)..(6285): n is a, c, g, or t
  misc_feature (6310)..(6310): n is a, c, g, or t
agctggcgacggcggcggcagcggcagaggtggcggcggcgtgtccgtgagagtggcgtgggggcggggaggagaggcggcggcggcagtgtccaagctacgccactcgggctggggcgttgggagcgggagtgcagagcgtggtcgtggcggcggcggtgagaagagcgaggcggaggagggggtgccatggccgggcagcagttccagtacgatgacagtgggaacaccttcttctacttcctcacctccttcgtggggctcatcgtgatcccggcgacatactacctctggccccgagatcagaatgccgagcaaattcgattaaagaatatcagaaaagtatatggaaggtgtatgtggtatcgtttacggttattaaaaccccagccaaatattattcctacagtaaagaaaatagttctgcttgcaggatgggcattgttcttattccttgcatataaagtttccaaaacagaccgagaataccaagaatacaatccttatgaagtattaaatttggatcctggagccacagtagcagaaattaaaaaacaatatcgtttgctgtcacttaaatatcatccagataaaggaggtgatgaggttatgttcatgaggatagcaaaagcttatgctgctttaacggatgaagagtcccggaaaaattgggaagaatttggaaatccagatgggcctcaagccacaagctttggaattgccctgccagcttggatagttgaccagaaaaattcaattctggttttacttgtatatggattggcatttatggttatccttccagttgttgtgggctcttggtggtatcgctcaatacgctatagtggagaccagattctaatacgcacaacacagatttatacatactttgtttataaaacccgaaatatggatatgaaacgtcttatcatggttttggctggagcttctgaatttgatcctcagtataataaagatgccacaagcagaccaacggataatattctaataccacagctaatcagagaaattggcagcattaatttaaagaagaatgagcctccacttacctgcccatatagcctgaaggccagagttcttttactgtctcatcttgctagaatgaaaattcctgagacccttgaagaagatcagcaattcatgctaaaaaagtgtcctgccctacttcaagaaatggttaatgtaatctgccaactaatagtaatggcccggaaccgtgaagaaagggagtttcgtgctccaactttggcatccctagaaaactgcatgaagctttctcagatggccgttcagggacttcagcaatttaagtctccccttctgcagctccctcatattgaagaggacaatcttagacgggtttctaatcataagaagtataaaattaaaactatccaggatttggtgagtttaaaagaatcagatcgtcacactctactgcacttccttgaagatgaaaaatatgaagaggttatggctgtccttgggagttttccatatgtgaccatggatataaaatcacaggtgttagatgatgaagatagcaacaacatcacagtaggatccttagttacagtgttggttaagttgacaaggcaaacaatggctgaagtatttgaaaaggagcagtccatctgtgctgcagaggaacagccagcagaagatgggcagggtgaaactaacaagaacaggacaaaaggaggatggcaacagaagagtaaaggacccaagaaaactgctaaatcaaaaaaaaagaaacctttaaaaaaaaaacctacacctgtgctattaccacagtcaaagcaacagaaacaaaagcaggcaaatggagtcgttgggaatgaagctgcagtaaaggaagatgaagaagaagtttcagataagggcagtgattctgaagaagaagaaaccaatagagattcccaaagtgagaaagatgatggtagtgacagagactctgatagagagcaagatgaaaaacaaaacaaagatgatgaagcagagtggcaagaattacaacaaagcatacagcgaaaagagagagctctattggaaaccaaatcaaaaataacacatcctgtgtatagcctttactttcctgaggaaaaacaagaatggtggtggctttacattgcagataggaaggagcagacattaatatccatgccatatcatgtttggaagttcatgaggctaagcctgtgccagaaaatcacccacagtgggatacagcaatagagggggatgaagaccaggaggacagtgagggctttgaagatagctttgaggaagaagaggaggaagaagaagatgatgactaagcagtactctgaatggaccacagtgtttgcacatatttgcaattttttgctgttttggaagtgtatcataaaccagaaacagtacagaactgatgttgagggaggtgtagtttttttactctagaaatgggtgcataatataactaggcagtggcggtgccttggtacaacctgaaaaatgttaaggcttattgaaacctttcaagtaggggatggtacatttatttcatctgcaaatgataataaatcctttgttattataactgtccagaagtgtgggctatgtattatctgatcagtctatggtcccagtaaaagtaaagatgcaggaaacacagtctgtaaatgagcgacttttctttgttcagctttagttttagcaaacaccacaaatatgttttaagtaacatcgctcaagtttaagtaacatcgctcaagttgataatctcttgataagctctgttgttgacattttgcagtgatacaacagctccactcatagatttaaacttttatttttacttatcttggtcataagttggcattctctcacattccacatgatatagagggctacgttttggaattttccttttcttaattgcccagagttatcagacagattataaaaatggcttttaatggcttaaaccatttctaaacctctatcttagcagatcaatgcaggatctaattcttttgataagttctagctctaaaagtgatagtgggactgtatgttttctgatactggtggcttatgttattaaaccttttttaaaaaaggttcactctaaaagctgaactacatccttagttttcagtctacttgactctatcaggagctttttaaggaaagtaagtataacatgcaaaggaagctttttttgtattcattttggactcctgtcaataaaaatagaagtttgttgactcgttttatgtttcaatggtgtgtgtctttttactatcaggacataaatagggcaatccacttctttatttttcaactaaagattgaatagtattgtacattactgctaaagtgactgctatttctgtatactgtagaaaaacccaggagtgagagggatttcccctcatagtacaactggaaggatagtgcttgtaaagagtagagatgtgtacatgatgaatcattgagggagggtggatatttttattcctagatatggaggaaacataagtctgtagtattataaaactgattgtaataattctttcctatcaaaatctccataggtcaaaatattgttggaatactaaaatttgcaaccttgtttactttaaaaggttgccactttcagtgcagaatactaccggcatcttgttactgcaatagttggaaataaaatgtgaaaattagcaaaaccatgcatggttttttggttctaaatttaagatgtaatatttcctataaaagggtgaaagcagtttctttctctataacctcaatcaccagtttagtgagagcctttcttggcaggcaggaggcagtgtcaccgaggatttttttcatttacttcattgtacaagtaggagggtgggtttaattttcaaatcaggttctgctgtgaagcaccagtgtcttgaggcagctactgattacctaagtgtggtggcagggggtaagccagctggtgtcaagtgaaaggagggattagagaaaacaggtgtggcacaaaggcaaggaaactgagcagacaagacagaacaatgtgtagaatgcatatttcctagttttcttgaaagatttcaagaaaagttttttttttttctagtggctactttgccttaaagaggctttataagttcattcacacagctggcttctctggttttaagattctggagaggatgataacctagtaacaccgcagtgcttaaaaaaaaaaaaaaaactaccatcaccagaaaattccaccagtttgttttccttttctctttgtgtgatgtgtatgtacttcccaactaagtaaaataaaatttcctctagtgagtgctttaggtaacctctttccatatggcagtagtgaaagaactgagccttcagttgatagttcttctctctccagcaagtcgctaaactccacatcccttcgtttttcctctggaatgagaataacaaactatcctagtttgcatttaatctaatggaaacttgagcaaagtttcaattttcttcctataaagaaactgacattttgtcaacaattgatgagcctatagatcatacagtgtataggaagtgaaattgaaacagttaaattatgtgatatttttctctaattggtaaagtacctatttattttagcattataatatttgattgaggccctgaggtgttaatatctcaatctcagagttagatgttcatgtcctttttgaattttttaaacatttttcataattttttttttaagttagggagcacattgagtgaagttctctgtgtagaacaataccttctgctctgcttctcccagctttcactgagggctggaaaaggacaggcctgtccagctgtactgtcccactgtgtatggggaagctcaggctctggtggaagcagggggcatggatgtcaaacaactgatgtggaaacagggagggagagatataatgaggctctctaggcatgttatttttgaccacaagttttgttcagtttgcttcagccaatccaaaccatatactagagtgttctgtagtcacaattcttatttcaaatgtaattcagcaccttacataatttttgagaggttgtcattcatcacatatttactgagtttctatgtgccaggctctgtgactggatactggagctatcaaaatgaaaaaaatagtgttaagaactcactcgctggtgttagagcaggtagatgagtggcaatccatttaaatccatttgccttggctattatttggaatgcctttttttttttttaagtctatctactgtaggcagaagaattatttctttaggggctagctgtttattttgctggcctttttttctctctttctctttttcttcttaagacggagtctcgctctgtcctccaggctgggaggagtgcagtgggcacgatctcagctcactgcaacctcggcctcccagtttcaagcgattcttctgcctcagcctcctgagtagctgggactgcaggtgcatgccaccacacccagctaattttttaatttttagtagagatgggattttgccacgttgtccagcctggtctcgaactcctggcctcaagtgatcagccctcctcagcctcccaaagtgctggcattacaggcatgagtcactgcgcccagcctgttgggtttttttggaaaaaaaccaaaaacaacaaatcatcatcctttcctttaaaatgttttttttttttaagaaacaattttcccacaaacggtctgatttaactccatgaaatcctctatttagactgccttaaagtgaaataactgttggtgaaccataacgacattttaccagctgtgtagtgattagtccaaatatgtctcaagaagttagcaccaagcattctcatccatttaaacttgatgctagggctattttgcaaaacttaaaaagatgcgatcttgtacatatttctgtaacctgagctgaaaacccaaataacaatcattgacatactttagggctattgtttcaggtgggggtgtatacatcccaggggcgtggagatgatcaatccattgaggaagtattaagatgattatttgtatttaatctcatccttttaaatttctatttttgtgtgttttataatgtacataatatattgtacaattgtacacttctattatttataaataaacatttattggtgcattaaaaaaaaaaaaaaaaaaaattcactgaccatcattttacaacatgataactggnaccctgacattacccaacttaatcncctgatcacacatcccccttt

SEQ ID NO: 312636 - DNA, 5772 bp, Homo sapiens
  misc_feature (5726)..(5726): n is a, c, g, or t
  misc_feature (5751)..(5751): n is a, c, g, or t
ctgggctcaagcagtcctctcacctcagcctcccaaagtgctgggattacaggaatgagccatctcgcccagcctatcgtagtttttatactttctttcttgtttaattttttttgtgttttagggctcttggtggtatcgctcaatacgctatagtggagaccagattctaatacgcacaacacagatttatacatactttgtttataaaacccgaaatatggatatgaaacgtcttatcatggttttggctggagcttctgaatttgatcctcagtataataaagatgccacaagcagaccaacggataatattctaataccacagctaatcagagaaattggcagcattaatttaaagaagaatgagcctccacttacctgcccatatagcctgaaggccagagttcttttactgtctcatcttgctagaatgaaaattcctgagacccttgaagaagatcagcaattcatgctaaaaaagtgtcctgccctacttcaagaaatggttaatgtaatctgccaactaatagtaatggcccggaaccgtgaagaaagggagtttcgtgctccaactttggcatccctagaaaactgcatgaagctttctcagatggccgttcagggacttcagcaatttaagtctccccttctgcagctccctcatattgaagaggacaatcttagacgggtttctaatcataagaagtataaaattaaaactatccaggatttggtgagtttaaaagaatcagatcgtcacactctactgcacttccttgaagatgaaaaatatgaagaggttatggctgtccttgggagttttccatatgtgaccatggatataaaatcacaggtgttagatgatgaagatagcaacaacatcacagtaggatccttagttacagtgttggttaagttgacaaggcaaacaatggctgaagtatttgaaaaggagcagtccatctgtgctgcagaggaacagccagcagaagatgggcagggtgaaactaacaagaacaggacaaaaggaggatggcaacagaagagtaaaggacccaagaaaactgctaaatcaaaaaaaaagaaacctttaaaaaaaaaacctacacctgtgctattaccacagtcaaagcaacagaaacaaaagcaggcaaatggagtcgttgggaatgaagctgcagtaaaggaagatgaagaagaagtttcagataagggcagtgattctgaagaagaagaaaccaatagagattcccaaagtgagaaagatgatggtagtgacagagactctgatagagagcaagatgaaaaacaaaacaaagatgatgaagcagagtggcaagaattacaacaaagcatacagcgaaaagagagagctctattggaaaccaaatcaaaaataacacatcctgtgtatagcctttactttcctgaggaaaaacaagaatggtggtggctttacattgcagataggaaggagcagacattaatatccatgccatatcatgtgtgtacgctgaaagatacagaggaggtagagctgaagtttcctgcaccaggcaagcctggaaattatcagtatactgtgtttctgagatcagactcctatatgggtttggatcagattaaaccattgaagttggaagttcatgaggctaagcctgtgccagaaaatcacccacagtgggatacagcaatagagggggatgaagaccaggaggacagtgagggctttgaagatagctttgaggaagaagaggaggaagaagaagatgatgactaagcagtactctgaatggaccacagtgtttgcacatatttgcaattttttgctgttttggaagtgtatcataaaccagaaacagtacagaactgatgttgagggaggtgtagtttttttactctagaaatgggtgcataatataactaggcagtggcggtgccttggtacaacctgaaaaatgttaaggcttattgaaacctttcaagtaggggatggtacatttatttcatctgcaaatgataataaatcctttgttattataactgtccagaagtgtgggctatgtattatctgatcagtctatggtcccagtaaaagtaaagatgcaggaaacacagtctgtaaatgagcgacttttctttgttcagctttagttttagcaaacaccacaaatatgttttaagtaacatcgctcaagtttaagtaacatcgctcaagttgataatctcttgataagctctgttgttgacattttgcagtgatacaacagctccactcatagatttaaacttttatttttacttatcttggtcataagttggcattctctcacattccacatgatatagagggctacgttttggaattttccttttcttaattgcccagagttatcagacagattataaaaatggcttttaatggcttaaaccatttctaaacctctatcttagcagatcaatgcaggatctaattcttttgataagttctagctctaaaagtgatagtgggactgtatgttttctgatactggtggcttatgttattaaaccttttttaaaaaaggttcactctaaaagctgaactacatccttagttttcagtctacttgactctatcaggagctttttaaggaaagtaagtataacatgcaaaggaagctttttttgtattcattttggactcctgtcaataaaaatagaagtttgttgactcgttttatgtttcaatggtgtgtgtctttttactatcaggacataaatagggcaatccacttctttatttttcaactaaagattgaatagtattgtacattactgctaaagtgactgctatttctgtatactgtagaaaaacccaggagtgagagggatttcccctcatagtacaactggaaggatagtgcttgtaaagagtagagatgtgtacatgatgaatcattgagggagggtggatatttttattcctagatatggaggaaacataagtctgtagtattataaaactgattgtaataattctttcctatcaaaatctccataggtcaaaatattgttggaatactaaaatttgcaaccttgtttactttaaaaggttgccactttcagtgcagaatactaccggcatcttgttactgcaatagttggaaataaaatgtgaaaattagcaaaaccatgcatggttttttggttctaaatttaagatgtaatatttcctataaaagggtgaaagcagtttctttctctataacctcaatcaccagtttagtgagagcctttcttggcaggcaggaggcagtgtcaccgaggatttttttcatttacttcattgtacaagtaggagggtgggtttaattttcaaatcaggttctgctgtgaagcaccagtgtcttgaggcagctactgattacctaagtgtggtggcagggggtaagccagctggtgtcaagtgaaaggagggattagagaaaacaggtgtggcacaaaggcaaggaaactgagcagacaagacagaacaatgtgtagaatgcatatttcctagttttcttgaaagatttcaagaaaagttttttttttttctagtggctactttgccttaaagaggctttataagttcattcacacagctggcttctctggttttaagattctggagaggatgataacctagtaacaccgcagtgcttaaaaaaaaaaaaaaaactaccatcaccagaaaattccaccagtttgttttccttttctctttgtgtgatgtgtatgtacttcccaactaagtaaaataaaatttcctctagtgagtgctttaggtaacctctttccatatggcagtagtgaaagaactgagccttcagttgatagttcttctctctccagcaagtcgctaaactccacatcccttcgtttttcctctggaatgagaataacaaactatcctagtttgcatttaatctaatggaaacttgagcaaagtttcaattttcttcctataaagaaactgacattttgtcaacaattgatgagcctatagatcatacagtgtataggaagtgaaattgaaacagttaaattatgtgatatttttctctaattggtaaagtacctatttattttagcattataatatttgattgaggccctgaggtgttaatatctcaatctcagagttagatgttcatgtcctttttgaattttttaaacatttttcataattttttttttaagttagggagcacattgagtgaagttctctgtgtagaacaataccttctgctctgcttctcccagctttcactgagggctggaaaaggacaggcctgtccagctgtactgtcccactgtgtatggggaagctcaggctctggtggaagcagggggcatggatgtcaaacaactgatgtggaaacagggagggagagatataatgaggctctctaggcatgttatttttgaccacaagttttgttcagtttgcttcagccaatccaaaccatatactagagtgttctgtagtcacaattcttatttcaaatgtaattcagcaccttacataatttttgagaggttgtcattcatcacatatttactgagtttctatgtgccaggctctgtgactggatactggagctatcaaaatgaaaaaaatagtgttaagaactcactcgctggtgttagagcaggtagatgagtggcaatccatttaaatccatttgccttggctattatttggaatgcctttttttttttttaagtctatctactgtaggcagaagaattatttctttaggggctagctgtttattttgctggcctttttttctctctttctctttttcttcttaagacggagtctcgctctgtcctccaggctgggaggagtgcagtgggcacgatctcagctcactgcaacctcggcctcccagtttcaagcgattcttctgcctcagcctcctgagtagctgggactgcaggtgcatgccaccacacccagctaattttttaatttttagtagagatgggattttgccacgttgtccagcctggtctcgaactcctggcctcaagtgatcagccctcctcagcctcccaaagtgctggcattacaggcatgagtcactgcgcccagcctgttgggtttttttggaaaaaaaccaaaaacaacaaatcatcatcctttcctttaaaatgttttttttttttaagaaacaattttcccacaaacggtctgatttaactccatgaaatcctctatttagactgccttaaagtgaaataactgttggtgaaccataacgacattttaccagctgtgtagtgattagtccaaatatgtctcaagaagttagcaccaagcattctcatccatttaaacttgatgctagggctattttgcaaaacttaaaaagatgcgatcttgtacatatttctgtaacctgagctgaaaacccaaataacaatcattgacatactttagggctattgtttcaggtgggggtgtatacatcccaggggcgtggagatgatcaatccattgaggaagtattaagatgattatttgtatttaatctcatccttttaaatttctatttttgtgtgttttataatgtacataatatattgtacaattgtacacttctattatttataaataaacatttattggtgcattaaaaaaaaaaaaaaaaaaaattcactgaccatcattttacaacatgataactggnaccctgacattacccaacttaatcncctgatcacacatcccccttt

SEQ ID NO: 312637 - DNA, 4374 bp, Homo sapiens
  misc_feature (4328)..(4328): n is a, c, g, or t
  misc_feature (4353)..(4353): n is a, c, g, or t
acccctcttctttttttttttttttttttgtttccaggaaaaacaagaatggtggtggctttacattgcagataggaaggagcagacattaatatccatgccatatcatgtgtgtacgctgaaagatacagaggaggtagagctgaagtttcctgcaccaggcaagcctggaaattatcagtatactgtgtttctgagatcagactcctatatgggtttggatcagattaaaccattgaagttggaagttcatgaggctaagcctgtgccagaaaatcacccacagtgggatacagcaatagagggggatgaagaccaggaggacagtgagggctttgaagatagctttgaggaagaagaggaggaagaagaagatgatgactaagcagtactctgaatggaccacagtgtttgcacatatttgcaattttttgctgttttggaagtgtatcataaaccagaaacagtacagaactgatgttgagggaggtgtagtttttttactctagaaatgggtgcataatataactaggcagtggcggtgccttggtacaacctgaaaaatgttaaggcttattgaaacctttcaagtaggggatggtacatttatttcatctgcaaatgataataaatcctttgttattataactgtccagaagtgtgggctatgtattatctgatcagtctatggtcccagtaaaagtaaagatgcaggaaacacagtctgtaaatgagcgacttttctttgttcagctttagttttagcaaacaccacaaatatgttttaagtaacatcgctcaagtttaagtaacatcgctcaagttgataatctcttgataagctctgttgttgacattttgcagtgatacaacagctccactcatagatttaaacttttatttttacttatcttggtcataagttggcattctctcacattccacatgatatagagggctacgttttggaattttccttttcttaattgcccagagttatcagacagattataaaaatggcttttaatggcttaaaccatttctaaacctctatcttagcagatcaatgcaggatctaattcttttgataagttctagctctaaaagtgatagtgggactgtatgttttctgatactggtggcttatgttattaaaccttttttaaaaaaggttcactctaaaagctgaactacatccttagttttcagtctacttgactctatcaggagctttttaaggaaagtaagtataacatgcaaaggaagctttttttgtattcattttggactcctgtcaataaaaatagaagtttgttgactcgttttatgtttcaatggtgtgtgtctttttactatcaggacataaatagggcaatccacttctttatttttcaactaaagattgaatagtattgtacattactgctaaagtgactgctatttctgtatactgtagaaaaacccaggagtgagagggatttcccctcatagtacaactggaaggatagtgcttgtaaagagtagagatgtgtacatgatgaatcattgagggagggtggatatttttattcctagatatggaggaaacataagtctgtagtattataaaactgattgtaataattctttcctatcaaaatctccataggtcaaaatattgttggaatactaaaatttgcaaccttgtttactttaaaaggttgccactttcagtgcagaatactaccggcatcttgttactgcaatagttggaaataaaatgtgaaaattagcaaaaccatgcatggttttttggttctaaatttaagatgtaatatttcctataaaagggtgaaagcagtttctttctctataacctcaatcaccagtttagtgagagcctttcttggcaggcaggaggcagtgtcaccgaggatttttttcatttacttcattgtacaagtaggagggtgggtttaattttcaaatcaggttctgctgtgaagcaccagtgtcttgaggcagctactgattacctaagtgtggtggcagggggtaagccagctggtgtcaagtgaaaggagggattagagaaaacaggtgtggcacaaaggcaaggaaactgagcagacaagacagaacaatgtgtagaatgcatatttcctagttttcttgaaagatttcaagaaaagttttttttttttctagtggctactttgccttaaagaggctttataagttcattcacacagctggcttctctggttttaagattctggagaggatgataacctagtaacaccgcagtgcttaaaaaaaaaaaaaaaactaccatcaccagaaaattccaccagtttgttttccttttctctttgtgtgatgtgtatgtacttcccaactaagtaaaataaaatttcctctagtgagtgctttaggtaacctctttccatatggcagtagtgaaagaactgagccttcagttgatagttcttctctctccagcaagtcgctaaactccacatcccttcgtttttcctctggaatgagaataacaaactatcctagtttgcatttaatctaatggaaacttgagcaaagtttcaattttcttcctataaagaaactgacattttgtcaacaattgatgagcctatagatcatacagtgtataggaagtgaaattgaaacagttaaattatgtgatatttttctctaattggtaaagtacctatttattttagcattataatatttgattgaggccctgaggtgttaatatctcaatctcagagttagatgttcatgtcctttttgaattttttaaacatttttcataattttttttttaagttagggagcacattgagtgaagttctctgtgtagaacaataccttctgctctgcttctcccagctttcactgagggctggaaaaggacaggcctgtccagctgtactgtcccactgtgtatggggaagctcaggctctggtggaagcagggggcatggatgtcaaacaactgatgtggaaacagggagggagagatataatgaggctctctaggcatgttatttttgaccacaagttttgttcagtttgcttcagccaatccaaaccatatactagagtgttctgtagtcacaattcttatttcaaatgtaattcagcaccttacataatttttgagaggttgtcattcatcacatatttactgagtttctatgtgccaggctctgtgactggatactggagctatcaaaatgaaaaaaatagtgttaagaactcactcgctggtgttagagcaggtagatgagtggcaatccatttaaatccatttgccttggctattatttggaatgcctttttttttttttaagtctatctactgtaggcagaagaattatttctttaggggctagctgtttattttgctggcctttttttctctctttctctttttcttcttaagacggagtctcgctctgtcctccaggctgggaggagtgcagtgggcacgatctcagctcactgcaacctcggcctcccagtttcaagcgattcttctgcctcagcctcctgagtagctgggactgcaggtgcatgccaccacacccagctaattttttaatttttagtagagatgggattttgccacgttgtccagcctggtctcgaactcctggcctcaagtgatcagccctcctcagcctcccaaagtgctggcattacaggcatgagtcactgcgcccagcctgttgggtttttttggaaaaaaaccaaaaacaacaaatcatcatcctttcctttaaaatgttttttttttttaagaaacaattttcccacaaacggtctgatttaactccatgaaatcctctatttagactgccttaaagtgaaataactgttggtgaaccataacgacattttaccagctgtgtagtgattagtccaaatatgtctcaagaagttagcaccaagcattctcatccatttaaacttgatgctagggctattttgcaaaacttaaaaagatgcgatcttgtacatatttctgtaacctgagctgaaaacccaaataacaatcattgacatactttagggctattgtttcaggtgggggtgtatacatcccaggggcgtggagatgatcaatccattgaggaagtattaagatgattatttgtatttaatctcatccttttaaatttctatttttgtgtgttttataatgtacataatatattgtacaattgtacacttctattatttataaataaacatttattggtgcattaaaaaaaaaaaaaaaaaaaattcactgaccatcattttacaacatgataactggnaccctgacattacccaacttaatcncctgatcacacatcccccttt

SEQ ID NO: 312638 - DNA, 3936 bp, Homo sapiens
  misc_feature (3890)..(3890): n is a, c, g, or t
  misc_feature (3915)..(3915): n is a, c, g, or t
cagctgattctagaggatccctcaaacagtacagaactgatgttgagggaggtgtagtttttttactctagaaatgggtgcataatataactaggcagtggcggtgccttggtacaacctgaaaaatgttaaggcttattgaaacctttcaagtaggggatggtacatttatttcatctgcaaatgataataaatcctttgttattataactgtccagaagtgtgggctatgtattatctgatcagtctatggtcccagtaaaagtaaagatgcaggaaacacagtctgtaaatgagcgacttttctttgttcagctttagttttagcaaacaccacaaatatgttttaagtaacatcgctcaagtttaagtaacatcgctcaagttgataatctcttgataagctctgttgttgacattttgcagtgatacaacagctccactcatagatttaaacttttatttttacttatcttggtcataagttggcattctctcacattccacatgatatagagggctacgttttggaattttccttttcttaattgcccagagttatcagacagattataaaaatggcttttaatggcttaaaccatttctaaacctctatcttagcagatcaatgcaggatctaattcttttgataagttctagctctaaaagtgatagtgggactgtatgttttctgatactggtggcttatgttattaaaccttttttaaaaaaggttcactctaaaagctgaactacatccttagttttcagtctacttgactctatcaggagctttttaaggaaagtaagtataacatgcaaaggaagctttttttgtattcattttggactcctgtcaataaaaatagaagtttgttgactcgttttatgtttcaatggtgtgtgtctttttactatcaggacataaatagggcaatccacttctttatttttcaactaaagattgaatagtattgtacattactgctaaagtgactgctatttctgtatactgtagaaaaacccaggagtgagagggatttcccctcatagtacaactggaaggatagtgcttgtaaagagtagagatgtgtacatgatgaatcattgagggagggtggatatttttattcctagatatggaggaaacataagtctgtagtattataaaactgattgtaataattctttcctatcaaaatctccataggtcaaaatattgttggaatactaaaatttgcaaccttgtttactttaaaaggttgccactttcagtgcagaatactaccggcatcttgttactgcaatagttggaaataaaatgtgaaaattagcaaaaccatgcatggttttttggttctaaatttaagatgtaatatttcctataaaagggtgaaagcagtttctttctctataacctcaatcaccagtttagtgagagcctttcttggcaggcaggaggcagtgtcaccgaggatttttttcatttacttcattgtacaagtaggagggtgggtttaattttcaaatcaggttctgctgtgaagcaccagtgtcttgaggcagctactgattacctaagtgtggtggcagggggtaagccagctggtgtcaagtgaaaggagggattagagaaaacaggtgtggcacaaaggcaaggaaactgagcagacaagacagaacaatgtgtagaatgcatatttcctagttttcttgaaagatttcaagaaaagttttttttttttctagtggctactttgccttaaagaggctttataagttcattcacacagctggcttctctggttttaagattctggagaggatgataacctagtaacaccgcagtgcttaaaaaaaaaaaaaaaactaccatcaccagaaaattccaccagtttgttttccttttctctttgtgtgatgtgtatgtacttcccaactaagtaaaataaaatttcctctagtgagtgctttaggtaacctctttccatatggcagtagtgaaagaactgagccttcagttgatagttcttctctctccagcaagtcgctaaactccacatcccttcgtttttcctctggaatgagaataacaaactatcctagtttgcatttaatctaatggaaacttgagcaaagtttcaattttcttcctataaagaaactgacattttgtcaacaattgatgagcctatagatcatacagtgtataggaagtgaaattgaaacagttaaattatgtgatatttttctctaattggtaaagtacctatttattttagcattataatatttgattgaggccctgaggtgttaatatctcaatctcagagttagatgttcatgtcctttttgaattttttaaacatttttcataattttttttttaagttagggagcacattgagtgaagttctctgtgtagaacaataccttctgctctgcttctcccagctttcactgagggctggaaaaggacaggcctgtccagctgtactgtcccactgtgtatggggaagctcaggctctggtggaagcagggggcatggatgtcaaacaactgatgtggaaacagggagggagagatataatgaggctctctaggcatgttatttttgaccacaagttttgttcagtttgcttcagccaatccaaaccatatactagagtgttctgtagtcacaattcttatttcaaatgtaattcagcaccttacataatttttgagaggttgtcattcatcacatatttactgagtttctatgtgccaggctctgtgactggatactggagctatcaaaatgaaaaaaatagtgttaagaactcactcgctggtgttagagcaggtagatgagtggcaatccatttaaatccatttgccttggctattatttggaatgcctttttttttttttaagtctatctactgtaggcagaagaattatttctttaggggctagctgtttattttgctggcctttttttctctctttctctttttcttcttaagacggagtctcgctctgtcctccaggctgggaggagtgcagtgggcacgatctcagctcactgcaacctcggcctcccagtttcaagcgattcttctgcctcagcctcctgagtagctgggactgcaggtgcatgccaccacacccagctaattttttaatttttagtagagatgggattttgccacgttgtccagcctggtctcgaactcctggcctcaagtgatcagccctcctcagcctcccaaagtgctggcattacaggcatgagtcactgcgcccagcctgttgggtttttttggaaaaaaaccaaaaacaacaaatcatcatcctttcctttaaaatgttttttttttttaagaaacaattttcccacaaacggtctgatttaactccatgaaatcctctatttagactgccttaaagtgaaataactgttggtgaaccataacgacattttaccagctgtgtagtgattagtccaaatatgtctcaagaagttagcaccaagcattctcatccatttaaacttgatgctagggctattttgcaaaacttaaaaagatgcgatcttgtacatatttctgtaacctgagctgaaaacccaaataacaatcattgacatactttagggctattgtttcaggtgggggtgtatacatcccaggggcgtggagatgatcaatccattgaggaagtattaagatgattatttgtatttaatctcatccttttaaatttctatttttgtgtgttttataatgtacataatatattgtacaattgtacacttctattatttataaataaacatttattggtgcattaaaaaaaaaaaaaaaaaaaattcactgaccatcattttacaacatgataactggnaccctgacattacccaacttaatcncctgatcacacatcccccttt

SEQ ID NO: 312639 - DNA, 1966 bp, Homo sapiens
agctggcgacggcggcggcagcggcagaggtggcggcggcgtgtccgtgagagtggcgtgggggcggggaggagaggcggcggcggcagtgtccaagctacgccactcgggctggggcgttgggagcgggagtgcagagcgtggtcgtggcggcggcggtgagaagagcgaggcggaggagggggtgccatggccgggcagcagttccagtacgatgacagtgggaacaccttcttctacttcctcacctccttcgtggggctcatcgtgatcccggcgacatactacctctggccccgagatcagaatgccgagcaaattcgattaaagaatatcagaaaagtatatggaaggtgtatgtggtatcgtttacggttattaaaaccccagccaaatattattcctacagtaaagaaaatagttctgcttgcaggatgggcattgttcttattccttgcatataaagtttccaaaacagaccgagaataccaagaatacaatccttatgaagtattaaatttggatcctggagccacagtagcagaaattaaaaaacaatatcgtttgctgtcacttaaatatcatccagataaaggaggtgatgaggttatgttcatgaggatagcaaaagcttatgctgctttaacggatgaagagtcccggaaaaattgggaagaatttggaaatccagatgggcctcaagccacaagctttggaattgccctgccagcttggatagttgaccagaaaaattcaattctggttttacttgtatatggattggcatttatggttatccttccagttgttgtgggctcttggtggtatcgctcaatacgctatagtggagaccagattctaatacgcacaacacagatttatacatactttgtttataaaacccgaaatatggatatgaaacgtcttatcatggttttggctggagcttctgaatttgatcctcagtataataaagatgccacaagcagaccaacggataatattctaataccacagctaatcagagaaattggcagcattaatttaaagaagaatgagcctccacttacctgcccatatagcctgaaggccagagttcttttactgtctcatcttgctagaatgaaaattcctgagacccttgaagaagatcagcaattcatgctaaaaaagtgtcctgccctacttcaagaaatggttaatgtaatctgccaactaatagtaatggcccggaaccgtgaagaaagggagtttcgtgctccaactttggcatccctagaaaactgcatgaagctttctcagatggccgttcagggacttcagcaatttaagtctccccttctgcagctccctcatattgaagaggacaatcttagacgggtttctaatcataagaagtataaaattaaaactatccaggatttggtgagtttaaaagaatcagatcgtcacactctactgcacttccttgaagatgaaaaatatgaagaggttatggctgtccttgggagttttccatatgtgaccatggatataaaatcacaggtgttagatgatgaagatagcaacaacatcacagtaggatccttagttacagtgttggttaagttgacaaggcaaacaatggctgaagtatttgaaaaggagcagtccatctgtgctgcagaggaacagccagcagaagatggggtaaaaacttgggtttccgaacctatttttcctagtgaaagaaatattttatttacttttccaattgacttatattgctctgggagagtaattcagtttagctatttccacctaaaaattactacaaccttcaattgaatctgttgctataacttaagagtgtgacgtgttatgattcacagcagggtgaaactaacaagaacaggacaaaaggaggatggcaacagaagagtaaaggacccaagaaaactgctaaatcaaaaaaaaagaaaccttt

SEQ ID NO: 312640 - DNA, 411 bp, Homo sapiens
ttaaaaaacaatatcgtttgctgtcacttaaatatcatccagataaaggaggtgatgaggttatgttcatgaggatagcaaaagcttatgctgcgtaagtatcaggatccattacaaatttttaagaatggtacagataagccaggtgcagtggttcatgcctgtaatcccagtactttgggaggctgaggcaggaggatcgcttgagcccaggagtttgagaccatccctggcaacataccaagaccccatctctacaaaaaataaaagaattaaccctgtgtggtggtgtgtgcctgtagtcctagctacttgggaggctgaggtgggagcgttgtttgagcctgggaggtcaaggctgcagtgagccgtgaccatgccactgcagcccaacttcgatgacagtaatac

SEQ ID NO: 312641 - DNA, 477 bp, Homo sapiens
taagaataaaagtgaaattttaaacaaatatttttactgtatgtatccttactgtgtttgtaaacttgagtagactgtacttttcaaaacttgttcaagacagatgtgagatactttagaaggtatctacctgcataggcacacattcatcagctagtaattgctaaacgtctccttctttgtcaattgtagccagttaaaaatacttaataaaaatgcagtttgaaagattgctttgtttgtctgaaagataaatataggttgacagattttgtatttctcttcttgccgccccccaggaagtatttgaaaaggagcagtccatctgtgctgcagaggaacagccagcagaagatggggtaaaaacttgggtttccgaacctatttttcctagtgaaagaaatattttatttacttttccaattgacttatattgctctgggagagtaattcagtttagctatttccacctaaaaa

SEQ ID NO: 312642 - DNA, 991 bp, Homo sapiens
agctggcgacggcggcggcagcggcagaggtggcggcggcgtgtccgtgagagtggcgtgggggcggggaggagaggcggcggcggcagtgtccaagctacgccactcgggctggggcgttgggagcgggagtgcagagcgtggtcgtggcggcggcggtgagaagagcgaggcggaggagggggtgccatggccgggcagcagttccagtacgatgacagtgggaacaccttcttctacttcctcacctccttcgtggggctcatcgtgatcccggcgacatactacctctggccccgagatcagaatgccgagcaaattcgattaaagaatatcagaaaagtatatggaaggtgtatgtggtatcgtttacggttattaaaaccccagccaaatattattcctacagtaaagaaaatagttctgcttgcaggatgggcattgttcttattccttgcatataaagtttccaaaacagaccgagaataccaagaatacaatccttatgaagtattaaatttggatcctggagccacagtagcagaaattaaaaaacaatatcgtttgctgtcacttaaatatcatccagataaaggaggtgatgaggttatgttcatgaggatagcaaaagcttatgctgctttaacggatgaagagtcccggaaaaattgggaagaatttggaaatccagatgggcctcaagccacaagctttggaattgccctgccagcttggatagttgaccagaaaaattcaattctggttttacttgtatatggattggcatttatggttatccttccagttgttgtggtaagttttagctttttaagttaatgttttttttggaaaggagattgacatgttttggagtctccctataacattttaaatgtatgttagaatataacccattgatccttgaatttaagagtcttgccactgaaggtgaggtgggaggatcgcttgagcctaggtgtttgaggttgcg

SEQ ID NO: 312643 - DNA, 3616 bp, Homo sapiens
agctggcgacggcggcggcagcggcagaggtggcggcggcgtgtccgtgagagtggcgtgggggcggggaggagaggcggcggcggcagtgtccaagctacgccactcgggctggggcgttgggagcgggagtgcagagcgtggtcgtggcggcggcggtgagaagagcgaggcggaggagggggtgccatggccgggcagcagttccagtacgatgacagtgggaacaccttcttctacttcctcacctccttcgtggggctcatcgtgatcccggcgacatactacctctggccccgagatcagaatgccgagcaaattcgattaaagaatatcagaaaagtatatggaaggtgtatgtggtatcgtttacggttattaaaaccccagccaaatattattcctacagtaaagaaaatagttctgcttgcaggatgggcattgttcttattccttgcatataaagtttccaaaacagaccgagaataccaagaatacaatccttatgaagtattaaatttggatcctggagccacagtagcagaaattaaaaaacaatatcgtttgctgtcacttaaatatcatccagataaaggaggtgatgaggttatgttcatgaggatagcaaaagcttatgctgctttaacggatgaagagtcccggaaaaattgggaagaatttggaaatccagatgggcctcaagccacaagctttggaattgccctgccagcttggatagttgaccagaaaaattcaattctggttttacttgtatatggattggcatttatggttatccttccagttgttgtgggctcttggtggtatcgctcaatacgctatagtggagaccagattctaatacgcacaacacagatttatacatactttgtttataaaacccgaaatatggatatgaaacgtcttatcatggttttggctggagcttctgaatttgatcctcagtataataaagatgccacaagcagaccaacggataatattctaataccacagctaatcagagaaattggcagcattaatttaaagaagaatgagcctccacttacctgcccatatagcctgaaggccagagttcttttactgtctcatcttgctagaatgaaaattcctgagacccttgaagaagatcagcaattcatgctaaaaaagtgtcctgccctacttcaagaaatggttaatgtaatctgccaactaatagtaatggcccggaaccgtgaagaaagggagtttcgtgctccaactttggcatccctagaaaactgcatgaagctttctcagatggccgttcagggacttcagcaatttaagtctccccttctgcagctccctcatattgaagaggacaatcttagacgggtttctaatcataagaagtataaaattaaaactatccaggatttggtgagtttaaaagaatcagatcgtcacactctactgcacttccttgaagatgaaaaatatgaagaggttatggctgtccttgggagttttccatatgtgaccatggatataaaatcacaggtgttagatgatgaagatagcaacaacatcacagtaggatccttagttacagtgttggttaagttgacaaggcaaacaatggctgaagtatttgaaaaggagcagtccatctgtgctgcagaggaacagccagcagaagatgggcagggtgaaactaacaagaacaggacaaaaggaggatggcaacagaagagtaaaggacccaagaaaactgctaaatcaaaaaaaaagaaacctttaaaaaaaaaacctacacctgtgctattaccacagtcaaagcaacagaaacaaaagcaggcaaatggagtcgttgggaatgaagctgcagtaaaggaagatgaagaagaagtttcagataagggcagtgattctgaagaagaagaaaccaatagagattcccaaagtgagaaagatgatggtagtgacagagactctgatagagagcaagatgaaaaacaaaacaaagatgatgaagcagagtggcaagaattacaacaaagcatacagcgaaaagagagagctctattggaaaccaaatcaaaaataacacatcctgtgtatagcctttactttcctgaggaaaaacaagaatggtggtggctttacattgcagataggaaggagcagacattaatatccatgccatatcatgtgtgtacgctgaaagatacagaggaggtagagctgaagtttcctgcaccaggcaagcctggaaattatcagtatactgtgtttctgagatcagactcctatatgggtttggatcagattaaaccattgaagttggaagttcatgaggctaagcctgtgccagaaaatcacccacagtgggatacagcaatagagggggatgaagaccaggaggacagtgagggctttgaagatagctttgaggaagaagaggaggaagaagaagatgatgactaagcagtactctgaatggaccacagtgtttgcacatatttgcaattttttgctgttttggaagtgtatcataaaccagaaacagtacagaactgatgttgagggaggtgtagtttttttactctagaaatgggtgcataatataactaggcagtggcggtgccttggtacaacctgaaaaatgttaaggcttattgaaacctttcaagtaggggatggtacatttatttcatctgcaaatgataataaatcctttgttattataactgtccagaagtgtgggctatgtattatctgatcagtctatggtcccagtaaaagtaaagatgcaggaaacacagtctgtaaatgagcgacttttctttgttcagctttagttttagcaaacaccacaaatatgttttaagtaacatcgctcaagtttaagtaacatcgctcaagttgataatctcttgataagctctgttgttgacattttgcagtgatacaacagctccactcatagatttaaacttttatttttacttatcttggtcataagttggcattctctcacattccacatgatatagagggctacgttttggaattttccttttcttaattgcccagagttatcagacagattataaaaatggcttttaatggcttaaaccatttctaaacctctatcttagcagatcaatgcaggatctaattcttttgataagttctagctctaaaagtgatagtgggactgtatgttttctgatactggtggcttatgttattaaaccttttttaaaaaaggttcactctaaaagctgaactacatccttagttttcagtctacttgactctatcaggagctttttaaggaaagtaagtataacatgcaaaggaagctttttttgtattcattttggactcctgtcaataaaaatagaagtttgttgactcgtaaaaaaaaccacaaaaaaaaaaaaaatggggggcggcccgggcccgaaaaaaattttaaaacactcggtgggggcggggccccctagtaagtcaccggggccaagtggtccaaggaaaccgggccgacagggtgggtctcccccaaaaacgcggggacggcggtggacacaccaaggggcggggccgggtccacagggccgggcaa

SEQ ID NO: 312644 - DNA, 6515 bp, Homo sapiens
  misc_feature (6469)..(6469): n is a, c, g, or t
  misc_feature (6494)..(6494): n is a, c, g, or t
agctggcgacggcggcggcagcggcagaggtggcggcggcgtgtccgtgagagtggcgtgggggcggggaggagaggcggcggcggcagtgtccaagctacgccactcgggctggggcgttgggagcgggagtgcagagcgtggtcgtggcggcggcggtgagaagagcgaggcggaggagggggtgccatggccgggcagcagttccagtacgatgacagtgggaacaccttcttctacttcctcacctccttcgtggggctcatcgtgatcccggcgacatactacctctggccccgagatcagaatgccgagcaaattcgattaaagaatatcagaaaagtatatggaaggtgtatgtggtatcgtttacggttattaaaaccccagccaaatattattcctacagtaaagaaaatagttctgcttgcaggatgggcattgttcttattccttgcatataaagtttccaaaacagaccgagaataccaagaatacaatccttatgaagtattaaatttggatcctggagccacagtagcagaaattaaaaaacaatatcgtttgctgtcacttaaatatcatccagataaaggaggtgatgaggttatgttcatgaggatagcaaaagcttatgctgctttaacggatgaagagtcccggaaaaattgggaagaatttggaaatccagatgggcctcaagccacaagctttggaattgccctgccagcttggatagttgaccagaaaaattcaattctggttttacttgtatatggattggcatttatggttatccttccagttgttgtgggctcttggtggtatcgctcaatacgctatagtggagaccagattctaatacgcacaacacagatttatacatactttgtttataaaacccgaaatatggatatgaaacgtcttatcatggttttggctggagcttctgaatttgatcctcagtataataaagatgccacaagcagaccaacggataatattctaataccacagctaatcagagaaattggcagcattaatttaaagaagaatgagcctccacttacctgcccatatagcctgaaggccagagttcttttactgtctcatcttgctagaatgaaaattcctgagacccttgaagaagatcagcaattcatgctaaaaaagtgtcctgccctacttcaagaaatggttaatgtaatctgccaactaatagtaatggcccggaaccgtgaagaaagggagtttcgtgctccaactttggcatccctagaaaactgcatgaagctttctcagatggccgttcagggacttcagcaatttaagtctccccttctgcagctccctcatattgaagaggacaatcttagacgggtttctaatcataagaagtataaaattaaaactatccaggatttggtgagtttaaaagaatcagatcgtcacactctactgcacttccttgaagatgaaaaatatgaagaggttatggctgtccttgggagttttccatatgtgaccatggatataaaatcacaggtgttagatgatgaagatagcaacaacatcacagtaggatccttagttacagtgttggttaagttgacaaggcaaacaatggctgaagtatttgaaaaggagcagtccatctgtgctgcagaggaacagccagcagaagatgggcagggtgaaactaacaagaacaggacaaaaggaggatggcaacagaagagtaaaggacccaagaaaactgctaaatcaaaaaaaaagaaacctttaaaaaaaaaacctacacctgtgctattaccacagtcaaagcaacagaaacaaaagcaggcaaatggagtcgttgggaatgaagctgcagtaaaggaagatgaagaagaagtttcagataagggcagtgattctgaagaagaagaaaccaatagagattcccaaagtgagaaagatgatggtagtgacagagactctgatagagagcaagatgaaaaacaaaacaaagatgatgaagcagagtggcaagaattacaacaaagcatacagcgaaaagagagagctctattggaaaccaaatcaaaaataacacatcctgtgtatagcctttactttcctgaggaaaaacaagaatggtggtggctttacattgcagataggaaggagcagacattaatatccatgccatatcatgtgtgtacgctgaaagatacagaggaggtagagctgaagtttcctgcaccaggcaagcctggaaattatcagtatactgtgtttctgagatcagactcctatatgggtttggatcagattaaaccattgaagttggaagttcatgaggctaagcctgtgccagaaaatcacccacagtgggatacagcaatagagggggatgaagaccaggaggacagtgagggctttgaagatagctttgaggaagaagaggaggaagaagaagatgatgactaagcagtactctgaatggaccacagtgtttgcacatatttgcaattttttgctgttttggaagtgtatcataaaccagaaacagtacagaactgatgttgagggaggtgtagtttttttactctagaaatgggtgcataatataactaggcagtggcggtgccttggtacaacctgaaaaatgttaaggcttattgaaacctttcaagtaggggatggtacatttatttcatctgcaaatgataataaatcctttgttattataactgtccagaagtgtgggctatgtattatctgatcagtctatggtcccagtaaaagtaaagatgcaggaaacacagtctgtaaatgagcgacttttctttgttcagctttagttttagcaaacaccacaaatatgttttaagtaacatcgctcaagtttaagtaacatcgctcaagttgataatctcttgataagctctgttgttgacattttgcagtgatacaacagctccactcatagatttaaacttttatttttacttatcttggtcataagttggcattctctcacattccacatgatatagagggctacgttttggaattttccttttcttaattgcccagagttatcagacagattataaaaatggcttttaatggcttaaaccatttctaaacctctatcttagcagatcaatgcaggatctaattcttttgataagttctagctctaaaagtgatagtgggactgtatgttttctgatactggtggcttatgttattaaaccttttttaaaaaaggttcactctaaaagctgaactacatccttagttttcagtctacttgactctatcaggagctttttaaggaaagtaagtataacatgcaaaggaagctttttttgtattcattttggactcctgtcaataaaaatagaagtttgttgactcgttttatgtttcaatggtgtgtgtctttttactatcaggacataaatagggcaatccacttctttatttttcaactaaagattgaatagtattgtacattactgctaaagtgactgctatttctgtatactgtagaaaaacccaggagtgagagggatttcccctcatagtacaactggaaggatagtgcttgtaaagagtagagatgtgtacatgatgaatcattgagggagggtggatatttttattcctagatatggaggaaacataagtctgtagtattataaaactgattgtaataattctttcctatcaaaatctccataggtcaaaatattgttggaatactaaaatttgcaaccttgtttactttaaaaggttgccactttcagtgcagaatactaccggcatcttgttactgcaatagttggaaataaaatgtgaaaattagcaaaaccatgcatggttttttggttctaaatttaagatgtaatatttcctataaaagggtgaaagcagtttctttctctataacctcaatcaccagtttagtgagagcctttcttggcaggcaggaggcagtgtcaccgaggatttttttcatttacttcattgtacaagtaggagggtgggtttaattttcaaatcaggttctgctgtgaagcaccagtgtcttgaggcagctactgattacctaagtgtggtggcagggggtaagccagctggtgtcaagtgaaaggagggattagagaaaacaggtgtggcacaaaggcaaggaaactgagcagacaagacagaacaatgtgtagaatgcatatttcctagttttcttgaaagatttcaagaaaagttttttttttttctagtggctactttgccttaaagaggctttataagttcattcacacagctggcttctctggttttaagattctggagaggatgataacctagtaacaccgcagtgcttaaaaaaaaaaaaaaaactaccatcaccagaaaattccaccagtttgttttccttttctctttgtgtgatgtgtatgtacttcccaactaagtaaaataaaatttcctctagtgagtgctttaggtaacctctttccatatggcagtagtgaaagaactgagccttcagttgatagttcttctctctccagcaagtcgctaaactccacatcccttcgtttttcctctggaatgagaataacaaactatcctagtttgcatttaatctaatggaaacttgagcaaagtttcaattttcttcctataaagaaactgacattttgtcaacaattgatgagcctatagatcatacagtgtataggaagtgaaattgaaacagttaaattatgtgatatttttctctaattggtaaagtacctattaaaatacagctgttcatgaggagacttaccacaattcaaagtgtagcagttgtgtattttagcattataatatttgattgaggccctgaggtgttaatatctcaatctcagagttagatgttcatgtcctttttgaattttttaaacatttttcataattttttttttaagttagggagcacattgagtgaagttctctgtgtagaacaataccttctgctctgcttctcccagctttcactgagggctggaaaaggacaggcctgtccagctgtactgtcccactgtgtatggggaagctcaggctctggtggaagcagggggcatggatgtcaaacaactgatgtggaaacagggagggagagatataatgaggctctctaggcatgttatttttgaccacaagttttgttcagtttgcttcagccaatccaaaccatatactagagtgttctgtagtcacaattcttatttcaaatgtaattcagcaccttacataatttttgagaggttgtcattcatcacatatttactgagtttctatgtgccaggctctgtgactggatactggagctatcaaaatgaaaaaaatagtgttaagaactcactcgctggtgttagagcaggtagatgagtggcaatccatttaaatccatttgccttggctattatttggaatgcctttttttttttttaagtctatctactgtaggcagaagaattatttctttaggggctagctgtttattttgctggcctttttttctctctttctctttttcttcttaagacggagtctcgctctgtcctccaggctgggaggagtgcagtgggcacgatctcagctcactgcaacctcggcctcccagtttcaagcgattcttctgcctcagcctcctgagtagctgggactgcaggtgcatgccaccacacccagctaattttttaatttttagtagagatgggattttgccacgttgtccagcctggtctcgaactcctggcctcaagtgatcagccctcctcagcctcccaaagtgctggcattacaggcatgagtcactgcgcccagcctgttgggtttttttggaaaaaaaccaaaaacaacaaatcatcatcctttcctttaaaatgttttttttttttaagaaacaattttcccacaaacggtctgatttaactccatgaaatcctctatttagactgccttaaagtgaaataactgttggtgaaccataacgacattttaccagctgtgtagtgattagtccaaatatgtctcaagaagttagcaccaagcattctcatccatttaaacttgatgctagggctattttgcaaaacttaaaaagatgcgatcttgtacatatttctgtaacctgagctgaaaacccaaataacaatcattgacatactttagggctattgtttcaggtgggggtgtatacatcccaggggcgtggagatgatcaatccattgaggaagtattaagatgattatttgtatttaatctcatccttttaaatttctatttttgtgtgttttataatgtacataatatattgtacaattgtacacttctattatttataaataaacatttattggtgcattaaaaaaaaaaaaaaaaaaaattcactgaccatcattttacaacatgataactggnaccctgacattacccaacttaatcncctgatcacacatcccccttt

SEQ ID NO: 312645 - DNA, 3516 bp, Homo sapiens
agctggcgacggcggcggcagcggcagaggtggcggcggcgtgtccgtgagagtggcgtgggggcggggaggagaggcggcggcggcagtgtccaagctacgccactcgggctggggcgttgggagcgggagtgcagagcgtggtcgtggcggcggcggtgagaagagcgaggcggaggagggggtgccatggccgggcagcagttccagtacgatgacagtgggaacaccttcttctacttcctcacctccttcgtggggctcatcgtgatcccggcgacatactacctctggccccgagatcagaatgccggaaaatagttctgcttgcaggatgggcattgttcttattccttgcatataaagtttccaaaacagaccgagaataccaagaatacaatccttatgaagtattaaatttggatcctggagccacagtagcagaaattaaaaaacaatatcgtttgctgtcacttaaatatcatccagataaaggaggtgatgaggttatgttcatgaggatagcaaaagcttatgctgctttaacggatgaagagtcccggaaaaattgggaagaatttggaaatccagatgggcctcaagccacaagctttggaattgccctgccagcttggatagttgaccagaaaaattcaattctggttttacttgtatatggattggcatttatggttatccttccagttgttgtgggctcttggtggtatcgctcaatacgctatagtggagaccagattctaatacgcacaacacagatttatacatactttgtttataaaacccgaaatatggatatgaaacgtcttatcatggttttggctggagcttctgaatttgatcctcagtataataaagatgccacaagcagaccaacggataatattctaataccacagctaatcagagaaattggcagcattaatttaaagaagaatgagcctccacttacctgcccatatagcctgaaggccagagttcttttactgtctcatcttgctagaatgaaaattcctgagacccttgaagaagatcagcaattcatgctaaaaaagtgtcctgccctacttcaagaaatggttaatgtaatctgccaactaatagtaatggcccggaaccgtgaagaaagggagtttcgtgctccaactttggcatccctagaaaactgcatgaagctttctcagatggccgttcagggacttcagcaatttaagtctccccttctgcagctccctcatattgaagaggacaatcttagacgggtttctaatcataagaagtataaaattaaaactatccaggatttggtgagtttaaaagaatcagatcgtcacactctactgcacttccttgaagatgaaaaatatgaagaggttatggctgtccttgggagttttccatatgtgaccatggatataaaatcacaggtgttagatgatgaagatagcaacaacatcacagtaggatccttagttacagtgttggttaagttgacaaggcaaacaatggctgaagtatttgaaaaggagcagtccatctgtgctgcagaggaacagccagcagaagatgggcagggtgaaactaacaagaacaggacaaaaggaggatggcaacagaagagtaaaggacccaagaaaactgctaaatcaaaaaaaaagaaacctttaaaaaaaaaacctacacctgtgctattaccacagtcaaagcaacagaaacaaaagcaggcaaatggagtcgttgggaatgaagctgcagtaaaggaagatgaagaagaagtttcagataagggcagtgattctgaagaagaagaaaccaatagagattcccaaagtgagaaagatgatggtagtgacagagactctgatagagagcaagatgaaaaacaaaacaaagatgatgaagcagagtggcaagaattacaacaaagcatacagcgaaaagagagagctctattggaaaccaaatcaaaaataacacatcctgtgtatagcctttactttcctgaggaaaaacaagaatggtggtggctttacattgcagataggaaggagcagacattaatatccatgccatatcatgtgtgtacgctgaaagatacagaggaggtagagctgaagtttcctgcaccaggcaagcctggaaattatcagtatactgtgtttctgagatcagactcctatatgggtttggatcagattaaaccattgaagttggaagttcatgaggctaagcctgtgccagaaaatcacccacagtgggatacagcaatagagggggatgaagaccaggaggacagtgagggctttgaagatagctttgaggaagaagaggaggaagaagaagatgatgactaagcagtactctgaatggaccacagtgtttgcacatatttgcaattttttgctgttttggaagtgtatcataaaccagaaacagtacagaactgatgttgagggaggtgtagtttttttactctagaaatgggtgcataatataactaggcagtggcggtgccttggtacaacctgaaaaatgttaaggcttattgaaacctttcaagtaggggatggtacatttatttcatctgcaaatgataataaatcctttgttattataactgtccagaagtgtgggctatgtattatctgatcagtctatggtcccagtaaaagtaaagatgcaggaaacacagtctgtaaatgagcgacttttctttgttcagctttagttttagcaaacaccacaaatatgttttaagtaacatcgctcaagtttaagtaacatcgctcaagttgataatctcttgataagctctgttgttgacattttgcagtgatacaacagctccactcatagatttaaacttttatttttacttatcttggtcataagttggcattctctcacattccacatgatatagagggctacgttttggaattttccttttcttaattgcccagagttatcagacagattataaaaatggcttttaatggcttaaaccatttctaaacctctatcttagcagatcaatgcaggatctaattcttttgataagttctagctctaaaagtgatagtgggactgtatgttttctgatactggtggcttatgttattaaaccttttttaaaaaaggttcactctaaaagctgaactacatccttagttttcagtctacttgactctatcaggagctttttaaggaaagtaagtataacatgcaaaggaagctttttttgtattcattttggactcctgtcaataaaaatagaagtttgttgactcgtaaaaaaaaccacaaaaaaaaaaaaaatggggggcggcccgggcccgaaaaaaattttaaaacactcggtgggggcggggccccctagtaagtcaccggggccaagtggtccaaggaaaccgggccgacagggtgggtctcccccaaaaacgcggggacggcggtggacacaccaaggggcggggccgggtccacagggccgggcaa

SEQ ID NO: 312646 - DNA, 3251 bp, Homo sapiens
agctggcgacggcggcggcagcggcagaggtggcggcggcgtgtccgtgagagtggcgtgggggcggggaggagaggcggcggcggcagtgtccaagctacgccactcgggctggggcgttgggagcgggagtgcagagcgtggtcgtggcggcggcggtgagaagagcgaggcggaggagggggtgccatggccgggcagcagttccagtacgatgacagtgggaacaccttcttctacttcctcacctccttcgtggggctcatcgtgatcccggcgacatactacctctggccccgagatcagaatgccgagcaaattcgattaaagaatatcagaaaagtatatggaaggtgtatgtggtatcgtttacggttattaaaaccccagccaaatattattcctacagtaaagaaaatagttctgcttgcaggatgggcattgttcttattccttgcatataaagtttccaaaacagaccgagaataccaagaatacaatccttatgaagtattaaatttggatcctggagccacagtagcagaaattaaaaaacaatatcgtttgctgtcacttaaatatcatccagataaaggaggtgatgaggttatgttcatgaggatagcaaaagcttatgctgctttaacggatgaagagtcccggaaaaattgggaagaatttggaaatccagatgggcctcaagccacaagctttggaattgccctgccagcttggatagttgaccagaaaaattcaattctggttttacttgtatatggattggcatttatggttatccttccagttgttgtgggctcttggtggtatcgctcaatacgctatagtggagaccagattctaatacgcacaacacagatttatacatactttgtttataaaacccgaaatatggatatgaaacgtcttatcatggttttggctggagcttctgaatttgatcctcagtataataaagatgccacaagcagaccaacggataatattctaataccacagctaatcagagaaattggcagcattaatttaaagaagaatgagcctccacttacctgcccatatagcctgaaggccagagttcttttactgtctcatcttgctagaatgaaaattcctgagacccttgaagaagatcagcaattcatgctaaaaaagtgtcctgccctacttcaagaaatggttaatgtaatctgccaactaatagtaatggcccggaaccgtgaagaaagggagtttcgtgctccaactttggcatccctagaaaactgcatgaagctttctcagatggccgttcagggacttcagcaatttaagtctccccttctgcagctccctcatattgaagaggacaatcttagacgggtttctaatcataagaagtataaaattaaaactatccaggatttggtgagtttaaaagaatcagatcgtcacactctactgcacttccttgaagatgaaaaatatgaagaggttatggctgtccttgggagttttccatatgtgaccatggatataaaatcacaggtgttagatgatgaagatagcaacaacatcacagtaggatccttagttacagtgttggttaagttgacaaggcaaacaatggctgaagtatttgaaaaggagcagtccatctgtgctgcagaggaacagccagcagaagatgggcagggtgaaactaacaagaacaggacaaaaggaggatggcaacagaagagtaaaggacccaagaaaactgctaaatcaaaaaaaaagaaacctttaaaaaaaaaacctacacctgtgctattaccacagtcaaagcaacagaaacaaaagcaggcaaatggagtcgttgggaatgaagctgcagtaaaggaagatgaagaagaagtttcagataagggcagtgattctgaagaagaagaaaccaatagagattcccaaagtgagaaagatgatggtagtgacagagactctgatagagagcaagatgaaaaacaaaacaaagatgatgaagcagagtggcaagaattacaacaaagcatacagcgaaaagagagagctctattggaaaccaaatcaaaaataacacatcctgtgtatagcctttactttcctgaggaaaaacaagaatggtggtggctttacattgcagataggaaggagcagacattaatatccatgccatatcatgtgtgtacgctgaaagatacagaggaggtagagctgaagtttcctgcaccaggcaagcctggaaattatcagtatactgtgtttctgagatcagactcctatatgggtttggatcagattaaaccattgaagttggaagttcatgaggctaagcctgtgccagaaaatcacccacagtgggatacagcaatagagggggatgaagaccaggaggacagtgagggctttgaagatagctttgaggaagaagaggaggaagaagaagatgatgactaagcagtactctgaatggaccacagtgtttgcacatatttgcaattttttgctgttttggaagtgtatcataaaccagaaacagtacagaactgatgttgagggaggtgtagtttttttactctagaaatgggtgcataatataactaggcagtggcggtgccttggtacaacctgaaaaatgttaaggcttattgaaacctttcaagtaggggatggtacatttatttcatctgcaaatgataataaatcctttgttattataactgtccagaagtgtgggctatgtattatctgatcagtctatggtcccagtaaaagtaaagatgcaggaaacacagtctgtaaatgagcgacttttctttgttcagctttagttttagcaaacaccacaaatatgttttaagtaacatcgctcaagtttaagtaacatcgctcaagttgataatctcttgataagctctgttgttgacattttgcagtgatacaacagctccactcatagatttaaacttttatttttacttatcttggtcataagttggcattctctcacattccacatgatatagagggctacgttttggaattttccttttcttaattgcccagagttatcagacagattataaaaatggcttttaatggcttaaaccatttctaaacctctatcttagcagatcaatgcaggatctaattcttttgataagttctagctctaaaagtgatagtgggactgtatgttttctgatacgttttgagggatcctctagacagcctca

SEQ ID NO: 312647 - DNA, 4780 bp, Homo sapiens
  misc_feature (4734)..(4734): n is a, c, g, or t
  misc_feature (4759)..(4759): n is a, c, g, or t
gcgcaactggagaagaaaaaaaagaaaaagatagaaaaaagaaaaagtttcagaagagcagaagtaaacacaaaaaacataagtcctcttcttcctcatcttcctcctcctcctcctcttcctctactgagacttcagaaagcagtagtgagagtgagagtaacaataaagaaaaaaaaatacaaaggaagaaaagaaagaaaaacaagtgttcagggcataagggcagtgattctgaagaagaagaaaccaatagagattcccaaagtgagaaagatgatggtagtgacagagactctgatagagagcaagatgaaaaacaaaacaaagatgatgaagcagagtggcaagaattacaacaaagcatacagcgaaaagagagagctctattggaaaccaaatcaaaaataacacatcctgtgtatagcctttactttcctgaggaaaaacaagaatggtggtggctttacattgcagataggaaggagcagacattaatatccatgccatatcatgtgtgtacgctgaaagatacagaggaggtagagctgaagtttcctgcaccaggcaagcctggaaattatcagtatactgtgtttctgagatcagactcctatatgggtttggatcagattaaaccattgaagttggaagttcatgaggctaagcctgtgccagaaaatcacccacagtgggatacagcaatagagggggatgaagaccaggaggacagtgagggctttgaagatagctttgaggaagaagaggaggaagaagaagatgatgactaagcagtactctgaatggaccacagtgtttgcacatatttgcaattttttgctgttttggaagtgtatcataaaccagaaacagtacagaactgatgttgagggaggtgtagtttttttactctagaaatgggtgcataatataactaggcagtggcggtgccttggtacaacctgaaaaatgttaaggcttattgaaacctttcaagtaggggatggtacatttatttcatctgcaaatgataataaatcctttgttattataactgtccagaagtgtgggctatgtattatctgatcagtctatggtcccagtaaaagtaaagatgcaggaaacacagtctgtaaatgagcgacttttctttgttcagctttagttttagcaaacaccacaaatatgttttaagtaacatcgctcaagtttaagtaacatcgctcaagttgataatctcttgataagctctgttgttgacattttgcagtgatacaacagctccactcatagatttaaacttttatttttacttatcttggtcataagttggcattctctcacattccacatgatatagagggctacgttttggaattttccttttcttaattgcccagagttatcagacagattataaaaatggcttttaatggcttaaaccatttctaaacctctatcttagcagatcaatgcaggatctaattcttttgataagttctagctctaaaagtgatagtgggactgtatgttttctgatactggtggcttatgttattaaaccttttttaaaaaaggttcactctaaaagctgaactacatccttagttttcagtctacttgactctatcaggagctttttaaggaaagtaagtataacatgcaaaggaagctttttttgtattcattttggactcctgtcaataaaaatagaagtttgttgactcgttttatgtttcaatggtgtgtgtctttttactatcaggacataaatagggcaatccacttctttatttttcaactaaagattgaatagtattgtacattactgctaaagtgactgctatttctgtatactgtagaaaaacccaggagtgagagggatttcccctcatagtacaactggaaggatagtgcttgtaaagagtagagatgtgtacatgatgaatcattgagggagggtggatatttttattcctagatatggaggaaacataagtctgtagtattataaaactgattgtaataattctttcctatcaaaatctccataggtcaaaatattgttggaatactaaaatttgcaaccttgtttactttaaaaggttgccactttcagtgcagaatactaccggcatcttgttactgcaatagttggaaataaaatgtgaaaattagcaaaaccatgcatggttttttggttctaaatttaagatgtaatatttcctataaaagggtgaaagcagtttctttctctataacctcaatcaccagtttagtgagagcctttcttggcaggcaggaggcagtgtcaccgaggatttttttcatttacttcattgtacaagtaggagggtgggtttaattttcaaatcaggttctgctgtgaagcaccagtgtcttgaggcagctactgattacctaagtgtggtggcagggggtaagccagctggtgtcaagtgaaaggagggattagagaaaacaggtgtggcacaaaggcaaggaaactgagcagacaagacagaacaatgtgtagaatgcatatttcctagttttcttgaaagatttcaagaaaagttttttttttttctagtggctactttgccttaaagaggctttataagttcattcacacagctggcttctctggttttaagattctggagaggatgataacctagtaacaccgcagtgcttaaaaaaaaaaaaaaaactaccatcaccagaaaattccaccagtttgttttccttttctctttgtgtgatgtgtatgtacttcccaactaagtaaaataaaatttcctctagtgagtgctttaggtaacctctttccatatggcagtagtgaaagaactgagccttcagttgatagttcttctctctccagcaagtcgctaaactccacatcccttcgtttttcctctggaatgagaataacaaactatcctagtttgcatttaatctaatggaaacttgagcaaagtttcaattttcttcctataaagaaactgacattttgtcaacaattgatgagcctatagatcatacagtgtataggaagtgaaattgaaacagttaaattatgtgatatttttctctaattggtaaagtacctatttattttagcattataatatttgattgaggccctgaggtgttaatatctcaatctcagagttagatgttcatgtcctttttgaattttttaaacatttttcataattttttttttaagttagggagcacattgagtgaagttctctgtgtagaacaataccttctgctctgcttctcccagctttcactgagggctggaaaaggacaggcctgtccagctgtactgtcccactgtgtatggggaagctcaggctctggtggaagcagggggcatggatgtcaaacaactgatgtggaaacagggagggagagatataatgaggctctctaggcatgttatttttgaccacaagttttgttcagtttgcttcagccaatccaaaccatatactagagtgttctgtagtcacaattcttatttcaaatgtaattcagcaccttacataatttttgagaggttgtcattcatcacatatttactgagtttctatgtgccaggctctgtgactggatactggagctatcaaaatgaaaaaaatagtgttaagaactcactcgctggtgttagagcaggtagatgagtggcaatccatttaaatccatttgccttggctattatttggaatgcctttttttttttttaagtctatctactgtaggcagaagaattatttctttaggggctagctgtttattttgctggcctttttttctctctttctctttttcttcttaagacggagtctcgctctgtcctccaggctgggaggagtgcagtgggcacgatctcagctcactgcaacctcggcctcccagtttcaagcgattcttctgcctcagcctcctgagtagctgggactgcaggtgcatgccaccacacccagctaattttttaatttttagtagagatgggattttgccacgttgtccagcctggtctcgaactcctggcctcaagtgatcagccctcctcagcctcccaaagtgctggcattacaggcatgagtcactgcgcccagcctgttgggtttttttggaaaaaaaccaaaaacaacaaatcatcatcctttcctttaaaatgttttttttttttaagaaacaattttcccacaaacggtctgatttaactccatgaaatcctctatttagactgccttaaagtgaaataactgttggtgaaccataacgacattttaccagctgtgtagtgattagtccaaatatgtctcaagaagttagcaccaagcattctcatccatttaaacttgatgctagggctattttgcaaaacttaaaaagatgcgatcttgtacatatttctgtaacctgagctgaaaacccaaataacaatcattgacatactttagggctattgtttcaggtgggggtgtatacatcccaggggcgtggagatgatcaatccattgaggaagtattaagatgattatttgtatttaatctcatccttttaaatttctatttttgtgtgttttataatgtacataatatattgtacaattgtacacttctattatttataaataaacatttattggtgcattaaaaaaaaaaaaaaaaaaaattcactgaccatcattttacaacatgataactggnaccctgacattacccaacttaatcncctgatcacacatcccccttt

SEQ ID NO: 312648 - DNA, 2491 bp, Homo sapiens
agctggcgacggcggcggcagcggcagaggtggcggcggcgtgtccgtgagagtggcgtgggggcggggaggagaggcggcggcggcagtgtccaagctacgccactcgggctggggcgttgggagcgggagtgcagagcgtggtcgtggcggcggcggtgagaagagcgaggcggaggagggggtgccatggccgggcagcagttccagtacgatgacagtgggaacaccttcttctacttcctcacctccttcgtggggctcatcgtgatcccggcgacatactacctctggccccgagatcagaatgccgagcaaattcgattaaagaatatcagaaaagtatatggaaggtgtatgtggtatcgtttacggttattaaaaccccagccaaatattattcctacagtaaagaaaatagttctgcttgcaggatgggcattgttcttattccttgcatataaagtttccaaaacagaccgagaataccaagaatacaatccttatgaagtattaaatttggatcctggagccacagtagcagaaattaaaaaacaatatcgtttgctgtcacttaaatatcatccagataaaggaggtgatgaggttatgttcatgaggatagcaaaagcttatgctgctttaacggatgaagagtcccggaaaaattgggaagaatttggaaatccagatgggcctcaagccacaagctttggaattgccctgccagcttggatagttgaccagaaaaattcaattctggttttacttgtatatggattggcatttatggttatccttccagttgttgtgggctcttggtggtatcgctcaatacgctatagtggagaccagattctaatacgcacaacacagatttatacatactttgtttataaaacccgaaatatggatatgaaacgtcttatcatggttttggctggagcttctgaatttgatcctcagtataataaagatgccacaagcagaccaacggataatattctaataccacagctaatcagagaaattggcagcattaatttaaagaagaatgagcctccacttacctgcccatatagcctgaaggccagagttcttttactgtctcatcttgctagaatgaaaattcctgagacccttgaagaagatcagcaattcatgctaaaaaagtgtcctgccctacttcaagaaatggttaatgtaatctgccaactaatagtaatggcccggaaccgtgaagaaagggagtttcgtgctccaactttggcatccctagaaaactgcatgaagctttctcagatggccgttcagggacttcagcaatttaagtctccccttctgcagctccctcatattgaagaggacaatcttagacgggtttctaatcataagaagtataaaattaaaactatccaggatttggtgagtttaaaagaatcagatcgtcacactctactgcacttccttgaagatgaaaaatatgaagaggttatggctgtccttgggagttttccatatgtgaccatggatataaaatcacaggtgttagatgatgaagatagcaacaacatcacagtaggatccttagttacagtgttggttaagttgacaaggcaaacaatggctgaagtatttgaaaaggagcagtccatctgtgctgcagaggaacagccagcagaagatgggcagggtgaaactaacaagaacaggacaaaaggaggatggcaacagaagagtaaaggacccaagaaaactgctaaatcaaaaaaaaagaaacctttaaaaaaaaaacctacacctgtgctattaccacagtcaaagcaacagaaacaaaagcaggcaaatggagtcgttgggaatgaagctgcagtaaaggaagatgaagaagaagtttcagataagggcagtgattctgaagaagaagaaaccaatagagattcccaaagtgagaaagatgatggtagtgacagagactctgatagagagcaagatgaaaaacaaaacaaagatgatgaagcagagtggcaagaattacaacaaagcatacagcgaaaagagagagctctattggaaaccaaatcaaaaataacacatcctgtgtatagcctttactttcctgaggaaaaacaagaatggtggtggctttacattgcagataggaaggagcagacattaatatccatgccatatcatgtgtgtacgctgaaagatacagaggaggtagagctgaagtttcctgcaccaggcaagcctggaaattatcagtatactgtgtttctgagatcagactcctatatgggtttggatcagattaaaccattgaaggacgtcctaatagacgatcggccagtcacaagcttaagtcgctgtgcacgatcgactctagaagcatcgggcgattgccagacgggggcagcaacaccaagaggacagcaagggtcttgatgatagcatgaaggaaaatgagaagggagaatacgaggaagtg

SEQ ID NO: 312649 - DNA, 1750 bp, Homo sapiens
agctggcgacggcggcggcagcggcagaggtggcggcggcgtgtccgtgagagtggcgtgggggcggggaggagaggcggcggcggcagtgtccaagctacgccactcgggctggggcgttgggagcgggagtgcagagcgtggtcgtggcggcggcggtgagaagagcgaggcggaggagggggtgccatggccgggcagcagttccagtacgatgacagtgggaacaccttcttctacttcctcacctccttcgtggggctcatcgtgatcccggcgacatactacctctggccccgagatcagaatgccgagcaaattcgattaaagaatatcagaaaagtatatggaaggtgtatgtggtatcgtttacggttattaaaaccccagccaaatattattcctacagtaaagaaaatagttctgcttgcaggatgggcattgttcttattccttgcatataaagtttccaaaacagaccgagaataccaagaatacaatccttatgaagtattaaatttggatcctggagccacagtagcagaaattaaaaaacaatatcgtttgctgtcacttaaatatcatccagataaaggaggtgatgaggttatgttcatgaggatagcaaaagcttatgctgctttaacggatgaagagtcccggaaaaattgggaagaatttggaaatccagatgggcctcaagccacaagctttggaattgccctgccagcttggatagttgaccagaaaaattcaattctggttttacttgtatatggattggcatttatggttatccttccagttgttgtgggctcttggtggtatcgctcaatacgctatagtggagaccagattctaatacgcacaacacagatttatacatactttgtttataaaacccgaaatatggatatgaaacgtcttatcatggttttggctggagcttctgaatttgatcctcagtataataaagatgccacaagcagaccaacggataatattctaataccacagctaatcagagaaattggcagcattaatttaaagaagaatgagcctccacttacctgcccatatagcctgaaggccagagttcttttactgtctcatcttgctagaatgaaaattcctgagacccttgaagaagatcagcaattcatgctaaaaaagtgtcctgccctacttcaagaaatggttaatgtaatctgccaactaatagtaatggcccggaaccgtgaagaaagggagtttcgtgctccaactttggcatccctagaaaactgcatgaagctttctcagatggccgttcagggacttcagcaatttaagtctccccttctgcagctccctcatattgaagaggacaatcttagacgggtttctaatcataagaagtataaaattaaaactatccaggatttggtgagtttaaaagaatcagatcgtcacactctactgcacttccttgaagatgaaaaatatgaagaggttatggctgtccttgggagttttccatatgtgaccatggatataaaatcacaggtgttagatgatgaagatagcaacaacatcacagtaggatccttagttacagtgttggttaagttgacaaggcaaacaatggctgaagtatttgaaaaggagcagtccatctgtgctgcagaggaacagccagcagaagatgggcagggtgaaactaacaagaacaggtccagggcagaggaccaacgtctacgcggccgcgaat

SEQ ID NO: 312650 - DNA, 621 bp, Homo sapiens
agagagactcgtgccgaattcggcagagccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatg

SEQ ID NO: 312651 - DNA, 795 bp, Homo sapiens
ggcagataatgggaggagccgggcccgagcgagctctttcctttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatgaaaaaaaacaatgccttatcatatatgtaaaacccagcccatgaccctaaaaggggcctctagac

SEQ ID NO: 312652 - DNA, 730 bp, Homo sapiens
ggcagataatgggaggagccgggcccgagcgagctctttcctttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatg

SEQ ID NO: 312653 - DNA, 784 bp, Homo sapiens
ggcagataatgggaggagccgggcccgagcgagctctttcctttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatgaaaaaaaaaaaacccgggccacagtcggggcgggcaagggttgaatggctggca

SEQ ID NO: 312654 - DNA, 718 bp, Homo sapiens
atccttaattaaattaatccccccccgcctttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatg

SEQ ID NO: 312655 - DNA, 604 bp, Homo sapiens
ttcattggtctcattggggtctaaccagaccttcttcttgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatg

SEQ ID NO: 312656 - DNA, 866 bp, Homo sapiens
  misc_feature (855)..(855): n is a, c, g, or t
  misc_feature (859)..(859): n is a, c, g, or t
atccttaattaaattaatccccccccgcctttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatgaaaaaaaaaaaaaaaaaaaaaaaaaaaaagcgggggttttttggggggggggaaaaggggtataaagggcgggatagtgtgttcggacccgtttttggaagggggaaatgggggcccaaagggggggataatgaagnggtngataaag

SEQ ID NO: 312657 - DNA, 1160 bp, Homo sapiens
aggatccttaataaattaatccccccccccccgctttcctttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatgaaaaaaaaaaaaaaaaaaaaaattgcagttccacttgccccaattttattttagactggacaggtttaaccctgggggcccaattcggaataatttggccaaataccccttattggggcggctttaaaaataacggggcggggtttaaaaaagggcgttccgaaaaaaaccgggggttacccaaattaatggctttggaaaaaattcccattttgccaaagtgggaaataaccaatgggcccacaacgtgagcctttaccaaaaagggcgaactcttaaggggcattgggaatataaaggcttaaactttttttaaaaaccccgttaaattttttggaaacaaggctcttttttaaaccaaagggcaaaatcggggaaaatccttaaaaaccaataaaaagccccaaaacgttcagagggcgtcccttttaa

SEQ ID NO: 312658 - DNA, 391 bp, Homo sapiens
  misc_feature (14)..(14): n is a, c, g, or t
  misc_feature (18)..(18): n is a, c, g, or t
ctcggtaccccgcngatnaggccgattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatg

SEQ ID NO: 312659 - DNA, 373 bp, Homo sapiens
  misc_feature (5)..(5): n is a, c, g, or t
  misc_feature (15)..(15): n is a, c, g, or t
  misc_feature (19)..(19): n is a, c, g, or t
  misc_feature (37)..(38): n is a, c, g, or t
  misc_feature (47)..(47): n is a, c, g, or t
  misc_feature (53)..(53): n is a, c, g, or t
  misc_feature (62)..(62): n is a, c, g, or t
gcganctaccctagngganccttcgggctgcattaanncgttacgangatcgntcgccacangtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatg

SEQ ID NO: 312660 - DNA, 322 bp, Homo sapiens
  misc_feature (17)..(17): n is a, c, g, or t
  misc_feature (20)..(20): n is a, c, g, or t
  misc_feature (23)..(23): n is a, c, g, or t
gactactactactatanggntgntagaagacgacagaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatg

SEQ ID NO: 312661 - DNA, 319 bp, Homo sapiens
gcggccgcctactactactactactgctcgaattcaagcttctaacgatgtacggggaggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatg

SEQ ID NO: 312662 - DNA, 923 bp, Homo sapiens
aaagtaccctgtgcccctcccctcttcaaggggtctacatggcaactgtgaggaggggagattcagtgtggtgggggactgagcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccgggtttgtctgagtaccatacgttggccctcttgtggatttaccatacgatccagcccattgaaacaattaaaagcaaggcgttaaaataaaggacaaaccatgcgaaatccccgaaggggcatctaaattttcggggggttgggggaaaaaagacaggcgtcactgaaaatgggcgcactctggcacaaggggggtcctgagccccagagtttttggcacacacaagggcggaaacctcgcgccggtctcca

SEQ ID NO: 312663 - DNA, 249 bp, Homo sapiens
atcgatcgagctcggcccatgttcagataggccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatg

SEQ ID NO: 312664 - DNA, 454 bp, Homo sapiens
  misc_feature (412)..(412): n is a, c, g, or t
gcggccgctactactactaaattcgcggccgcgtcgacggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatgaaaanaaagtcgacgcggccgcgaatttagtagtagtaggcggccgc

SEQ ID NO: 312665 - DNA, 272 bp, Homo sapiens
  misc_feature (17)..(19): n is a, c, g, or t
  misc_feature (25)..(25): n is a, c, g, or t
  misc_feature (34)..(34): n is a, c, g, or t
tgccgcggtttctctannngactcncccgcagantaggcatgcgcagataaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatg

SEQ ID NO: 312666 - DNA, 242 bp, Homo sapiens
taatcgagctcggcccgcttataggccgcagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatg

SEQ ID NO: 312667 - DNA, 391 bp, Homo sapiens
  misc_feature (21)..(21): n is a, c, g, or t
  misc_feature (37)..(37): n is a, c, g, or t
  misc_feature (64)..(64): n is a, c, g, or t
  misc_feature (99)..(99): n is a, c, g, or t
gggaatttttaaaagtcagantttcctaagccctctnagctgattggttatttccctatgaatncctacacatggttatccccccctacttgagataanctaaatataaaccagctacttgatgtaactgagaatttgtgtggatatttatttaaacaaatgtgtaatttggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatg

SEQ ID NO: 312668 - DNA, 226 bp, Homo sapiens
ctgaggtgactctagaggtccccggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatg

SEQ ID NO: 312669 - DNA, 294 bp, Homo sapiens
  misc_feature (17)..(19): n is a, c, g, or t
  misc_feature (25)..(25): n is a, c, g, or t
  misc_feature (34)..(34): n is a, c, g, or t
tgccgcggtttctctannngactcncccgcagantaggcatgcgcagataaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatgctgcggggtacctctctgcttc

SEQ ID NO: 312670 - DNA, 618 bp, Homo sapiens
aaagtaccctgtgcccctcccctcttcaaggggtctacatggcaactgtgaggaggggagattcagtgtggtgggggactgagcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcatagcggaagggtacagccaatgcccgaataccttcaactgagaaatgtcattgagcgactccaccctcagctactgacccgtgcccccggcacctcggtttctgctttcgaagactctgctgccatccgttctcccagtcccaagggtccacgatgtacaaagtcatttcggccagtaggtgtgcagacccctccccgccacgatcgtcgctgtgcttggtgtgtaggaccctaggctccccgcccaccctctgcctggtcgcgctcttcagtcccacgaggagcttgacacgtccta

SEQ ID NO: 312671 - DNA, 629 bp, Homo sapiens
ggcagataatgggaggagccgggcccgagcgagctctttcctttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacggcctctaaaaaagcgctcttaggccattaaaccttcccattttggtctggcaatacg

SEQ ID NO: 312672 - DNA, 903 bp, Homo sapiens
tgtctcatcttgagcctgtttcttactccttgatatttgatgtgttttctgcctgtgtgcaaatcagaaagttggtgctggtattggaattgagagtatccctggtaggaggtcacatttactaagtccctacctacactatgccaaggattctgtactttctagtttcagaatgatcgaaggaagctccttacaacgtgctgtgttgccttggtgcactgcctgttacacccacattctgcatgaagtgaatggggaattattgctgtatttgtgcttcctttaaaattgagtaaacgaaagaacttacgtagttgggatcatcatctggaaaatggaagtaatgctacttaaaatgaggttgtgaggattaaatgagttaaggaccctgacttgaaactatattcacttggtgtacttatacacagtgggcctgggtagtggcccgttcctaactcatcttctccacaggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatg

SEQ ID NO: 312673 - DNA, 435 bp, Homo sapiens
tctgtcttaggaatacagctgttcccttagaggcacccactcctctgtcctgtacacacccactcttcctgtctcgtagggactagaggttagttgaagcaggagcctttggtgggcccagcaactcattccagaagctgactaggctcaaagggagaggtctggggatgtgcttctgtctccctagcatctcatctcttcccaaactgacccgtcttttctcttccctgaccagtgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatg

SEQ ID NO: 312674 - DNA, 144 bp, Homo sapiens
ctcccactttgtctgtacatactgggaggttttatttcttggtctcttcctccttggataagaaataaaacctcccactttgtctgtacatactggcctctgtgattacatagatcagccattaaaataaaacaagccttaatg

SEQ ID NO: 312675 - DNA, 130 bp, Homo sapiens
cctcagcctggtcagcccagagcttcttgcgggccttatctgcgcaagaaataaaacctcccactttgtctgtacatactggcctctgtgattacatagatcagccattaaaataaaacaagccttaatg

SEQ ID NO: 312676 - DNA, 199 bp, Homo sapiens
gcagaagggtgagtctagagtgatcccagcgcaggataggccaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatg

SEQ ID NO: 312677 - DNA, 240 bp, Homo sapiens
cttgttttattttaatggctgatctatgtaatcacaagagtgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatg

SEQ ID NO: 312678 - DNA, 334 bp, Homo sapiens
aacatgcgaacggactgatctatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatg

SEQ ID NO: 312679 - DNA, 516 bp, Homo sapiens
tagaggatccccgcagactatggcagttcatggttgcatggtgacttgatgacccatagtcaaatgttcggtctccaccaaagcctagtaacaggccaggagctgtctcaagaggaaagcagttatctgcagaagatggcaggccttgctccaaaatcctagaggcctccacggtgattcatctatgggggcctgccaaaggctccaaagggcatccttatctgcgtggcaaataaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccggtcttgctattgttgcccagagctgaactcacaacacctgagtctcaagatgatcctccacacctacagcctctcaagatagctgggattacagcgctggtattacctcgaagtcacgttgctccattaaaacatcatatgcc

SEQ ID NO: 312680 - DNA, 314 bp, Homo sapiens
tgcgcagataaggcaggaaactttattgaataatcttttctttggggtagagaagttgagaaaccaaagcgtatccaggtcagagaggagagagatccgacaggaagagaagagcgcagataggccgcaagaagctcctggctgaccaggctgaggcccgcaggtctaagaccaaggaagcacgcaagcgccgtgaagagcgcctccaggccaagaaggcacaagggttttacaagcaagaacgatgccaaggaacaagcgaccacagagaatagaacgtctcacgttgtactgacatagaggcctgcgtgatt

SEQ ID NO: 312681 - DNA, 255 bp, Homo sapiens
tatctagaggatccgggtactgaggcggtatcgtctcatggtcatacctgtgccatgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatg

SEQ ID NO: 312682 - DNA, 263 bp, Homo sapiens
cagtgttgccctgggtgatctagaggatccctgcgcacataggggtagcagaagctccgtggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatg

SEQ ID NO: 312683 - DNA, 428 bp, Homo sapiens
tgaggttactctagaggaccccgcggataggcatgaaggaggagatcatcaagactttatccaaggaggaagagaccaagaaataaaacctcccacttgtgtctgtacatactggcctctgtgattacatagatcagccattaaaataaaacaagccttatctgcgcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatg

SEQ ID NO: 312684 - DNA, 406 bp, Homo sapiens
gcagacgctacaactacaaaatacgcggccgtcagacggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatg

SEQ ID NO: 312685 - DNA, 801 bp, Homo sapiens
ggcagataatgggaggagccgggcccgagcgagctctttcctttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatgaaaaaaaaactggccgcggttacaacgtcggactgggaaccctggcgtcccactaatggcttgcccccttt

SEQ ID NO: 312686 - DNA, 832 bp, Homo sapiens
  misc_feature (153)..(153): n is a, c, g, or t
  misc_feature (202)..(202): n is a, c, g, or t
  misc_feature (214)..(214): n is a, c, g, or t
  misc_feature (246)..(246): n is a, c, g, or t
agcgggaggtcttgccttgcgctgctgctgccgctgccgtgatgtagtgctcatggttgtcagcatacgacggacgtcgctggtcataggtgtgcctcacgccatggtgggcaacagaagtaacggtctgggttagcaccccactacatgagnatcgcatgatgaccggtacgtcacactggcaacaagcttccgtctcggncacgcactccgngtaaccgctgcatccatacatgtactgcgtgnctgcattgcagtcacggcaacgccactgttgcacgggatcgcacttgccgcgtggactgcgcagtgcgcagcgatcacgagcatgcattgtgtccgcgccacgggaaaatggtgcggggcagcgctgcggacgagtaggtaacgcggaaggggtacagtgcgacgtcgcgacatgcccgagagggtcacattgcatcaggagaatgaggatcatgcgctcgtggtgctctggtaaccagtacctgtgaactctaaagaaagatcgatcggcacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatg

SEQ ID NO: 312687 - DNA, 406 bp, Homo sapiens
  misc_feature (1)..(1): n is a, c, g, or t
natttcgccccctctctccctcctcccctcgccctcgggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatg

SEQ ID NO: 312688 - DNA, 780 bp, Homo sapiens
tctaatcatgttttctgtgtgtgcatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatgagccaacacaccaccaacaaccccccggcgcccattttccggtgcgcacaaacaccgctccacacacggcgcgccggcccacgcccgca

SEQ ID NO: 312689 - DNA, 631 bp, Homo sapiens
cagtcacgaggccgacgattcgtctggattatgacctggcccgcggactgacagaaatccaccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatg

SEQ ID NO: 312690 - DNA, 226 bp, Homo sapiens
tgcgcagattaggcccgcagactggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatg

SEQ ID NO: 312691 - DNA, 191 bp, Homo sapiens
tcggtctacttgtttctcggctctacttgtatcacagcctgtacctgaaggtgaaggggaatgtgttcaaaaacaagcggattctcatggaacacatccacaagctgaaggcagacaaggtagagccgcagagacacaggtagagccgcagagacaagggtagagccagagagacaaggtagcagccagag

SEQ ID NO: 312692 - DNA, 735 bp, Homo sapiens
actcccgacccggggaggtagtgacgaaaaaaaaaaaaaaaaagaaaaaaaaaaaagcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatg

SEQ ID NO: 312693 - DNA, 711 bp, Homo sapiens
  misc_feature (12)..(12): n is a, c, g, or t
tccccccattcnccttgaagcctttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatg

SEQ ID NO: 312694 - DNA, 842 bp, Homo sapiens
  misc_feature (1)..(2): n is a, c, g, or t
  misc_feature (20)..(20): n is a, c, g, or t
  misc_feature (37)..(37): n is a, c, g, or t
nnaatccagtgaatgaagcntcttatgatggcaaatncagcttcctattgataggacatagtgaaagtgggtacaacgtagtacgtgtcgtgtagtacgatatctagtgatgagtttgctaatacaatgccagtcaggccacctacggtgaagacacttgacccactcgagtgggtcagttatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatg

SEQ ID NO: 312695 - DNA, 581 bp, Homo sapiens
  misc_feature (8)..(8): n is a, c, g, or t
  misc_feature (11)..(12): n is a, c, g, or t
  misc_feature (19)..(19): n is a, c, g, or t
ccgctacnacnncaaggtnatctcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatg

SEQ ID NO: 312696 - DNA, 662 bp, Homo sapiens
ttcattggtctcattggggtctaaccagaccttcttcttgccaactcccgaggacactagaggcgagcctcttctgaagcctgagcatactcatggctgcggccgcagtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatg

SEQ ID NO: 312697 - DNA, 575 bp, Homo sapiens
  misc_feature (19)..(19): n is a, c, g, or t
caaagaattcggcacgagncgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatg

SEQ ID NO: 312698 - DNA, 498 bp, Homo sapiens
atgtcgaggtgactctaccaggatcttctgtgctttgggacggcggaagggcaggcacatgggcatgtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatg

SEQ ID NO: 312699 - DNA, 976 bp, Homo sapiens
tggattcccactcatcttgactcagagtgcttttagggctgcttcctcctgaaggaacatccttctgtgagccttgcttttcctcctgtaggctggcagaggacagtggagcagccaacacacaaaactaccgtttgtgcatggctaaagaccggggtgattttatagcatcctgggcatttcacatccatgaagtaggaattggggctctgcaccaggcgtttcttcttgtgtttcctgttctcctcttctggagagggatgaaggagatcctttgccagaggcatgttctcgtgtgcgtaggtcgctcgtgccgaattcggcacgagtttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggagtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatg

SEQ ID NO: 312700 - DNA, 476 bp, Homo sapiens
atcagctcggtccggcttctggaccttctcaggcacatgggcatgtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatg

SEQ ID NO: 312701 - DNA, 999 bp, Homo sapiens
atccttaattaaattaatccccccccgcctttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatgaaaaaaaaaaaaaaaaaaaaaaaaaaaaaaaaaaaaaaaaaaaaaaacaaaaaaaaaaaaaaaaaaaagcatttcggccgcctgggcccaatggattttagacccaagaaaatttatgcattccacctaatttaaaactaatttggccaatttgccctaaagggagtcgtattaaaattaactggccgaaatctaaaacgtcggaattggaaaaaccctggctgtaccaaacttaatagccttgtagaaataccctttttgccagttggcgtaatacctga

SEQ ID NO: 312702 - DNA, 782 bp, Homo sapiens
aggatccttaataaattaatccccccccccccgctttcctttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatgaaaaaaaaaaaacccgggccacagtcggggcgggcaagggttgaatggctggca

SEQ ID NO: 312703 - DNA, 1249 bp, Homo sapiens
  misc_feature (751)..(751): n is a, c, g, or t
aggatccttaataaattaatccccccccccccgctttcctttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatgaaaaaaaaaaaaaaaaaaaaaanaaaaaaaaaaaaaaaaaaaaaaaaaaaaaaaaaaaaaaaaaaaaaaaaaaaaaaaaaaaaaaaaaaaaaaaaaaaaaaaaaaaaaaaattgcagttccacttgccccaattttattttagactggacaggtttaaccctgggggcccaattcggaataatttggccaaataccccttattggggcggctttaaaaataacggggcggggtttaaaaaagggcgttccgaaaaaaaccgggggttacccaaattaatggctttggaaaaaattcccattttgccaaagtgggaaataaccaatgggcccacaacgtgagcctttaccaaaaagggcgaactcttaaggggcattgggaatataaaggcttaaactttttttaaaaaccccgttaaattttttggaaacaaggctcttttttaaaccaaagggcaaaatcggggaaaatccttaaaaaccaataaaaagccccaaaacgttcagagggcgtcccttttaa

SEQ ID NO: 312704 - DNA, 1383 bp, Homo sapiens
  misc_feature (26)..(26): n is a, c, g, or t
ctagtagaggctgggtttgaatcggncgaggcgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatgaaaaaaaaaaaaaaaaaacaaaaaaaaaaaaaaaaaaaaggcgggggttttttggggggggggaaaaaaggggtgggaaaagagagggggccaggggggaagggttcgggagaccccacagtctttttgtgttcgcacagggggggagcaaatctcttggcgacggcgcccccccaataaggaagaggagagcgaagataattaactatctaagagatagaccgccgagggagaatccaccgttgttttataatgagctccgtgcgcgagtaacgagccacatacaaccaagctagcaagcagcagacgcaacagacagccacgacaaaccaacagaaccaagaagcgacacacaactgcacaaggcaaaaccaaatagtaatgcaagaaagcaaccagacgcacacagaggaggcaccaacaggaacacacatacagatcggcacgaaccaaaacctcgaggcaaatcaatccgacacccaaacccacacgaatgcgtagacaaaacacgcacacaagagcaggaacaaacagaggacgcgacaacagacgataggaagaagggaaggcagcaagaaagcagcaacagcaaccaaccggaaccagacgaaagagcagaagaaagaagagcgattgacgacacgatgacgccagaaaacacacgcaacagagagcgag

SEQ ID NO: 312705 - DNA, 1029 bp, Homo sapiens
  misc_feature (26)..(26): n is a, c, g, or t
  misc_feature (757)..(757): n is a, c, g, or t
ctagtagaggctgggtttgaatcggncgaggcgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatgaaaaaaaaaaaaaaaaaacaaaaaaaaaaaaaaaaaaaaggggggggggggncaaaaatttcccccgggggggcccaaagttaacggggaacccgaggtttcgtgtgggaccaaagggggccccaatagggagagggaatataaacgaaggagagggggggattacacagggcgggcgtggagaaacggacgggggatctgggagaggagcctacctgtgggggcgacctattgtgccacacccacagagttacgccgaaggaacataatcttcgggtattgggtcacacgcgaatgttgggaaagtcgtaggatagtaaatag

SEQ ID NO: 312706 - DNA, 767 bp, Homo sapiens
aggatccttaataaattaatccccccccccccgctttcctttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatgcaagcctatctgcgcatggggatccttagatcgacctca

SEQ ID NO: 312707 - DNA, 1279 bp, Homo sapiens
aggatccttaataaattaatccccccccccccgctttcctttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatgaaaacaacacaaacaaaaaaacaacacaacaccaaactcggggcaactaacaagcgggcgagcggcggcacacacgcgcgcaacaaaaaagggcaccggggaccaactccaaggaaccacagaccacaagctcccgtctgcacaacccgcgcccaacaacaagacgcacaccaacaaagagagaacacaaaaaaccccacaccccaccaggaacaaccgagaaaaacgacacaccgacaccgacacaccccacagtacaccccaccaccaaaagaagcaacaaaccagcagcaaaacaacaaaaagaatcaataaaacagataaacaacaaaaaacataaagatccacacaccaaatatacacaacaaaacagacacgacccacgttaaaacaaaaaccataataacgcaccaaactcagttattcaagaatccagttccaaacatccaaacacaacaccagtgacaatcaatctaatcaaacaaaacaaaacgcgactaaacacacaaaagatagaagaactacaaagagaacgaccaccaaaaaaataa

SEQ ID NO: 312708 - DNA, 1115 bp, Homo sapiens
aggatccttaataaattaatccccccccccccgctttcctttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatgaaaaaaaaaaaaaaaaaaaaaaaaaaaaaaaaaaaaaaaaaaaaaaaaaaaaaaaacaaaaaaaaaaaaaaaaaaaagggggctttgggggggggggaaaaagggaaagagagagcagcagagcggtgtaataaaacgtagggtcatagaacaacccccttttttgagcaagaagggggcatgataattcggggcgggccccaaaataggggggcgcagtataaaatttctaagaaacgagcgggtctcccccttgtgatttatcgcggctcaaagaaatcccctcaagcaacaccgtactcaccaagacgactcaccgtcgataacgcgctacactacacacatacaagcaatagaccaaaccgccaccacaacaacacaccccgt

SEQ ID NO: 312709 - DNA, 1054 bp, Homo sapiens
  misc_feature (782)..(782): n is a, c, g, or t
aggatccttaataaattaatccccccccccccgctttcctttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatgaaaaaaaaaaaaaaaaaaacaaaaaaaaaaaaaaaaaaaaaagggggggggggncaaaaatttcccccgggggggcccaaagttaacggggaacccgaggtttcgtgtgggaccaaagggggccccaatagggagagggaatataaacgaaggagagggggggattacacagggcgggcgtggagaaacggacgggggatctgggagaggagcctacctgtgggggcgacctattgtgccacacccacagagttacgccgaaggaacataatcttcgggtattgggtcacacgcgaatgttgggaaagtcgtaggatagtaaatag

SEQ ID NO: 312710 - DNA, 355 bp, Homo sapiens
  misc_feature (14)..(14): n is a, c, g, or t
  misc_feature (18)..(18): n is a, c, g, or t
ctcggtaccccgcngatnaggcctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatg

SEQ ID NO: 312711 - DNA, 1142 bp, Homo sapiens
  misc_feature (644)..(644): n is a, c, g, or t
agagagactcgtgccgaattcggcagagccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatgaaaaaaaaaaaaaaaaaaaaaanaaaaaaaaaaaaaaaaaaaaaaaaaaaaaaaaaaaaaaaaaaaaaaaaaaaaaaaaaaaaaaaaaaaaaaaaaaaaaaaaaaaaaaaattgcagttccacttgccccaattttattttagactggacaggtttaaccctgggggcccaattcggaataatttggccaaataccccttattggggcggctttaaaaataacggggcggggtttaaaaaagggcgttccgaaaaaaaccgggggttacccaaattaatggctttggaaaaaattcccattttgccaaagtgggaaataaccaatgggcccacaacgtgagcctttaccaaaaagggcgaactcttaaggggcattgggaatataaaggcttaaactttttttaaaaaccccgttaaattttttggaaacaaggctcttttttaaaccaaagggcaaaatcggggaaaatccttaaaaaccaataaaaagccccaaaacgttcagagggcgtcccttttaa

SEQ ID NO: 312712 - DNA, 928 bp, Homo sapiens
  misc_feature (656)..(656): n is a, c, g, or t
ttcattggtctcattggggtctaaccagaccttcttcttgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatgaaaaaaaaaaaaaaaaaacaaaaaaaaaaaaaaaaaaaaggggggggggggncaaaaatttcccccgggggggcccaaagttaacggggaacccgaggtttcgtgtgggaccaaagggggccccaatagggagagggaatataaacgaaggagagggggggattacacagggcgggcgtggagaaacggacgggggatctgggagaggagcctacctgtgggggcgacctattgtgccacacccacagagttacgccgaaggaacataatcttcgggtattgggtcacacgcgaatgttgggaaagtcgtaggatagtaaatag

SEQ ID NO: 312713 - DNA, 680 bp, Homo sapiens
atccttaattaaattaatccccccccgcctttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaagaaataaaacctcccactttgtctgtacatactggcctctgtgattacatagatcagccattaaaataaaacaagccttaatg

SEQ ID NO: 312714 - DNA, 642 bp, Homo sapiens
atccttaattaaattaatccccccccgcctttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctatcctcctgtgacaccttccccaccctgccagccaaagtgtccacccaagagcaagtaacggcttcaggattcatcaggagcatgagaggataaggata

SEQ ID NO: 312715 - DNA, 794 bp, Homo sapiens
gcggccgctactactactaaattcgcggccgcgtcgacggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatgaaaaaaaaaaaaaaaaaaaaaaaaaaaaaaaaaaaaaaaaaaaaaaaaaaaaaaaacaaaaaaaaaaaaaaaaaaaagggggctttgggggggggggaaaaagggaaagagagagcagcagagcggtgtaataaaacgtagggtcatagaacaacccccttttttgagcaagaagggggcatgataattcggggcgggccccaaaataggggggcgcagtataaaatttctaagaaacgagcgggtctcccccttgtgatttatcgcggctcaaagaaatcccctcaagcaacaccgtactcaccaagacgactcaccgtcgataacgcgctacactacacacatacaagcaatagaccaaaccgccaccacaacaacacaccccgt

SEQ ID NO: 312716 - DNA, 880 bp, Homo sapiens
  misc_feature (382)..(382): n is a, c, g, or t
gcggccgcctactactactactactgctcgaattcaagcttctaacgatgtacggggaggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatgaaaaaaaaaaaaaaaaaacaaaaaaaaaaaaaaaaaaaagaaaaaaaaaaaaaaaaaaaaaanaaaaaaaaaaaaaaaaaaaaaaaaaaaaaaaaaaaaaaaaaaaaaaaaaaaaaaaaaaaaaaaaaaaaaaaaaaaaaaaaaaaaaaaattgcagttccacttgccccaattttattttagactggacaggtttaaccctgggggcccaattcggaataatttggccaaataccccttattggggcggctttaaaaataacggggcggggtttaaaaaagggcgttccgaaaaaaaccgggggttacccaaattaatggctttggaaaaaattcccattttgccaaagtgggaaataaccaatgggcccacaacgtgagcctttaccaaaaagggcgaactcttaaggggcattgggaatataaaggcttaaactttttttaaaaaccccgttaaattttttggaaacaaggctcttttttaaaccaaagggcaaaatcggggaaaatccttaaaaaccaataaaaagccccaaaacgttcagagggcgtcccttttaa

SEQ ID NO: 312717 - DNA, 339 bp, Homo sapiens
  misc_feature (17)..(19): n is a, c, g, or t
  misc_feature (25)..(25): n is a, c, g, or t
  misc_feature (34)..(34): n is a, c, g, or t
tgccgcggtttctctannngactcncccgcagantaggcatgcgcagataaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatgcctctgtgattacatagatcagccattaaaataaaacaagccttatctgcgcagtgcctaatctgcg

SEQ ID NO: 312718 - DNA, 331 bp, Homo sapiens
  misc_feature (17)..(19): n is a, c, g, or t
  misc_feature (25)..(25): n is a, c, g, or t
  misc_feature (34)..(34): n is a, c, g, or t
tgccgcggtttctctannngactcncccgcagantaggcatgcgcagataaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccggtcttgctattgttgcccagagctgaactcacaacacctgagtctcaagatgatcctccacacctacagcctctcaagatagctgggattacagcgctggtattacctcgaagtcacgttgctccattaaaacatcatatgcc

SEQ ID NO: 312719 - DNA, 325 bp, Homo sapiens
cagccatgggtagggagcctttctaagaaagtttttctattctggtctttctttttttccctgtatgtcatcaggatagcccaacagtttatttgccaggcaagttctatctaggaactgcacacaaaaaagtcatggtttaggaagtaattcatgcagcaataggagaaaagaaaggaagctacaagcttagtgaccttgggtggaggaacagctcacaaggcagcctctgatccatcaccaaccagcatctcttcactccgtgtaccctgcaggtatcacagcctgtacctgaaggtgaaggggaatgtgttcaaaaacaagc

SEQ ID NO: 312720 - DNA, 858 bp, Homo sapiens
atgagcccagaaattcaagaccggcctgggcaacatagggagactgtctcaaagacaaagggtatttctcacaacctctgtttgtgaaggaaaaagaaaagatagaggttttttgggtttttgaaggcaagaaataagttccagtgtttccatcctttttgagaccgtggggccaagaatgtgagcagtgtctctggcctggcctatttggactctgtgatgtgcttgggccccagttgactgaccaggtgcattatgctttcccaggtcagcagatccggaagctcatcaaagatgggctgatcatccgcaagcctgtgacggtccattcccgggctcgatgccggaaaaacaccttggcccgccggaagggcaggcacatgggcataggtaagtgtggtcatcttctccttaagaaatgataggtgctggcatctatgctgaaatatattcaggatctaagcactctgtctcatcttgagcctgtttcttactccttgatatttgatgtgttttctgcctgtgtgcaaatcagaaagttggtgctggtattggaattgagagtatccctggtaggaggtcacatttactaagtccctacctacactatgccaaggattctgtactttctagtttcagaatgatcgaaggaagctccttacaacgtgctgtgttgccttggtgcactgcctgttacacccacattctgcatgaagtgaatggggaattattgctgtatttgtgcttcctttaaaattgagtaaacgaaagaacttacgtagttgggatcatcatctggaaaatggaagtaatgctacttaaaatgaggttgtgaggattaaatgagttaaggaccct

SEQ ID NO: 312721 - DNA, 728 bp, Homo sapiens
aggatccttaataaattaatccccccccccccgctttcctttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatg

SEQ ID NO: 312722 - DNA, 717 bp, Homo sapiens
aagtgagcgtagtgcgagccggttggtgtaattcggccgaggcgcagccatgaggtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatg

SEQ ID NO: 312723 - DNA, 864 bp, Homo sapiens
  misc_feature (26)..(26): n is a, c, g, or t
  misc_feature (853)..(853): n is a, c, g, or t
  misc_feature (857)..(857): n is a, c, g, or t
ctagtagaggctgggtttgaatcggncgaggcgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatgaaaaaaaaaaaaaaaaaacaaaaaaaaaaaaaaaaaaaaggcgggggttttttggggggggggaaaaggggtataaagggcgggatagtgtgttcggacccgtttttggaagggggaaatgggggcccaaagggggggataatgaagnggtngataaag

SEQ ID NO: 312724 - DNA, 816 bp, Homo sapiens
  misc_feature (706)..(706): n is a, c, g, or t
  misc_feature (709)..(709): n is a, c, g, or t
cgcttgcagaaatgcgcgccgagcccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatgtaacacnttngtgtgtgtgtggttggtttgtttggtttttgttgttgttgttggtgttgggtgttgtgggtgtggtgcgtgggatgtgtggggggttgttgtggggtgtgtcgttga

SEQ ID NO: 312725 - DNA, 322 bp, Homo sapiens
gcggccgctactactactaaattcgcggccgcgtcgacggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatg

SEQ ID NO: 312726 - DNA, 1001 bp, Homo sapiens
agcgggctgacatatcgtagcccgcagtggcagtcaccttgtgtctctcgtgtacccaagcaagatcagcctgctagctgtccgtcgcgactgctgagacaaccaagatgggtctgctacgtactcacatgtagcatacacatgcagatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatgaaaaaaaaaaataaaagaacttgcggaactaagttctcacagcgagcggacaaatatggcaagtgaaagttatccaagacaggaggaatttggccgctaagggcatcttcaaggctgaacctgaatgagtttcttaaactcgggaaaactggtctacagagtggctactcgtgaagttgcgtgtccaagtttactccaacccgtgacgacgattccttttctttaagccaccaaaaacaccagaatgttcttgggcaaacagggccggcgaatcgggaaa

SEQ ID NO: 312727 - DNA, 284 bp, Homo sapiens
gtgttcggcgcggttcccccagctgtctctggctgaaccggcgctctcgcctccctgccgaacacagcgtgagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatg

SEQ ID NO: 312728 - DNA, 398 bp, Homo sapiens
  misc_feature (11)..(11): n is a, c, g, or t
  misc_feature (23)..(23): n is a, c, g, or t
  misc_feature (194)..(194): n is a, c, g, or t
  misc_feature (198)..(198): n is a, c, g, or t
cccgggctgcnggaaattcggcncgaggtttatttgggattttgaaatgcaacaaaaattttccgatcactcatctagctgaaaaagaaatggtagttactggaattagtaaacacttttatcttgagttactttttaatgaacactgctcattacaactttacaaaccaaaagtagttactggaattagtaanaccnacccccgaattcggcacgaggatcatcaagactttatccaaggaggaagagaccaagaaataaaacctccttcttggcctggaggcgctcttcacggcgcttgcgtgcttccttgaagaaataaaacctcccactttgtctgtacatactggcctctgtgattacatagatcagccattaaaataaaacaagccttaatg

SEQ ID NO: 312729 - DNA, 658 bp, Homo sapiens
tcggtaccacctcgttattcatcggcaccagtgtcgtcagcagagagaggaagcacaggctcaaggttggtagtgaagtcaggttcggggtgcatagtattgtggctattcatcggcacctcgctattcatcggcacccggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatgaaaaaaaaaaaaaaaaaaaaaaaaaaaaaaaaaaaaaaaaaaaaaaaaaaaacccgggggggctctatatatggggggggggagagaaaagagggggaaaaaaaggcgacgaaggggcgaaaaacgggggtcccgagagccacagttttcttgggacaaggggggagaaaacctcgggaggggctccccatatgagagggaggcggcgagataataatgtcgagaataaccgcgagggtgaaacccgggaataaaacg

SEQ ID NO: 312730 - DNA, 692 bp, Homo sapiens
cggacgcgtgggtcgacccacgcgtccggctatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatg

SEQ ID NO: 312731 - DNA, 283 bp, Homo sapiens
cgcggcccgcgcgcgacgacagggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatg

SEQ ID NO: 312732 - DNA, 1018 bp, Homo sapiens
tggattcccactcatcttgactcagagtgcttttagggctgcttcctcctgaaggaacatccttctgtgagccttgcttttcctcctgtaggctggcagaggacagtggagcagccaacacacaaaactaccgtttgtgcatggctaaagaccggggtgattttatagcatcctgggcatttcacatccatgaagtaggaattggggctctgcaccaggcgtttcttcttgtgtttcctgttctcctcttctggagagggatgaaggagatcctttgccagaggcatgttctcgtgtgcgtaggtcgctcgtgccgaattcggcacgagtttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatg

SEQ ID NO: 312733 - DNA, 755 bp, Homo sapiens
aaagtaccctgtgcccctcccctcttcaaggggtctacatggcaactgtgaggaggggagattcagtgtggtgggggactgagcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatg

SEQ ID NO: 312734 - DNA, 721 bp, Homo sapiens
agcgggctgacatatcgtagcccgcagtggcagtcaccttgtgtctctcgtgtacccaagcaagatcagcctgctagctgtccgtcgcgactgctgagacaaccaagatgggtctgctacgtactcacatgtagcatacacatgcagatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatg

SEQ ID NO: 312735 - DNA, 1031 bp, Homo sapiens
  misc_feature (759)..(759): n is a, c, g, or t
atccttaattaaattaatccccccccgcctttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatgaaaaaaaaaaaaaaaaaaaaaaaaaaaaagggggggggggncaaaaatttcccccgggggggcccaaagttaacggggaacccgaggtttcgtgtgggaccaaagggggccccaatagggagagggaatataaacgaaggagagggggggattacacagggcgggcgtggagaaacggacgggggatctgggagaggagcctacctgtgggggcgacctattgtgccacacccacagagttacgccgaaggaacataatcttcgggtattgggtcacacgcgaatgttgggaaagtcgtaggatagtaaatag

SEQ ID NO: 312736 - DNA, 793 bp, Homo sapiens
aggatccttaataaattaatccccccccccccgctttcctttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatgaaaaaaaacaatgccttatcatatatgtaaaacccagcccatgaccctaaaaggggcctctagac

SEQ ID NO: 312737 - DNA, 771 bp, Homo sapiens
  misc_feature (739)..(740): n is a, c, g, or t
  misc_feature (749)..(749): n is a, c, g, or t
aggatccttaataaattaatccccccccccccgctttcctttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatgaaaaaaaaaannaaaactcgngactagttctctctctctctcc

SEQ ID NO: 312738 - DNA, 845 bp, Homo sapiens
  misc_feature (735)..(735): n is a, c, g, or t
  misc_feature (738)..(738): n is a, c, g, or t
aggatccttaataaattaatccccccccccccgctttcctttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatgtaacacnttngtgtgtgtgtggttggtttgtttggtttttgttgttgttgttggtgttgggtgttgtgggtgtggtgcgtgggatgtgtggggggttgttgtggggtgtgtcgttga

SEQ ID NO: 312739 - DNA, 1266 bp, Homo sapiens
  misc_feature (26)..(26): n is a, c, g, or t
  misc_feature (768)..(768): n is a, c, g, or t
ctagtagaggctgggtttgaatcggncgaggcgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatgaaaaaaaaaaaaaaaaaacaaaaaaaaaaaaaaaaaaaagaaaaaaaaaaaaaaaaaaaaaanaaaaaaaaaaaaaaaaaaaaaaaaaaaaaaaaaaaaaaaaaaaaaaaaaaaaaaaaaaaaaaaaaaaaaaaaaaaaaaaaaaaaaaaattgcagttccacttgccccaattttattttagactggacaggtttaaccctgggggcccaattcggaataatttggccaaataccccttattggggcggctttaaaaataacggggcggggtttaaaaaagggcgttccgaaaaaaaccgggggttacccaaattaatggctttggaaaaaattcccattttgccaaagtgggaaataaccaatgggcccacaacgtgagcctttaccaaaaagggcgaactcttaaggggcattgggaatataaaggcttaaactttttttaaaaaccccgttaaattttttggaaacaaggctcttttttaaaccaaagggcaaaatcggggaaaatccttaaaaaccaataaaaagccccaaaacgttcagagggcgtcccttttaa

SEQ ID NO: 312740 - DNA, 1053 bp, Homo sapiens
  misc_feature (826)..(826): n is a, c, g, or t
aggatccttaataaattaatccccccccccccgctttcctttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatgagaacaaaaaaacaaacaaaactcgggcggcacacagctgcggggcggagaaagaaggtcgagcaagggccagggtcaatgactgttccggacccgangtttgcggcacagggggaaactccccgggtcccacatggagccgacactcagcaacacgggcaacgtgatataagcagctatacacaacgaagaacactacgagcaccaccgtcgagcacagcacggcgacaccactctaaccgaaggtgcagcgtccaccccacacccgctccgacgcacctgaacgtgaccacacacacgtagacgacgactacgactaagacag

SEQ ID NO: 312741 - DNA, 775 bp, Homo sapiens
  misc_feature (733)..(733): n is a, c, g, or t
aggatccttaataaattaatccccccccccccgctttcctttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatgaaaanaaagtcgacgcggccgcgaatttagtagtagtaggcggccgc

SEQ ID NO: 312742 - DNA, 1042 bp, Homo sapiens
aggatccttaataaattaatccccccccccccgctttcctttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatgaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaagcatttcggccgcctgggcccaatggattttagacccaagaaaatttatgcattccacctaatttaaaactaatttggccaatttgccctaaagggagtcgtattaaaattaactggccgaaatctaaaacgtcggaattggaaaaaccctggctgtaccaaacttaatagccttgtagaaataccctttttgccagttggcgtaatacctga

SEQ ID NO: 312743 - DNA, 823 bp, Homo sapiens
  misc_feature (651)..(651): n is a, c, g, or t
atccttaattaaattaatccccccccgcctttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggagggaaggggggaaacggaattccaatttccaaaggaacttttttatttccaaagnggaaggggcgaaagggaagggaaaccccaaaaaggaaaaaaaattttaaaaaaaaaagccctttctccccccaaaaaccttttttggttccttgtacatactgggcctctgtgattacatagatcagccattaaaataaaacaagccttatctgcgcagtgcctaatctgcg

SEQ ID NO: 312744 - DNA, 957 bp, Homo sapiens
tggattcccactcatcttgactcagagtgcttttagggctgcttcctcctgaaggaacatccttctgtgagccttgcttttcctcctgtaggctggcagaggacagtggagcagccaacacacaaaactaccgtttgtgcatggctaaagaccggggtgattttatagcatcctgggcatttcacatccatgaagtaggaattggggctctgcaccaggcgtttcttcttgtgtttcctgttctcctcttctggagagggatgaaggagatcctttgccagaggcatgttctcgtgtgcgtaggtcgctcgtgccgaattcggcacgagtttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatg

SEQ ID NO: 312745 - DNA, 272 bp, Homo sapiens
atcgatcgagctcggcccatgttcagataggccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatgaacatgggccgagctcgattgta

SEQ ID NO: 312746 - DNA, 3372 bp, Homo sapiens
cccttgcactgcctctggcacctggggcagccgcgcccgcggagttttccgcccggcgctgacggctgctgcgcccgcggctccccagtgccccgagtgccccgcgggccccgcgagcgggagtgggacccagccctaggcagaacccaggcgccgcgcccgggacgcccgcggagagagccactcccgcccacgtcccatttcgcccctcgcgtccggagtccccgtggccagatctaaccatgagctaccctggctatcccccgcccccaggtggctacccaccagctgcaccaggtggtggtccctggggaggtgctgcctaccctcctccgcccagcatgccccccatcgggctggataacgtggccacctatgcggggcagttcaaccaggactatctctcgggaatggcggccaacatgtctgggacatttggaggagccaacatgcccaacctgtaccctggggcccctggggctggctacccaccagtgccccctggcggctttgggcagcccccctctgcccagcagcctgttcctccctatgggatgtatccacccccaggaggaaacccaccctccaggatgccctcatatccgccatacccaggggcccctgtgccgggccagcccatgccaccccccggacagcagcccccaggggcctaccctgggcagccaccagtgacctaccctggtcagcctccagtgccactccctgggcagcagcagccagtgccgagctacccaggatacccggggtctgggactgtcacccccgctgtgcccccaacccagtttggaagccgaggcaccatcactgatgctcccggctttgaccccctgcgagatgccgaggtcctgcggaaggccatgaaaggcttcgggacggatgagcaggccatcattgactgcctggggagtcgctccaacaagcagcggcagcagatcctactttccttcaagacggcttacggcaaggatttgatcaaagatctgaaatctgaactgtcaggaaactttgagaagacaatcttggctctgatgaagaccccagtcctctttgacatttatgagataaaggaagccatcaagggggttggcactgatgaagcctgcctgattgagatcctcgcttcccgcagcaatgagcacatccgagaattaaacagagcctacaaagcagaattcaaaaagaccctggaagaggccattcgaagcgacacatcagggcacttccagcggctcctcatctctctctctcagggaaaccgtgatgaaagcacaaacgtggacatgtcactcgcccagagagatgcccaggagctgtatgcggccggggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcgggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctgactcatgcaatcattcccctttgcctgtggctaagacttggcttcatttcgtcatgtaattgtatatttttatttggaggcatattttcttttcttacagtcattgccagacagaggcatacaagtctgtttgctgcatacacatttctggtgagggcgactgggtgggtgaagcaccgtgtcctcgctgaggagagaaagggaggcgtgcctgagagggtagcctgtgcatctggtgagtgtgtcacgagctttgttactgccaaactcactcctttttagaaaaaacaaaaaaaaagggccagaaagtcattccttccatcttccttgcagaaaccacgagaacaaagccagttccctgtcagtgacagggcttcttgtaatttgtggtatgtgccttaaacctgaatgtctgtagccaaaacttgtttccacattaagagtcagccagctctggaatggtctggaaatgtcttcctggtaccaacttgttttcttctgcttgattctgccctgtggctcagaggtctggccttatcagccagtgaaagttcatgtaaccttacgtagagatttgtgtgcaggaaaccctgagcatacactagtttgcagggactcgtaaggacatgggaagggaggttcccgaaatccaggcaggaggcccagacacctgaaaggcaaagggatcttggttggttgcaggtgcagtgaagtccactgaaggtgtggtgcgaagaatgcagtccttcacccaggtcccaggagggaagaagggtgtgtgctaattcctggtgcccctcggcgggggccagagagaaggatggggacaacccagagagtcacaagaccagtgcctcccctcagggtgcctccaggctgaaaggggctcctggctctggtctctggggaccctgtgcccgttggttggtggtgtgagggaagagaatccataagagagtttctgagaattatggtgtcatgtccagaagctagagcttaccttgcatcaggggtctccacccactccttttccaacctcctgcgttgaggtttagaaaagagagaatcgactaggcactatggctcacgcctgtaatccaaggactttgggaagctgaggtgagaggatcacttgagctcaggagttcaagactagcctagccaacagcgagacccctgtctctactaaaaaatttggccaggcgtggtggctcacggctgtaatcccagcactttgggaggtgaggcgggcagatcacctgaggtcaggagttcgagacccagcctggccaacatggtgaaaccccatctctactaaaaatacaaaaattagccaggcatggtggcacattcctgt

SEQ ID NO: 312747 - DNA, 782 bp, Homo sapiens
cccttgcactgcctctggcacctggggcagccgcgcccgcggagttttccgcccggcgctgacggctgctgcgcccgcggctccccagtgccccgagtgccccgcgggccccgcgagcgggagtgggacccagccctaggcagaacccaggcgccgcgcccgggacgcccgcggagagagccactcccgcccacgtcccatttcgcccctcgcgtccggagtccccgtggccagatctaaccatgagctaccctggctatcccccgcccccaggtggctacccaccagctgcaccaggtggtggtccctggggaggtgctgcctaccctcctccgcccagcatgccccccatcgggctggataacgtggccacctatgcggggcagttcaaccaggactatctctcgggaatggctggccaacactgtctcgggacggtttggagggaggccagacagtgcccagaccttgtatccctggtggcccctgtggtgcttggcttaccctagcctacttgcctcccgtggcctggcttttggcgcacgtgcccaccgtcatggtccgcaagctatgccctagtatccgtcccctagttggaatcggtaatcccatgcgccgcaaagcgatggggaaagccgcgagcccgtgcccacgtgagttggccccttccaataagtacttgcctattagtcccaattgggggccctcccttggtgaaccctggggccttatagacccaatgccgatgcccacactggtgcaaatgtaattgacccacacat

SEQ ID NO: 312748 - DNA, 656 bp, Homo sapiens
caaaatacattctcagctgtgtggtctaacgctcaaattctgaactcacatgagccttgcaattgcaccatggggaccacgtcctcccaccttagactcagtagcatttgatgatggtgggcatgtcatcacaggaaactcactgtgtttccttggctgtatgaatgaagctgttgttagagaattagtgattctaggctgggcacagtggctcacgcctgtaatcccagcactttgggaggctgaggcaggtggatcatttgaggtcaggagttcgagaccagcctggccaacaaggtaaaaccctgtctctactaaaaatacaaaattagctgggcttgcctgtaatcccagctaattaggtaggctgcggcaggagaattgcttgaacccgggagacagaggttgcagtgagctgggatcacgccattccacttcagtcttggtgacagagtgagacttcgtctcaaaaaaaaaaagagagttaataattcattacagagtatctcctgcatgccagcaagctatggacatctggaagaagccacatgccttgccctcaagttgcttagggtggaaggaaatgattagaaatgagccaagccgagcctgcactcttagagtaagtgtagtggcctcagacagaggagagatcc

SEQ ID NO: 312749 - DNA, 3421 bp, Homo sapiens
cccttgcactgcctctggcacctggggcagccgcgcccgcggagttttccgcccggcgctgacggctgctgcgcccgcggctccccagtgccccgagtgccccgcgggccccgcgagcgggagtgggacccagccctaggcagaacccaggcgccgcgcccgggacgcccgcggagagagccactcccgcccacgtcccatttcgcccctcgcgtccggagtccccgtggccaggtgtgtgtctggggaagagacttacagaagtggagttgctgagtcaaagatctaaccatgagctaccctggctatcccccgcccccaggtggctacccaccagctgcaccaggtggtggtccctggggaggtgctgcctaccctcctccgcccagcatgccccccatcgggctggataacgtggccacctatgcggggcagttcaaccaggactatctctcgggaatggcggccaacatgtctgggacatttggaggagccaacatgcccaacctgtaccctggggcccctggggctggctacccaccagtgccccctggcggctttgggcagcccccctctgcccagcagcctgttcctccctatgggatgtatccacccccaggaggaaacccaccctccaggatgccctcatatccgccatacccaggggcccctgtgccgggccagcccatgccaccccccggacagcagcccccaggggcctaccctgggcagccaccagtgacctaccctggtcagcctccagtgccactccctgggcagcagcagccagtgccgagctacccaggatacccggggtctgggactgtcacccccgctgtgcccccaacccagtttggaagccgaggcaccatcactgatgctcccggctttgaccccctgcgagatgccgaggtcctgcggaaggccatgaaaggcttcgggacggatgagcaggccatcattgactgcctggggagtcgctccaacaagcagcggcagcagatcctactttccttcaagacggcttacggcaaggatttgatcaaagatctgaaatctgaactgtcaggaaactttgagaagacaatcttggctctgatgaagaccccagtcctctttgacatttatgagataaaggaagccatcaagggggttggcactgatgaagcctgcctgattgagatcctcgcttcccgcagcaatgagcacatccgagaattaaacagagcctacaaagcagaattcaaaaagaccctggaagaggccattcgaagcgacacatcagggcacttccagcggctcctcatctctctctctcagggaaaccgtgatgaaagcacaaacgtggacatgtcactcgcccagagagatgcccaggagctgtatgcggccggggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcgggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctgactcatgcaatcattcccctttgcctgtggctaagacttggcttcatttcgtcatgtaattgtatatttttatttggaggcatattttcttttcttacagtcattgccagacagaggcatacaagtctgtttgctgcatacacatttctggtgagggcgactgggtgggtgaagcaccgtgtcctcgctgaggagagaaagggaggcgtgcctgagagggtagcctgtgcatctggtgagtgtgtcacgagctttgttactgccaaactcactcctttttagaaaaaacaaaaaaaaagggccagaaagtcattccttccatcttccttgcagaaaccacgagaacaaagccagttccctgtcagtgacagggcttcttgtaatttgtggtatgtgccttaaacctgaatgtctgtagccaaaacttgtttccacattaagagtcagccagctctggaatggtctggaaatgtcttcctggtaccaacttgttttcttctgcttgattctgccctgtggctcagaggtctggccttatcagccagtgaaagttcatgtaaccttacgtagagatttgtgtgcaggaaaccctgagcatacactagtttgcagggactcgtaaggacatgggaagggaggttcccgaaatccaggcaggaggcccagacacctgaaaggcaaagggatcttggttggttgcaggtgcagtgaagtccactgaaggtgtggtgcgaagaatgcagtccttcacccaggtcccaggagggaagaagggtgtgtgctaattcctggtgcccctcggcgggggccagagagaaggatggggacaacccagagagtcacaagaccagtgcctcccctcagggtgcctccaggctgaaaggggctcctggctctggtctctggggaccctgtgcccgttggttggtggtgtgagggaagagaatccataagagagtttctgagaattatggtgtcatgtccagaagctagagcttaccttgcatcaggggtctccacccactccttttccaacctcctgcgttgaggtttagaaaagagagaatcgactaggcactatggctcacgcctgtaatccaaggactttgggaagctgaggtgagaggatcacttgagctcaggagttcaagactagcctagccaacagcgagacccctgtctctactaaaaaatttggccaggcgtggtggctcacggctgtaatcccagcactttgggaggtgaggcgggcagatcacctgaggtcaggagttcgagacccagcctggccaacatggtgaaaccccatctctactaaaaatacaaaaattagccaggcatggtggcacattcctgt

SEQ ID NO: 312750 - DNA, 3347 bp, Homo sapiens
aaccccattacggctaggtacgaggctgggtggtggacggctgctgcgcccgcggctccccagtgccccgagtgccccgcgggccccgcgagcgggagtgggacccagccctaggcagaacccaggcgccgcgcccgggacgcccgcggagagagccactcccgcccacgtcccatttcgcccctcgcgtccggagtccccgtggccagatctaaccatgagctaccctggctatcccccgcccccaggtggctacccaccagctgcaccaggtggtggtccctggggaggtgctgcctaccctcctccgcccagcatgccccccatcgggctggataacgtggccacctatgcggggcagttcaaccaggactatctctcgggaatggcggccaacatgtctgggacatttggaggagccaacatgcccaacctgtaccctggggcccctggggctggctacccaccagtgccccctggcggctttgggcagcccccctctgcccagcagcctgttcctccctatgggatgtatccacccccaggaggaaacccaccctccaggatgccctcatatccgccatacccaggggcccctgtgccgggccagcccatgccaccccccggacagcagcccccaggggcctaccctgggcagccaccagtgacctaccctggtcagcctccagtgccactccctgggcagcagcagccagtgccgagctacccaggatacccggggtctgggactgtcacccccgctgtgcccccaacccagtttggaagccgaggcaccatcactgatgctcccggctttgaccccctgcgagatgccgaggtcctgcggaaggccatgaaaggcttcgggacggatgagcaggccatcattgactgcctggggagtcgctccaacaagcagcggcagcagatcctactttccttcaagacggcttacggcaaggatttgatcaaagatctgaaatctgaactgtcaggaaactttgagaagacaatcttggctctgatgaagaccccagtcctctttgacatttatgagataaaggaagccatcaagggggttggcactgatgaagcctgcctgattgagatcctcgcttcccgcagcaatgagcacatccgagaattaaacagagcctacaaagcagaattcaaaaagaccctggaagaggccattcgaagcgacacatcagggcacttccagcggctcctcatctctctctctcagggaaaccgtgatgaaagcacaaacgtggacatgtcactcgcccagagagatgcccaggagctgtatgcggccggggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcgggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctgactcatgcaatcattcccctttgcctgtggctaagacttggcttcatttcgtcatgtaattgtatatttttatttggaggcatattttcttttcttacagtcattgccagacagaggcatacaagtctgtttgctgcatacacatttctggtgagggcgactgggtgggtgaagcaccgtgtcctcgctgaggagagaaagggaggcgtgcctgagagggtagcctgtgcatctggtgagtgtgtcacgagctttgttactgccaaactcactcctttttagaaaaaacaaaaaaaaagggccagaaagtcattccttccatcttccttgcagaaaccacgagaacaaagccagttccctgtcagtgacagggcttcttgtaatttgtggtatgtgccttaaacctgaatgtctgtagccaaaacttgtttccacattaagagtcagccagctctggaatggtctggaaatgtcttcctggtaccaacttgttttcttctgcttgattctgccctgtggctcagaggtctggccttatcagccagtgaaagttcatgtaaccttacgtagagatttgtgtgcaggaaaccctgagcatacactagtttgcagggactcgtaaggacatgggaagggaggttcccgaaatccaggcaggaggcccagacacctgaaaggcaaagggatcttggttggttgcaggtgcagtgaagtccactgaaggtgtggtgcgaagaatgcagtccttcacccaggtcccaggagggaagaagggtgtgtgctaattcctggtgcccctcggcgggggccagagagaaggatggggacaacccagagagtcacaagaccagtgcctcccctcagggtgcctccaggctgaaaggggctcctggctctggtctctggggaccctgtgcccgttggttggtggtgtgagggaagagaatccataagagagtttctgagaattatggtgtcatgtccagaagctagagcttaccttgcatcaggggtctccacccactccttttccaacctcctgcgttgaggtttagaaaagagagaatcgactaggcactatggctcacgcctgtaatccaaggactttgggaagctgaggtgagaggatcacttgagctcaggagttcaagactagcctagccaacagcgagacccctgtctctactaaaaaatttggccaggcgtggtggctcacggctgtaatcccagcactttgggaggtgaggcgggcagatcacctgaggtcaggagttcgagacccagcctggccaacatggtgaaaccccatctctactaaaaatacaaaaattagccaggcatggtggcacattcctgt

SEQ ID NO: 312751 - DNA, 3617 bp, Homo sapiens
cccttgcactgcctctggcacctggggcagccgcgcccgcggagttttccgcccggcgctgacggctgctgcgcccgcggctccccagtgccccgagtgccccgcgggccccgcgagcgggagtgggacccagccctaggcagaacccaggcgccgcgcccgggacgcccgcggagagagccactcccgcccacgtcccatttcgcccctcgcgtccggagtccccgtggccagggattattggacctgcctggtttaaactattgtcttagttaattttgtgctgctctaacaaaatatcacagactgagtaatttataagcaatagtagcttatttggctcacagttctggaggctgagaagatcgtgaggctgcatctggcaagggccttcttgctgcttcataacatggcagaagacatcatgcgggtgtgtgtctggggaagagacttacagaagtggagttgctgagtcaaagatctaaccatgagctaccctggctatcccccgcccccaggtggctacccaccagctgcaccaggtggtggtccctggggaggtgctgcctaccctcctccgcccagcatgccccccatcgggctggataacgtggccacctatgcggggcagttcaaccaggactatctctcgggaatggcggccaacatgtctgggacatttggaggagccaacatgcccaacctgtaccctggggcccctggggctggctacccaccagtgccccctggcggctttgggcagcccccctctgcccagcagcctgttcctccctatgggatgtatccacccccaggaggaaacccaccctccaggatgccctcatatccgccatacccaggggcccctgtgccgggccagcccatgccaccccccggacagcagcccccaggggcctaccctgggcagccaccagtgacctaccctggtcagcctccagtgccactccctgggcagcagcagccagtgccgagctacccaggatacccggggtctgggactgtcacccccgctgtgcccccaacccagtttggaagccgaggcaccatcactgatgctcccggctttgaccccctgcgagatgccgaggtcctgcggaaggccatgaaaggcttcgggacggatgagcaggccatcattgactgcctggggagtcgctccaacaagcagcggcagcagatcctactttccttcaagacggcttacggcaaggatttgatcaaagatctgaaatctgaactgtcaggaaactttgagaagacaatcttggctctgatgaagaccccagtcctctttgacatttatgagataaaggaagccatcaagggggttggcactgatgaagcctgcctgattgagatcctcgcttcccgcagcaatgagcacatccgagaattaaacagagcctacaaagcagaattcaaaaagaccctggaagaggccattcgaagcgacacatcagggcacttccagcggctcctcatctctctctctcagggaaaccgtgatgaaagcacaaacgtggacatgtcactcgcccagagagatgcccaggagctgtatgcggccggggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcgggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctgactcatgcaatcattcccctttgcctgtggctaagacttggcttcatttcgtcatgtaattgtatatttttatttggaggcatattttcttttcttacagtcattgccagacagaggcatacaagtctgtttgctgcatacacatttctggtgagggcgactgggtgggtgaagcaccgtgtcctcgctgaggagagaaagggaggcgtgcctgagagggtagcctgtgcatctggtgagtgtgtcacgagctttgttactgccaaactcactcctttttagaaaaaacaaaaaaaaagggccagaaagtcattccttccatcttccttgcagaaaccacgagaacaaagccagttccctgtcagtgacagggcttcttgtaatttgtggtatgtgccttaaacctgaatgtctgtagccaaaacttgtttccacattaagagtcagccagctctggaatggtctggaaatgtcttcctggtaccaacttgttttcttctgcttgattctgccctgtggctcagaggtctggccttatcagccagtgaaagttcatgtaaccttacgtagagatttgtgtgcaggaaaccctgagcatacactagtttgcagggactcgtaaggacatgggaagggaggttcccgaaatccaggcaggaggcccagacacctgaaaggcaaagggatcttggttggttgcaggtgcagtgaagtccactgaaggtgtggtgcgaagaatgcagtccttcacccaggtcccaggagggaagaagggtgtgtgctaattcctggtgcccctcggcgggggccagagagaaggatggggacaacccagagagtcacaagaccagtgcctcccctcagggtgcctccaggctgaaaggggctcctggctctggtctctggggaccctgtgcccgttggttggtggtgtgagggaagagaatccataagagagtttctgagaattatggtgtcatgtccagaagctagagcttaccttgcatcaggggtctccacccactccttttccaacctcctgcgttgaggtttagaaaagagagaatcgactaggcactatggctcacgcctgtaatccaaggactttgggaagctgaggtgagaggatcacttgagctcaggagttcaagactagcctagccaacagcgagacccctgtctctactaaaaaatttggccaggcgtggtggctcacggctgtaatcccagcactttgggaggtgaggcgggcagatcacctgaggtcaggagttcgagacccagcctggccaacatggtgaaaccccatctctactaaaaatacaaaaattagccaggcatggtggcacattcctgt

SEQ ID NO: 312752 - DNA, 3479 bp, Homo sapiens
aaccccattacggctaggtacgaggctgggtggtggacggctgctgcgcccgcggctccccagtgccccgagtgccccgcgggccccgcgagcgggagtgggacccagccctaggcagaacccaggcgccgcgcccgggacgcccgcggagagagccactcccgcccacgtcccatttcgcccctcgcgtccggagtccccgtggccagttctggaggctgagaagatcgtgaggctgcatctggcaagggccttcttgctgcttcataacatggcagaagacatcatgcgggtgtgtgtctggggaagagacttacagaagtggagttgctgagtcaaagatctaaccatgagctaccctggctatcccccgcccccaggtggctacccaccagctgcaccaggtggtggtccctggggaggtgctgcctaccctcctccgcccagcatgccccccatcgggctggataacgtggccacctatgcggggcagttcaaccaggactatctctcgggaatggcggccaacatgtctgggacatttggaggagccaacatgcccaacctgtaccctggggcccctggggctggctacccaccagtgccccctggcggctttgggcagcccccctctgcccagcagcctgttcctccctatgggatgtatccacccccaggaggaaacccaccctccaggatgccctcatatccgccatacccaggggcccctgtgccgggccagcccatgccaccccccggacagcagcccccaggggcctaccctgggcagccaccagtgacctaccctggtcagcctccagtgccactccctgggcagcagcagccagtgccgagctacccaggatacccggggtctgggactgtcacccccgctgtgcccccaacccagtttggaagccgaggcaccatcactgatgctcccggctttgaccccctgcgagatgccgaggtcctgcggaaggccatgaaaggcttcgggacggatgagcaggccatcattgactgcctggggagtcgctccaacaagcagcggcagcagatcctactttccttcaagacggcttacggcaaggatttgatcaaagatctgaaatctgaactgtcaggaaactttgagaagacaatcttggctctgatgaagaccccagtcctctttgacatttatgagataaaggaagccatcaagggggttggcactgatgaagcctgcctgattgagatcctcgcttcccgcagcaatgagcacatccgagaattaaacagagcctacaaagcagaattcaaaaagaccctggaagaggccattcgaagcgacacatcagggcacttccagcggctcctcatctctctctctcagggaaaccgtgatgaaagcacaaacgtggacatgtcactcgcccagagagatgcccaggagctgtatgcggccggggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcgggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctgactcatgcaatcattcccctttgcctgtggctaagacttggcttcatttcgtcatgtaattgtatatttttatttggaggcatattttcttttcttacagtcattgccagacagaggcatacaagtctgtttgctgcatacacatttctggtgagggcgactgggtgggtgaagcaccgtgtcctcgctgaggagagaaagggaggcgtgcctgagagggtagcctgtgcatctggtgagtgtgtcacgagctttgttactgccaaactcactcctttttagaaaaaacaaaaaaaaagggccagaaagtcattccttccatcttccttgcagaaaccacgagaacaaagccagttccctgtcagtgacagggcttcttgtaatttgtggtatgtgccttaaacctgaatgtctgtagccaaaacttgtttccacattaagagtcagccagctctggaatggtctggaaatgtcttcctggtaccaacttgttttcttctgcttgattctgccctgtggctcagaggtctggccttatcagccagtgaaagttcatgtaaccttacgtagagatttgtgtgcaggaaaccctgagcatacactagtttgcagggactcgtaaggacatgggaagggaggttcccgaaatccaggcaggaggcccagacacctgaaaggcaaagggatcttggttggttgcaggtgcagtgaagtccactgaaggtgtggtgcgaagaatgcagtccttcacccaggtcccaggagggaagaagggtgtgtgctaattcctggtgcccctcggcgggggccagagagaaggatggggacaacccagagagtcacaagaccagtgcctcccctcagggtgcctccaggctgaaaggggctcctggctctggtctctggggaccctgtgcccgttggttggtggtgtgagggaagagaatccataagagagtttctgagaattatggtgtcatgtccagaagctagagcttaccttgcatcaggggtctccacccactccttttccaacctcctgcgttgaggtttagaaaagagagaatcgactaggcactatggctcacgcctgtaatccaaggactttgggaagctgaggtgagaggatcacttgagctcaggagttcaagactagcctagccaacagcgagacccctgtctctactaaaaaatttggccaggcgtggtggctcacggctgtaatcccagcactttgggaggtgaggcgggcagatcacctgaggtcaggagttcgagacccagcctggccaacatggtgaaaccccatctctactaaaaatacaaaaattagccaggcatggtggcacattcctgt

SEQ ID NO: 312753 - DNA, 3599 bp, Homo sapiens
cccttgcactgcctctggcacctggggcagccgcgcccgcggagttttccgcccggcgctgacggctgctgcgcccgcggctccccagtgccccgagtgccccgcgggccccgcgagcgggagtgggacccagccctaggcagaacccaggcgccgcgcccgggacgcccgcggagagagccactcccgcccacgtcccatttcgcccctcgcgtccggagtccccgtggccaggtgtgtgtctggggaagagacttacagaagtggagttgctgagtcaaaggaacgatgattccataccttaccaggtccccttgcctgatgaaccagaggttggagaatgaagagagacaggggcctctgacttcccctgttgctggagggatggcaataaggacacaggaagataaatagacagacctggagtcctgagaatgaggcagtgcgtctctacctctgagatctaaccatgagctaccctggctatcccccgcccccaggtggctacccaccagctgcaccaggtggtggtccctggggaggtgctgcctaccctcctccgcccagcatgccccccatcgggctggataacgtggccacctatgcggggcagttcaaccaggactatctctcgggaatggcggccaacatgtctgggacatttggaggagccaacatgcccaacctgtaccctggggcccctggggctggctacccaccagtgccccctggcggctttgggcagcccccctctgcccagcagcctgttcctccctatgggatgtatccacccccaggaggaaacccaccctccaggatgccctcatatccgccatacccaggggcccctgtgccgggccagcccatgccaccccccggacagcagcccccaggggcctaccctgggcagccaccagtgacctaccctggtcagcctccagtgccactccctgggcagcagcagccagtgccgagctacccaggatacccggggtctgggactgtcacccccgctgtgcccccaacccagtttggaagccgaggcaccatcactgatgctcccggctttgaccccctgcgagatgccgaggtcctgcggaaggccatgaaaggcttcgggacggatgagcaggccatcattgactgcctggggagtcgctccaacaagcagcggcagcagatcctactttccttcaagacggcttacggcaaggatttgatcaaagatctgaaatctgaactgtcaggaaactttgagaagacaatcttggctctgatgaagaccccagtcctctttgacatttatgagataaaggaagccatcaagggggttggcactgatgaagcctgcctgattgagatcctcgcttcccgcagcaatgagcacatccgagaattaaacagagcctacaaagcagaattcaaaaagaccctggaagaggccattcgaagcgacacatcagggcacttccagcggctcctcatctctctctctcagggaaaccgtgatgaaagcacaaacgtggacatgtcactcgcccagagagatgcccaggagctgtatgcggccggggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcgggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctgactcatgcaatcattcccctttgcctgtggctaagacttggcttcatttcgtcatgtaattgtatatttttatttggaggcatattttcttttcttacagtcattgccagacagaggcatacaagtctgtttgctgcatacacatttctggtgagggcgactgggtgggtgaagcaccgtgtcctcgctgaggagagaaagggaggcgtgcctgagagggtagcctgtgcatctggtgagtgtgtcacgagctttgttactgccaaactcactcctttttagaaaaaacaaaaaaaaagggccagaaagtcattccttccatcttccttgcagaaaccacgagaacaaagccagttccctgtcagtgacagggcttcttgtaatttgtggtatgtgccttaaacctgaatgtctgtagccaaaacttgtttccacattaagagtcagccagctctggaatggtctggaaatgtcttcctggtaccaacttgttttcttctgcttgattctgccctgtggctcagaggtctggccttatcagccagtgaaagttcatgtaaccttacgtagagatttgtgtgcaggaaaccctgagcatacactagtttgcagggactcgtaaggacatgggaagggaggttcccgaaatccaggcaggaggcccagacacctgaaaggcaaagggatcttggttggttgcaggtgcagtgaagtccactgaaggtgtggtgcgaagaatgcagtccttcacccaggtcccaggagggaagaagggtgtgtgctaattcctggtgcccctcggcgggggccagagagaaggatggggacaacccagagagtcacaagaccagtgcctcccctcagggtgcctccaggctgaaaggggctcctggctctggtctctggggaccctgtgcccgttggttggtggtgtgagggaagagaatccataagagagtttctgagaattatggtgtcatgtccagaagctagagcttaccttgcatcaggggtctccacccactccttttccaacctcctgcgttgaggtttagaaaagagagaatcgactaggcactatggctcacgcctgtaatccaaggactttgggaagctgaggtgagaggatcacttgagctcaggagttcaagactagcctagccaacagcgagacccctgtctctactaaaaaatttggccaggcgtggtggctcacggctgtaatcccagcactttgggaggtgaggcgggcagatcacctgaggtcaggagttcgagacccagcctggccaacatggtgaaaccccatctctactaaaaatacaaaaattagccaggcatggtggcacattcctgt

SEQ ID NO: 312754 - DNA, 3290 bp, Homo sapiens
agtgaactggtctgcgacaagcagggcagatgcagcagtttcttctgcagggtcccagttgtggtggtggctgccctttcaagaagctgggtcccacgggccagcaggggctctcaggcagagcctgaatgtgctttcgtcttctcttccagatctaaccatgagctaccctggctatcccccgcccccaggtggctacccaccagctgcaccaggtggtggtccctggggaggtgctgcctaccctcctccgcccagcatgccccccatcgggctggataacgtggccacctatgcggggcagttcaaccaggactatctctcgggaatggcggccaacatgtctgggacatttggaggagccaacatgcccaacctgtaccctggggcccctggggctggctacccaccagtgccccctggcggctttgggcagcccccctctgcccagcagcctgttcctccctatgggatgtatccacccccaggaggaaacccaccctccaggatgccctcatatccgccatacccaggggcccctgtgccgggccagcccatgccaccccccggacagcagcccccaggggcctaccctgggcagccaccagtgacctaccctggtcagcctccagtgccactccctgggcagcagcagccagtgccgagctacccaggatacccggggtctgggactgtcacccccgctgtgcccccaacccagtttggaagccgaggcaccatcactgatgctcccggctttgaccccctgcgagatgccgaggtcctgcggaaggccatgaaaggcttcgggacggatgagcaggccatcattgactgcctggggagtcgctccaacaagcagcggcagcagatcctactttccttcaagacggcttacggcaaggatttgatcaaagatctgaaatctgaactgtcaggaaactttgagaagacaatcttggctctgatgaagaccccagtcctctttgacatttatgagataaaggaagccatcaagggggttggcactgatgaagcctgcctgattgagatcctcgcttcccgcagcaatgagcacatccgagaattaaacagagcctacaaagcagaattcaaaaagaccctggaagaggccattcgaagcgacacatcagggcacttccagcggctcctcatctctctctctcagggaaaccgtgatgaaagcacaaacgtggacatgtcactcgcccagagagatgcccaggagctgtatgcggccggggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcgggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctgactcatgcaatcattcccctttgcctgtggctaagacttggcttcatttcgtcatgtaattgtatatttttatttggaggcatattttcttttcttacagtcattgccagacagaggcatacaagtctgtttgctgcatacacatttctggtgagggcgactgggtgggtgaagcaccgtgtcctcgctgaggagagaaagggaggcgtgcctgagagggtagcctgtgcatctggtgagtgtgtcacgagctttgttactgccaaactcactcctttttagaaaaaacaaaaaaaaagggccagaaagtcattccttccatcttccttgcagaaaccacgagaacaaagccagttccctgtcagtgacagggcttcttgtaatttgtggtatgtgccttaaacctgaatgtctgtagccaaaacttgtttccacattaagagtcagccagctctggaatggtctggaaatgtcttcctggtaccaacttgttttcttctgcttgattctgccctgtggctcagaggtctggccttatcagccagtgaaagttcatgtaaccttacgtagagatttgtgtgcaggaaaccctgagcatacactagtttgcagggactcgtaaggacatgggaagggaggttcccgaaatccaggcaggaggcccagacacctgaaaggcaaagggatcttggttggttgcaggtgcagtgaagtccactgaaggtgtggtgcgaagaatgcagtccttcacccaggtcccaggagggaagaagggtgtgtgctaattcctggtgcccctcggcgggggccagagagaaggatggggacaacccagagagtcacaagaccagtgcctcccctcagggtgcctccaggctgaaaggggctcctggctctggtctctggggaccctgtgcccgttggttggtggtgtgagggaagagaatccataagagagtttctgagaattatggtgtcatgtccagaagctagagcttaccttgcatcaggggtctccacccactccttttccaacctcctgcgttgaggtttagaaaagagagaatcgactaggcactatggctcacgcctgtaatccaaggactttgggaagctgaggtgagaggatcacttgagctcaggagttcaagactagcctagccaacagcgagacccctgtctctactaaaaaatttggccaggcgtggtggctcacggctgtaatcccagcactttgggaggtgaggcgggcagatcacctgaggtcaggagttcgagacccagcctggccaacatggtgaaaccccatctctactaaaaatacaaaaattagccaggcatggtggcacattcctgt

SEQ ID NO: 312755 - DNA, 3006 bp, Homo sapiens
cccttgcactgcctctggcacctggggcagccgcgcccgcggagttttccgcccggcgctgacggctgctgcgcccgcggctccccagtgccccgagtgccggggcccctggggctggctacccaccagtgccccctggcggctttgggcagcccccctctgcccagcagcctgttcctccctatgggatgtatccacccccaggaggaaacccaccctccaggatgccctcatatccgccatacccaggggcccctgtgccgggccagcccatgccaccccccggacagcagcccccaggggcctaccctgggcagccaccagtgacctaccctggtcagcctccagtgccactccctgggcagcagcagccagtgccgagctacccaggatacccggggtctgggactgtcacccccgctgtgcccccaacccagtttggaagccgaggcaccatcactgatgctcccggctttgaccccctgcgagatgccgaggtcctgcggaaggccatgaaaggcttcgggacggatgagcaggccatcattgactgcctggggagtcgctccaacaagcagcggcagcagatcctactttccttcaagacggcttacggcaaggatttgatcaaagatctgaaatctgaactgtcaggaaactttgagaagacaatcttggctctgatgaagaccccagtcctctttgacatttatgagataaaggaagccatcaagggggttggcactgatgaagcctgcctgattgagatcctcgcttcccgcagcaatgagcacatccgagaattaaacagagcctacaaagcagaattcaaaaagaccctggaagaggccattcgaagcgacacatcagggcacttccagcggctcctcatctctctctctcagggaaaccgtgatgaaagcacaaacgtggacatgtcactcgcccagagagatgcccaggagctgtatgcggccggggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcgggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctgactcatgcaatcattcccctttgcctgtggctaagacttggcttcatttcgtcatgtaattgtatatttttatttggaggcatattttcttttcttacagtcattgccagacagaggcatacaagtctgtttgctgcatacacatttctggtgagggcgactgggtgggtgaagcaccgtgtcctcgctgaggagagaaagggaggcgtgcctgagagggtagcctgtgcatctggtgagtgtgtcacgagctttgttactgccaaactcactcctttttagaaaaaacaaaaaaaaagggccagaaagtcattccttccatcttccttgcagaaaccacgagaacaaagccagttccctgtcagtgacagggcttcttgtaatttgtggtatgtgccttaaacctgaatgtctgtagccaaaacttgtttccacattaagagtcagccagctctggaatggtctggaaatgtcttcctggtaccaacttgttttcttctgcttgattctgccctgtggctcagaggtctggccttatcagccagtgaaagttcatgtaaccttacgtagagatttgtgtgcaggaaaccctgagcatacactagtttgcagggactcgtaaggacatgggaagggaggttcccgaaatccaggcaggaggcccagacacctgaaaggcaaagggatcttggttggttgcaggtgcagtgaagtccactgaaggtgtggtgcgaagaatgcagtccttcacccaggtcccaggagggaagaagggtgtgtgctaattcctggtgcccctcggcgggggccagagagaaggatggggacaacccagagagtcacaagaccagtgcctcccctcagggtgcctccaggctgaaaggggctcctggctctggtctctggggaccctgtgcccgttggttggtggtgtgagggaagagaatccataagagagtttctgagaattatggtgtcatgtccagaagctagagcttaccttgcatcaggggtctccacccactccttttccaacctcctgcgttgaggtttagaaaagagagaatcgactaggcactatggctcacgcctgtaatccaaggactttgggaagctgaggtgagaggatcacttgagctcaggagttcaagactagcctagccaacagcgagacccctgtctctactaaaaaatttggccaggcgtggtggctcacggctgtaatcccagcactttgggaggtgaggcgggcagatcacctgaggtcaggagttcgagacccagcctggccaacatggtgaaaccccatctctactaaaaatacaaaaattagccaggcatggtggcacattcctgt

SEQ ID NO: 312756 - DNA, 3675 bp, Homo sapiens
acggcgagagtggggtcacgggggagatgcgcctctctcgctcctggcgccatctttggcgtgtcaacgaggtgttttccccggccgcgccccaaggggttgacctctccggcaagctcccggtccggaattccgcaatgtttccaagcccgcctcttctggtactccatgaaacctgatcccggtgggcccgctcgggagcacagaaccgcatggaactggactctctttcccagcgttctcccgcccgcatcacctcctggcatctatctggccgagtgacatgtccccgtttgtgctgtcatcacggttccctgagagagagagatgaggacccctgtaaggcgccctgatgtgtcgcttcgaatgccctcttccaggctctttttgaattctgcttttgatagctctgatttaattctcggatgtgctcattgtctgcgggaagcgaggatctcaaatcagcaggcttcatcagctaccaaccccggatgactggcgttcctgttatctcatcaaatctcaaagaggactggggtcttcatcagagccaagatcgtctctcgtccgacagtttcactgacagttcagatttcagcatctttgatctaaatcagttgccgtaacccgtctctgaaggaaagtaggatctactaccactgcttgttggagcgactcccccaggcaggtcaatgatggcctgctcatccgtcccgaagcctctcatggcccttccgcaggaccttcgggcatcatccggcagggggtcaaagaccgggagacatcagtgagtggtcgccatcggcttccaaactgggttgcggggcacatcgggggtgacagtcccagaccccgggtatcctggctagctcggcactgctgctccctccaggatgccctcatatccgccatacccaggggcccctgtgccgggccagcccatgccaccccccggacagcagcccccaggggcctaccctgggcagccaccagtgacctaccctggtcagcctccagtgccactccctgggcagcagcagccagtgccgagctacccaggatacccggggtctgggactgtcacccccgctgtgcccccaacccagtttggaagccgaggcaccatcactgatgctcccggctttgaccccctgcgagatgccgaggtcctgcggaaggccatgaaaggcttcgggacggatgagcaggccatcattgactgcctggggagtcgctccaacaagcagcggcagcagatcctactttccttcaagacggcttacggcaaggatttgatcaaagatctgaaatctgaactgtcaggaaactttgagaagacaatcttggctctgatgaagaccccagtcctctttgacatttatgagataaaggaagccatcaagggggttggcactgatgaagcctgcctgattgagatcctcgcttcccgcagcaatgagcacatccgagaattaaacagagcctacaaagcagaattcaaaaagaccctggaagaggccattcgaagcgacacatcagggcacttccagcggctcctcatctctctctctcagggaaaccgtgatgaaagcacaaacgtggacatgtcactcgcccagagagatgcccaggagctgtatgcggccggggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcgggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctgactcatgcaatcattcccctttgcctgtggctaagacttggcttcatttcgtcatgtaattgtatatttttatttggaggcatattttcttttcttacagtcattgccagacagaggcatacaagtctgtttgctgcatacacatttctggtgagggcgactgggtgggtgaagcaccgtgtcctcgctgaggagagaaagggaggcgtgcctgagagggtagcctgtgcatctggtgagtgtgtcacgagctttgttactgccaaactcactcctttttagaaaaaacaaaaaaaaagggccagaaagtcattccttccatcttccttgcagaaaccacgagaacaaagccagttccctgtcagtgacagggcttcttgtaatttgtggtatgtgccttaaacctgaatgtctgtagccaaaacttgtttccacattaagagtcagccagctctggaatggtctggaaatgtcttcctggtaccaacttgttttcttctgcttgattctgccctgtggctcagaggtctggccttatcagccagtgaaagttcatgtaaccttacgtagagatttgtgtgcaggaaaccctgagcatacactagtttgcagggactcgtaaggacatgggaagggaggttcccgaaatccaggcaggaggcccagacacctgaaaggcaaagggatcttggttggttgcaggtgcagtgaagtccactgaaggtgtggtgcgaagaatgcagtccttcacccaggtcccaggagggaagaagggtgtgtgctaattcctggtgcccctcggcgggggccagagagaaggatggggacaacccagagagtcacaagaccagtgcctcccctcagggtgcctccaggctgaaaggggctcctggctctggtctctggggaccctgtgcccgttggttggtggtgtgagggaagagaatccataagagagtttctgagaattatggtgtcatgtccagaagctagagcttaccttgcatcaggggtctccacccactccttttccaacctcctgcgttgaggtttagaaaagagagaatcgactaggcactatggctcacgcctgtaatccaaggactttgggaagctgaggtgagaggatcacttgagctcaggagttcaagactagcctagccaacagcgagacccctgtctctactaaaaaatttggccaggcgtggtggctcacggctgtaatcccagcactttgggaggtgaggcgggcagatcacctgaggtcaggagttcgagacccagcctggccaacatggtgaaaccccatctctactaaaaatacaaaaattagccaggcatggtggcacattcctgt

SEQ ID NO: 312757 - DNA, 2856 bp, Homo sapiens
cccttgcactgcctctggcacctggggcagccgcgcccgcggagttttccgcccggcgctgacggctgctgcgcccgcggctccccagtgccccgagtgccgcccctgtgccgggccagcccatgccaccccccggacagcagcccccaggggcctaccctgggcagccaccagtgacctaccctggtcagcctccagtgccactccctgggcagcagcagccagtgccgagctacccaggatacccggggtctgggactgtcacccccgctgtgcccccaacccagtttggaagccgaggcaccatcactgatgctcccggctttgaccccctgcgagatgccgaggtcctgcggaaggccatgaaaggcttcgggacggatgagcaggccatcattgactgcctggggagtcgctccaacaagcagcggcagcagatcctactttccttcaagacggcttacggcaaggatttgatcaaagatctgaaatctgaactgtcaggaaactttgagaagacaatcttggctctgatgaagaccccagtcctctttgacatttatgagataaaggaagccatcaagggggttggcactgatgaagcctgcctgattgagatcctcgcttcccgcagcaatgagcacatccgagaattaaacagagcctacaaagcagaattcaaaaagaccctggaagaggccattcgaagcgacacatcagggcacttccagcggctcctcatctctctctctcagggaaaccgtgatgaaagcacaaacgtggacatgtcactcgcccagagagatgcccaggagctgtatgcggccggggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcgggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctgactcatgcaatcattcccctttgcctgtggctaagacttggcttcatttcgtcatgtaattgtatatttttatttggaggcatattttcttttcttacagtcattgccagacagaggcatacaagtctgtttgctgcatacacatttctggtgagggcgactgggtgggtgaagcaccgtgtcctcgctgaggagagaaagggaggcgtgcctgagagggtagcctgtgcatctggtgagtgtgtcacgagctttgttactgccaaactcactcctttttagaaaaaacaaaaaaaaagggccagaaagtcattccttccatcttccttgcagaaaccacgagaacaaagccagttccctgtcagtgacagggcttcttgtaatttgtggtatgtgccttaaacctgaatgtctgtagccaaaacttgtttccacattaagagtcagccagctctggaatggtctggaaatgtcttcctggtaccaacttgttttcttctgcttgattctgccctgtggctcagaggtctggccttatcagccagtgaaagttcatgtaaccttacgtagagatttgtgtgcaggaaaccctgagcatacactagtttgcagggactcgtaaggacatgggaagggaggttcccgaaatccaggcaggaggcccagacacctgaaaggcaaagggatcttggttggttgcaggtgcagtgaagtccactgaaggtgtggtgcgaagaatgcagtccttcacccaggtcccaggagggaagaagggtgtgtgctaattcctggtgcccctcggcgggggccagagagaaggatggggacaacccagagagtcacaagaccagtgcctcccctcagggtgcctccaggctgaaaggggctcctggctctggtctctggggaccctgtgcccgttggttggtggtgtgagggaagagaatccataagagagtttctgagaattatggtgtcatgtccagaagctagagcttaccttgcatcaggggtctccacccactccttttccaacctcctgcgttgaggtttagaaaagagagaatcgactaggcactatggctcacgcctgtaatccaaggactttgggaagctgaggtgagaggatcacttgagctcaggagttcaagactagcctagccaacagcgagacccctgtctctactaaaaaatttggccaggcgtggtggctcacggctgtaatcccagcactttgggaggtgaggcgggcagatcacctgaggtcaggagttcgagacccagcctggccaacatggtgaaaccccatctctactaaaaatacaaaaattagccaggcatggtggcacattcctgt

SEQ ID NO: 312758 - DNA, 2641 bp, Homo sapiens
tgtatacggacacgcacacgaccgtctccatccccgagcggcccctttggcaaggaagacgaggcaggtctctttggaagccgaggcaccatcactgatgctcccggctttgaccccctgcgagatgccgaggtcctgcggaaggccatgaaaggcttcgggacggatgagcaggccatcattgactgcctggggagtcgctccaacaagcagcggcagcagatcctactttccttcaagacggcttacggcaaggatttgatcaaagatctgaaatctgaactgtcaggaaactttgagaagacaatcttggctctgatgaagaccccagtcctctttgacatttatgagataaaggaagccatcaagggggttggcactgatgaagcctgcctgattgagatcctcgcttcccgcagcaatgagcacatccgagaattaaacagagcctacaaagcagaattcaaaaagaccctggaagaggccattcgaagcgacacatcagggcacttccagcggctcctcatctctctctctcagggaaaccgtgatgaaagcacaaacgtggacatgtcactcgcccagagagatgcccaggagctgtatgcggccggggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcgggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctgactcatgcaatcattcccctttgcctgtggctaagacttggcttcatttcgtcatgtaattgtatatttttatttggaggcatattttcttttcttacagtcattgccagacagaggcatacaagtctgtttgctgcatacacatttctggtgagggcgactgggtgggtgaagcaccgtgtcctcgctgaggagagaaagggaggcgtgcctgagagggtagcctgtgcatctggtgagtgtgtcacgagctttgttactgccaaactcactcctttttagaaaaaacaaaaaaaaagggccagaaagtcattccttccatcttccttgcagaaaccacgagaacaaagccagttccctgtcagtgacagggcttcttgtaatttgtggtatgtgccttaaacctgaatgtctgtagccaaaacttgtttccacattaagagtcagccagctctggaatggtctggaaatgtcttcctggtaccaacttgttttcttctgcttgattctgccctgtggctcagaggtctggccttatcagccagtgaaagttcatgtaaccttacgtagagatttgtgtgcaggaaaccctgagcatacactagtttgcagggactcgtaaggacatgggaagggaggttcccgaaatccaggcaggaggcccagacacctgaaaggcaaagggatcttggttggttgcaggtgcagtgaagtccactgaaggtgtggtgcgaagaatgcagtccttcacccaggtcccaggagggaagaagggtgtgtgctaattcctggtgcccctcggcgggggccagagagaaggatggggacaacccagagagtcacaagaccagtgcctcccctcagggtgcctccaggctgaaaggggctcctggctctggtctctggggaccctgtgcccgttggttggtggtgtgagggaagagaatccataagagagtttctgagaattatggtgtcatgtccagaagctagagcttaccttgcatcaggggtctccacccactccttttccaacctcctgcgttgaggtttagaaaagagagaatcgactaggcactatggctcacgcctgtaatccaaggactttgggaagctgaggtgagaggatcacttgagctcaggagttcaagactagcctagccaacagcgagacccctgtctctactaaaaaatttggccaggcgtggtggctcacggctgtaatcccagcactttgggaggtgaggcgggcagatcacctgaggtcaggagttcgagacccagcctggccaacatggtgaaaccccatctctactaaaaatacaaaaattagccaggcatggtggcacattcctgt

SEQ ID NO: 312759 - DNA, 2630 bp, Homo sapiens
  misc_feature (25)..(26): n is a, c, g, or t
aaaagggcgaggctctgacgaacannattgcaaagacaaggccaacttcgtattggacaagtttggaagccgaggcaccatcactgatgctcccggctttgaccccctgcgagatgccgaggtcctgcggaaggccatgaaaggcttcgggacggatgagcaggccatcattgactgcctggggagtcgctccaacaagcagcggcagcagatcctactttccttcaagacggcttacggcaaggatttgatcaaagatctgaaatctgaactgtcaggaaactttgagaagacaatcttggctctgatgaagaccccagtcctctttgacatttatgagataaaggaagccatcaagggggttggcactgatgaagcctgcctgattgagatcctcgcttcccgcagcaatgagcacatccgagaattaaacagagcctacaaagcagaattcaaaaagaccctggaagaggccattcgaagcgacacatcagggcacttccagcggctcctcatctctctctctcagggaaaccgtgatgaaagcacaaacgtggacatgtcactcgcccagagagatgcccaggagctgtatgcggccggggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcgggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctgactcatgcaatcattcccctttgcctgtggctaagacttggcttcatttcgtcatgtaattgtatatttttatttggaggcatattttcttttcttacagtcattgccagacagaggcatacaagtctgtttgctgcatacacatttctggtgagggcgactgggtgggtgaagcaccgtgtcctcgctgaggagagaaagggaggcgtgcctgagagggtagcctgtgcatctggtgagtgtgtcacgagctttgttactgccaaactcactcctttttagaaaaaacaaaaaaaaagggccagaaagtcattccttccatcttccttgcagaaaccacgagaacaaagccagttccctgtcagtgacagggcttcttgtaatttgtggtatgtgccttaaacctgaatgtctgtagccaaaacttgtttccacattaagagtcagccagctctggaatggtctggaaatgtcttcctggtaccaacttgttttcttctgcttgattctgccctgtggctcagaggtctggccttatcagccagtgaaagttcatgtaaccttacgtagagatttgtgtgcaggaaaccctgagcatacactagtttgcagggactcgtaaggacatgggaagggaggttcccgaaatccaggcaggaggcccagacacctgaaaggcaaagggatcttggttggttgcaggtgcagtgaagtccactgaaggtgtggtgcgaagaatgcagtccttcacccaggtcccaggagggaagaagggtgtgtgctaattcctggtgcccctcggcgggggccagagagaaggatggggacaacccagagagtcacaagaccagtgcctcccctcagggtgcctccaggctgaaaggggctcctggctctggtctctggggaccctgtgcccgttggttggtggtgtgagggaagagaatccataagagagtttctgagaattatggtgtcatgtccagaagctagagcttaccttgcatcaggggtctccacccactccttttccaacctcctgcgttgaggtttagaaaagagagaatcgactaggcactatggctcacgcctgtaatccaaggactttgggaagctgaggtgagaggatcacttgagctcaggagttcaagactagcctagccaacagcgagacccctgtctctactaaaaaatttggccaggcgtggtggctcacggctgtaatcccagcactttgggaggtgaggcgggcagatcacctgaggtcaggagttcgagacccagcctggccaacatggtgaaaccccatctctactaaaaatacaaaaattagccaggcatggtggcacattcctgt

SEQ ID NO: 312760 - DNA, 2465 bp, Homo sapiens
cccttgcactgcctctggcacctggggcagccgcgcccgcggagttttccgcccggcgctgacggctgctgcgcccgcggctccccagtgccccgagtgccccgcgggccccgcgagcgggagtgggacccagccctaggcagaacccaggcgccgcgcccgggacgcccgcggagagagccactcccgcccacgtcccatttcgcccctcgcgtccggagtccccgtggccaggtgtgtgtctggggaagagacttacagaagtggagttgctgagtcaaagatctaaccatgagctaccctggctatcccccgcccccaggtggctacccaccagctgcaccaggtggtggtccctggggaggtgctgcctaccctcctccgcccagcatgccccccatcgggctggataacgtggccacctatgcggggcagttcaaccaggactatctctcgggaatggcggccaacatgtctgggacatttggaggagccaacatgcccaacctgtaccctggggcccctggggctggctacccaccagtgccccctggcggctttgggcagcccccctctgcccagcagcctgttcctccctatgggatgtatccacccccaggaggaaacccaccctccaggatgccctcatatccgccatacccaggggcccctgtgccgggccagcccatgccaccccccggacagcagcccccaggggcctaccctgggcagccaccagtgacctaccctggtcagcctccagtgccactccctgggcagcagcagccagtgccgagctacccaggatacccggggtctgggactgtcacccccgctgtgcccccaacccagtttggaagccgaggcaccatcactgatgctcccggctttgaccccctgcgagatgccgaggtcctgcggaaggccatgaaaggcttcgggacggatgagcaggccatcattgactgcctggggagtcgctccaacaagcagcggcagcagatcctactttccttcaagacggcttacggcaaggatttgatcaaagatctgaaatctgaactgtcaggaaactttgagaagacaatcttggctctgatgaagaccccagtcctctttgacatttatgagataaaggaagccatcaagggggttggcactgatgaagcctgcctgattgagatcctcgcttcccgcagcaatgagcacatccgagaattaaacagagcctacaaagcagaattcaaaaagaccctggaagaggccattcgaagcgacacatcagggcacttccagcggctcctcatctctctctctcagggaaaccgtgatgaaagcacaaacgtggacatgtcactcgcccagagagatgcccaggagctgtatgcggccggggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcgggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctaaaaaaaaaaaaaaaaaaaaaaaagaaaaaaaaaaaaaaaacaaaacaccacacaaaaaaagaaggagggggggacgggcagctcacaactcaccagccgagagggggacacacgcagcagacgcacaccgacttgtagacaaagggcgacgcacacaaggggggtgatgacagatcaacacaggaggcacgggccgaaaaataacacagcacaggagaggaaaaaaaccgccagaccggggagagagagactagacaacagaaacatcctctcgcgcgacggaagacgcaaagacaacacaacgcacacgagaaagcccgcccagaacacaacagccagaagggtggtgcaacacaacagtcacccgggaaaagcgacgggcgggcaagaaaaatcacggg

SEQ ID NO: 312761 - DNA, 2483 bp, Homo sapiens
cccttgcactgcctctggcacctggggcagccgcgcccgcggagttttccgcccggcgctgacggctgctgcgcccgcggctccccagtgccccgagtgccccgcgggccccgcgagcgggagtgggacccagccctaggcagaacccaggcgccgcgcccgggacgcccgcggagagagccactcccgcccacgtcccatttcgcccctcgcgtccggagtccccgtggccaggtgtgtgtctggggaagagacttacagaagtggagttgctgagtcaaagatctaaccatgagctaccctggctatcccccgcccccaggtggctacccaccagctgcaccaggtggtggtccctggggaggtgctgcctaccctcctccgcccagcatgccccccatcgggctggataacgtggccacctatgcggggcagttcaaccaggactatctctcgggaatggcggccaacatgtctgggacatttggaggagccaacatgcccaacctgtaccctggggcccctggggctggctacccaccagtgccccctggcggctttgggcagcccccctctgcccagcagcctgttcctccctatgggatgtatccacccccaggaggaaacccaccctccaggatgccctcatatccgccatacccaggggcccctgtgccgggccagcccatgccaccccccggacagcagcccccaggggcctaccctgggcagccaccagtgacctaccctggtcagcctccagtgccactccctgggcagcagcagccagtgccgagctacccaggatacccggggtctgggactgtcacccccgctgtgcccccaacccagtttggaagccgaggcaccatcactgatgctcccggctttgaccccctgcgagatgccgaggtcctgcggaaggccatgaaaggcttcgggacggatgagcaggccatcattgactgcctggggagtcgctccaacaagcagcggcagcagatcctactttccttcaagacggcttacggcaaggatttgatcaaagatctgaaatctgaactgtcaggaaactttgagaagacaatcttggctctgatgaagaccccagtcctctttgacatttatgagataaaggaagccatcaagggggttggcactgatgaagcctgcctgattgagatcctcgcttcccgcagcaatgagcacatccgagaattaaacagagcctacaaagcagaattcaaaaagaccctggaagaggccattcgaagcgacacatcagggcacttccagcggctcctcatctctctctctcagggaaaccgtgatgaaagcacaaacgtggacatgtcactcgcccagagagatgcccaggagctgtatgcggccggggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcgggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagagggggcgcgcggcgcgcgcaccaagctactcaccgccgagggagggcgcccggaccacgcccacgccaccccataccgcaaacgagccggcccgcacacaggcggcgcgcagctgttatatataataacaccggagccagcgagggcacgacgcgacgctaatattaacaccaccgccggcctccaggtgctgaggacacaacgttcactacactgtgcttcacttcttatgtcggagagcaagaaccctacctccttcgctccggtcggcgggcccacactcatgtgtggcacgaaacagaacaaa

SEQ ID NO: 312762 - DNA, 2506 bp, Homo sapiens
cccttgcactgcctctggcacctggggcagccgcgcccgcggagttttccgcccggcgctgacggctgctgcgcccgcggctccccagtgccccgagtgccccgcgggccccgcgagcgggagtgggacccagccctaggcagaacccaggcgccgcgcccgggacgcccgcggagagagccactcccgcccacgtcccatttcgcccctcgcgtccggagtccccgtggccagggggttggcactgatgaagcctgcctgattgagatcctcgcttcccgcagcaatgagcacatccgagaattaaacagagcctacaaagcagaattcaaaaagaccctggaagaggccattcgaagcgacacatcagggcacttccagcggctcctcatctctctctctcagggaaaccgtgatgaaagcacaaacgtggacatgtcactcgcccagagagatgcccaggagctgtatgcggccggggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcgggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctgactcatgcaatcattcccctttgcctgtggctaagacttggcttcatttcgtcatgtaattgtatatttttatttggaggcatattttcttttcttacagtcattgccagacagaggcatacaagtctgtttgctgcatacacatttctggtgagggcgactgggtgggtgaagcaccgtgtcctcgctgaggagagaaagggaggcgtgcctgagagggtagcctgtgcatctggtgagtgtgtcacgagctttgttactgccaaactcactcctttttagaaaaaacaaaaaaaaagggccagaaagtcattccttccatcttccttgcagaaaccacgagaacaaagccagttccctgtcagtgacagggcttcttgtaatttgtggtatgtgccttaaacctgaatgtctgtagccaaaacttgtttccacattaagagtcagccagctctggaatggtctggaaatgtcttcctggtaccaacttgttttcttctgcttgattctgccctgtggctcagaggtctggccttatcagccagtgaaagttcatgtaaccttacgtagagatttgtgtgcaggaaaccctgagcatacactagtttgcagggactcgtaaggacatgggaagggaggttcccgaaatccaggcaggaggcccagacacctgaaaggcaaagggatcttggttggttgcaggtgcagtgaagtccactgaaggtgtggtgcgaagaatgcagtccttcacccaggtcccaggagggaagaagggtgtgtgctaattcctggtgcccctcggcgggggccagagagaaggatggggacaacccagagagtcacaagaccagtgcctcccctcagggtgcctccaggctgaaaggggctcctggctctggtctctggggaccctgtgcccgttggttggtggtgtgagggaagagaatccataagagagtttctgagaattatggtgtcatgtccagaagctagagcttaccttgcatcaggggtctccacccactccttttccaacctcctgcgttgaggtttagaaaagagagaatcgactaggcactatggctcacgcctgtaatccaaggactttgggaagctgaggtgagaggatcacttgagctcaggagttcaagactagcctagccaacagcgagacccctgtctctactaaaaaatttggccaggcgtggtggctcacggctgtaatcccagcactttgggaggtgaggcgggcagatcacctgaggtcaggagttcgagacccagcctggccaacatggtgaaaccccatctctactaaaaatacaaaaattagccaggcatggtggcacattcctgt

SEQ ID NO: 312763 - DNA, 2098 bp, Homo sapiens
ggacgcgtgggtcgacccacgcgtccgatgtcactcgcccagagagatgcccaggagctgtatgcggccggggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcgggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctgactcatgcaatcattcccctttgcctgtggctaagacttggcttcatttcgtcatgtaattgtatatttttatttggaggcatattttcttttcttacagtcattgccagacagaggcatacaagtctgtttgctgcatacacatttctggtgagggcgactgggtgggtgaagcaccgtgtcctcgctgaggagagaaagggaggcgtgcctgagagggtagcctgtgcatctggtgagtgtgtcacgagctttgttactgccaaactcactcctttttagaaaaaacaaaaaaaaagggccagaaagtcattccttccatcttccttgcagaaaccacgagaacaaagccagttccctgtcagtgacagggcttcttgtaatttgtggtatgtgccttaaacctgaatgtctgtagccaaaacttgtttccacattaagagtcagccagctctggaatggtctggaaatgtcttcctggtaccaacttgttttcttctgcttgattctgccctgtggctcagaggtctggccttatcagccagtgaaagttcatgtaaccttacgtagagatttgtgtgcaggaaaccctgagcatacactagtttgcagggactcgtaaggacatgggaagggaggttcccgaaatccaggcaggaggcccagacacctgaaaggcaaagggatcttggttggttgcaggtgcagtgaagtccactgaaggtgtggtgcgaagaatgcagtccttcacccaggtcccaggagggaagaagggtgtgtgctaattcctggtgcccctcggcgggggccagagagaaggatggggacaacccagagagtcacaagaccagtgcctcccctcagggtgcctccaggctgaaaggggctcctggctctggtctctggggaccctgtgcccgttggttggtggtgtgagggaagagaatccataagagagtttctgagaattatggtgtcatgtccagaagctagagcttaccttgcatcaggggtctccacccactccttttccaacctcctgcgttgaggtttagaaaagagagaatcgactaggcactatggctcacgcctgtaatccaaggactttgggaagctgaggtgagaggatcacttgagctcaggagttcaagactagcctagccaacagcgagacccctgtctctactaaaaaatttggccaggcgtggtggctcacggctgtaatcccagcactttgggaggtgaggcgggcagatcacctgaggtcaggagttcgagacccagcctggccaacatggtgaaaccccatctctactaaaaatacaaaaattagccaggcatggtggcacattcctgt

SEQ ID NO: 312764 - DNA, 3298 bp, Homo sapiens
cccttgcactgcctctggcacctggggcagccgcgcccgcggagttttccgcccggcgctgacggctgctgcgcccgcggctccccagtgccccgagtgccccgcgggccccgcgagcgggagtgggacccagccctaggcagaacccaggcgccgcgcccgggacgcccgcggagagagccactcccgcccacgtcccatttcgcccctcgcgtccggagtccccgtggccaggtgtgtgtctggggaagagacttacagaagtggagttgctgagtcaaagatctaaccatgagctaccctggctatcccccgcccccaggtggctacccaccagctgcaccaggtggtggtccctggggaggtgctgcctaccctcctccgcccagcatgccccccatcgggctggataacgtggccacctatgcggggcagttcaaccaggactatctctcgggaatggcggccaacatgtctgggacatttggaggagccaacatgcccaacctgtaccctggggcccctggggctggctacccaccagtgccccctggcggctttgggcagcccccctctgcccagcagcctgttcctccctatgggatgtatccacccccaggaggaaacccaccctccaggatgccctcatatccgccatacccaggggcccctgtgccgggccagcccatgccaccccccggacagcagcccccaggggcctaccctgggcagccaccagtgacctaccctggtcagcctccagtgccactccctgggcagcagcagccagtgccgagctacccaggatacccggggtctgggactgtcacccccgctgtgcccccaacccagtttggaagccgaggcaccatcactgatgctcccggctttgaccccctgcgagatgccgaggtcctgcggaaggccatgaaaggcttcgggacggatgagcaggccatcattgactgcctggggagtcgctccaacaagcagcggcagcagatcctactttccttcaagacggcttacggcaaggatttgatcaaagatctgaaatctgaactgtcaggaaactttgagaagacaatcttggctctgatgaagaccccagtcctctttgacatttatgagataaaggaagccatcaagggggttggcactgatgaagcctgcctgattgagatcctcgcttcccgcagcaatgagcacatccgagaattaaacagagcctacaaagcagaattcaaaaagaccctggaagaggccattcgaagcgacacatcagggcacttccagcggctcctcatctctctctctcagggaaaccgtgatgaaagcacaaacgtggacatgtcactcgcccagagagatgcccaggagctgtatgcggccggggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgaggggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctgactcatgcaatcattcccctttgcctgtggctaagacttggcttcatttcgtcatgtaattgtatatttttatttggaggcatattttcttttcttacagtcattgccagacagaggcatacaagtctgtttgctgcatacacatttctggtgagggcgactgggtgggtgaagcaccgtgtcctcgctgaggagagaaagggaggcgtgcctgagagggtagcctgtgcatctggtgagtgtgtcacgagctttgttactgccaaactcactcctttttagaaaaaacaaaaaaaaagggccagaaagtcattccttccatcttccttgcagaaaccacgagaacaaagccagttccctgtcagtgacagggcttcttgtaatttgtggtatgtgccttaaacctgaatgtctgtagccaaaacttgtttccacattaagagtcagccagctctggaatggtctggaaatgtcttcctggtaccaacttgttttcttctgcttgattctgccctgtggctcagaggtctggccttatcagccagtgaaagttcatgtaaccttacgtagagatttgtgtgcaggaaaccctgagcatacactagtttgcagggactcgtaaggacatgggaagggaggttcccgaaatccaggcaggaggcccagacacctgaaaggcaaagggatcttggttggttgcaggtgcagtgaagtccactgaaggtgtggtgcgaagaatgcagtccttcacccaggtcccaggagggaagaagggtgtgtgctaattcctggtgcccctcggcgggggccagagagaaggatggggacaacccagagagtcacaagaccagtgcctcccctcagggtgcctccaggctgaaaggggctcctggctctggtctctggggaccctgtgcccgttggttggtggtgtgagggaagagaatccataagagagtttctgagaattatggtgtcatgtccagaagctagagcttaccttgcatcaggggtctccacccactccttttccaacctcctgcgttgaggtttagaaaagagagaatcgactaggcactatggctcacgcctgtaatccaaggactttgggaagctgaggtgagaggatcacttgagctcaggagttcaagactagcctagccaacagcgagacccctgtctctactaaaaaatttggccaggcgtggtggctcacggctgtaatcccagcactttgggaggtgaggcgggcagatcacctgaggtcaggagttcgagacccagcctggccaacatggtgaaaccccatctctactaaaaatacaaaaattagccaggcatggtggcacattcctgt

SEQ ID NO: 312765 - DNA, 1985 bp, Homo sapiens
cccttgcactgcctctggcacctggggcagccgcgcccgcggagttttccgcccggcgctgacggctgctgcgcccgcggctccccagtgccccgagtgccccgcgggccccgcgagcgggagtgggacccagccctaggcagaacccaggcgccgcgcccgggacgcccgcggagagagccactcccgcccacgtcccatttcgcccctcgcgtccggagtccccgtggccaggtgtgtgtctggggaagagacttacagaagtggagttgctgagtcaaagatctaaccatgagctaccctggctatcccccgcccccaggtggctacccaccagctgcaccaggtggtggtccctggggaggtgctgcctaccctcctccgcccagcatgccccccatcgggctggataacgtggccacctatgcggggcagttcaaccaggactatctctcgggaatggcggccaacatgtctgggacatttggaggagccaacatgcccaacctgtaccctggggcccctggggctggctacccaccagtgccccctggcggctttgggcagcccccctctgcccagcagcctgttcctccctatgggatgtatccacccccaggaggaaacccaccctccaggatgccctcatatccgccatacccaggggcccctgtgccgggccagcccatgccaccccccggacagcagcccccaggggcctaccctgggcagccaccagtgacctaccctggtcagcctccagtgccactccctgggcagcagcagccagtgccgagctacccaggatacccggggtctgggactgtcacccccgctgtgcccccaacccagtttggaagccgaggcaccatcactgatgctcccggctttgaccccctgcgagatgccgaggtcctgcggaaggccatgaaaggcttcgggacggatgagcaggccatcattgactgcctggggagtcgctccaacaagcagcggcagcagatcctactttccttcaagacggcttacggcaaggatttgatcaaagatctgaaatctgaactgtcaggaaactttgagaagacaatcttggctctgatgaagaccccagtcctctttgacatttatgagataaaggaagccatcaagggggttggcactgatgaagcctgcctgattgagatcctcgcttcccgcagcaatgagcacatccgagaattaaacagagcctacaaagcagaattcaaaaagaccctggaagaggccattcgaagcgacacatcagggcacttccagcggctcctcatctctctctctcagggaaaccgtgatgaaagcacaaacgtggacatgtcactcgcccagagagatgcccaggagctgtatgcggccggggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcgggagatacttcaggggattaccggaagattctgctgaagatctgtggtggcaatgactgaacagtgactggtggctcacttctgcccacctgccggcaacaccacaagtgggaggccaggcaaccaagtgggaggccaggcaaccaagtgggaggccaggcaaccaagtgggaggccagcaaccaagtgggaggccagcaaccaagtgggaggccagcaaccaagtgggaggccag

SEQ ID NO: 312766 - DNA, 3174 bp, Homo sapiens
cccttgcactgcctctggcacctggggcagccgcgcccgcggagttttccgcccggcgctgacggctgctgcgcccgcggctccccagtgccccgagtgccccgcgggccccgcgagcgggagtgggacccagccctaggcagaacccaggcgccgcgcccgggacgcccgcggagagagccactcccgcccacgtcccatttcgcccctcgcgtccggagtccccgtggccaggtgtgtgtctggggaagagacttacagaagtggagttgctgagtcaaagatctaaccatgagctaccctggctatcccccgcccccaggtggctacccaccagctgcaccaggtggtggtccctggggaggtgctgcctaccctcctccgcccagcatgccccccatcgggctggataacgtggccacctatgcggggcagttcaaccaggactatctctcgggaatggcggccaacatgtctgggacatttggaggagccaacatgcccaacctgtaccctggggcccctggggctggctacccaccagtgccccctggcggctttgggcagcccccctctgcccagcagcctgttcctccctatgggatgtatccacccccaggaggaaacccaccctccaggatgccctcatatccgccatacccaggggcccctgtgccgggccagcccatgccaccccccggacagcagcccccaggggcctaccctgggcagccaccagtgacctaccctggtcagcctccagtgccactccctgggcagcagcagccagtgccgagctacccaggatacccggggtctgggactgtcacccccgctgtgcccccaacccagtttggaagccgaggcaccatcactgatgctcccggctttgaccccctgcgagatgccgaggtcctgcggaaggccatgaaaggcttcgggacggatgagcaggccatcattgactgcctggggagtcgctccaacaagcagcggcagcagatcctactttccttcaagacggcttacggcaaggatttgatcaaagatctgaaatctgaactgtcaggaaactttgagaagacaatcttggctctgatgaagaccccagtcctctttgacatttatgagataaaggaagccatcaagggggttggcactgatgaagcctgcctgattgagatcctcgcttcccgcagcaatgagcacatccgagaattaaacagagcctacaaagcagaattcaaaaagaccctggaagaggccattcgaagcgacacatcagggcacttccagcggctcctcatctctctctctcagggaaaccgtgatgaaagcacaaacgtggacatgtcactcgcccagagagatgcccaggagctgtatgcggccggggagaaccgcctgggaacagacgagtccaagttcaatgcggttctgtgctcccggagccgggcccacctggtagcagttttcaatgagtaccagagaatgacaggccgggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctgactcatgcaatcattcccctttgcctgtggctaagacttggcttcatttcgtcatgtaattgtatatttttatttggaggcatattttcttttcttacagtcattgccagacagaggcatacaagtctgtttgctgcatacacatttctggtgagggcgactgggtgggtgaagcaccgtgtcctcgctgaggagagaaagggaggcgtgcctgagagggtagcctgtgcatctggtgagtgtgtcacgagctttgttactgccaaactcactcctttttagaaaaaacaaaaaaaaagggccagaaagtcattccttccatcttccttgcagaaaccacgagaacaaagccagttccctgtcagtgacagggcttcttgtaatttgtggtatgtgccttaaacctgaatgtctgtagccaaaacttgtttccacattaagagtcagccagctctggaatggtctggaaatgtcttcctggtaccaacttgttttcttctgcttgattctgccctgtggctcagaggtctggccttatcagccagtgaaagttcatgtaaccttacgtagagatttgtgtgcaggaaaccctgagcatacactagtttgcagggactcgtaaggacatgggaagggaggttcccgaaatccaggcaggaggcccagacacctgaaaggcaaagggatcttggttggttgcaggtgcagtgaagtccactgaaggtgtggtgcgaagaatgcagtccttcacccaggtcccaggagggaagaagggtgtgtgctaattcctggtgcccctcggcgggggccagagagaaggatggggacaacccagagagtcacaagaccagtgcctcccctcagggtgcctccaggctgaaaggggctcctggctctggtctctggggaccctgtgcccgttggttggtggtgtgagggaagagaatccataagagagtttctgagaattatggtgtcatgtccagaagctagagcttaccttgcatcaggggtctccacccactccttttccaacctcctgcgttgaggtttagaaaagagagaatcgactaggcactatggctcacgcctgtaatccaaggactttgggaagctgaggtgagaggatcacttgagctcaggagttcaagactagcctagccaacagcgagacccctgtctctactaaaaaatttggccaggcgtggtggctcacggctgtaatcccagcactttgggaggtgaggcgggcagatcacctgaggtcaggagttcgagacccagcctggccaacatggtgaaaccccatctctactaaaaatacaaaaattagccaggcatggtggcacattcctgt

SEQ ID NO: 312767 - DNA, 2280 bp, Homo sapiens
cccttgcactgcctctggcacctggggcagccgcgcccgcggagttttccgcccggcgctgacggctgctgcgcccgcggctccccagtgccccgagtgccccgcgggccccgcgagcgggagtgggacccagccctaggcagaacccaggcgccgcgcccgggacgcccgcggagagagccactcccgcccacgtcccatttcgcccctcgcgtccggagtccccgtggccaggtgtgtgtctggggaagagacttacagaagtggagttgctgagtcaaagatctaaccatgagctaccctggctatcccccgcccccaggtggctacccaccagctgcaccaggtggtggtccctggggaggtgctgcctaccctcctccgcccagcatgccccccatcgggctggataacgtggccacctatgcggggcagttcaaccaggactatctctcgggaatggcggccaacatgtctgggacatttggaggagccaacatgcccaacctgtaccctggggcccctggggctggctacccaccagtgccccctggcggctttgggcagcccccctctgcccagcagcctgttcctccctatgggatgtatccacccccaggaggaaacccaccctccaggatgccctcatatccgccatacccaggggcccctgtgccgggccagcccatgccaccccccggacagcagcccccaggggcctaccctgggcagccaccagtgacctaccctggtcagcctccagtgccactccctgggcagcagcagccagtgccgagctacccaggatacccggggtctgggactgtcacccccgctgtgcccccaacccagtttggaagccgaggcaccatcactgatgctcccggctttgaccccctgcgagatgccgaggtcctgcggaaggccatgaaaggcttcgggacggatgagcaggccatcattgactgcctggggagtcgctccaacaagcagcggcagcagatcctactttccttcaagacggcttacggcaaggatttgatcaaagatctgaaatctgaactgtcaggaaactttgagaagacaatcttggctctgatgaagaccccagtcctctttgacatttatgagataaaggaagccatcaagggggttggcactgatgaagcctgcctgattgagatcctcgcttcccgcagcaatgagcacatccgagaattaaacagagcctacaaagcagaattcaaaaagaccctggaagaggccattcgaagcgacacatcagggcacttccagcggctcctcatctctctctctcagggaaaccgtgatgaaagcacaaacgtggacatgtcactcgcccagagagatgcccaggagctgtatgcggccggggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcggtacgggcctgctgcaggccaactgggctcccttttggcatctcagtcacctgtggaacctccctccttggagtggccatatgcttggcctctgtgctgtgtgtgggcatcttgattatggacctcggacttgttcatccccttgcccttaaacagattataaatttctgagggcaggtggatcatgaccttgctgtcgcccccaccttgcatcccccagcagcatcagagaacactcgggacctccccaaccttgaccgtgaccttcagcgttccgatcaccgtgtgattccttgatctgtcagtgagaactcatgtcccaaaggctctgtggagctctgctgtcactccctgacaaagcacttcctgcactcagccttaaatctccctgaaccccagctccattgtctttaagatgagaaaataatcgttccttcctgggaatgttgtgagtattgagtgaggcagtgcaggtcaagtgtctattaaacactagccacagttgtatcgctgtgtggcagagccagtctg

SEQ ID NO: 312768 - DNA, 2808 bp, Homo sapiens
cccttgcactgcctctggcacctggggcagccgcgcccgcggagttttccgcccggcgctgacggctgctgcgcccgcggctccccagtgccccgagtgccccgcgggccccgcgagcgggagtgggacccagccctaggcagaacccaggcgccgcgcccgggacgcccgcggagagagccactcccgcccacgtcccatttcgcccctcgcgtccggagtccccgtggccaggtgtgtgtctggggaagagacttacagaagtggagttgctgagtcaaagatctaaccatgagctaccctggctatcccccgcccccaggtggctacccaccagctgcaccaggtggtggtccctggggaggtgctgcctaccctcctccgcccagcatgccccccatcgggctggataacgtggccacctatgcggggcagttcaaccaggactatctctcgggaatggcggccaacatgtctgggacatttggaggagccaacatgcccaacctgtaccctggggcccctggggctggctacccaccagtgccccctggcggctttgggcagcccccctctgcccagcagcctgttcctccctatgggatgtatccacccccaggaggaaacccaccctccaggatgccctcatatccgccatacccaggggcccctgtgccgggccagcccatgccaccccccggacagcagcccccaggggcctaccctgggcagccaccagtgacctaccctggtcagcctccagtgccactccctgggcagcagcagccagtgccgagctacccaggatacccggggtctgggactgtcacccccgctgtgcccccaacccagtttggaagccgaggcaccatcactgatgctcccggctttgaccccctgcgagatgccgaggtcctgcggaaggccatgaaaggcttcgggacggatgagcaggccatcattgactgcctggggagtcgctccaacaagcagcggcagcagatcctactttccttcaagacggcttacggcaaggatttgatcaaagatctgaaatctgaactgtcaggaaactttgagaagacaatcttggctctgatgaagaccccagtcctctttgacatttatgagataaaggaagccatcaagggggttggcactgatgaagcctgcctgattgagatcctcgcttcccgcagcaatgagcacatccgagaattaaacagagcctacaaagcaggtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctgactcatgcaatcattcccctttgcctgtggctaagacttggcttcatttcgtcatgtaattgtatatttttatttggaggcatattttcttttcttacagtcattgccagacagaggcatacaagtctgtttgctgcatacacatttctggtgagggcgactgggtgggtgaagcaccgtgtcctcgctgaggagagaaagggaggcgtgcctgagagggtagcctgtgcatctggtgagtgtgtcacgagctttgttactgccaaactcactcctttttagaaaaaacaaaaaaaaagggccagaaagtcattccttccatcttccttgcagaaaccacgagaacaaagccagttccctgtcagtgacagggcttcttgtaatttgtggtatgtgccttaaacctgaatgtctgtagccaaaacttgtttccacattaagagtcagccagctctggaatggtctggaaatgtcttcctggtaccaacttgttttcttctgcttgattctgccctgtggctcagaggtctggccttatcagccagtgaaagttcatgtaaccttacgtagagatttgtgtgcaggaaaccctgagcatacactagtttgcagggactcgtaaggacatgggaagggaggttcccgaaatccaggcaggaggcccagacacctgaaaggcaaagggatcttggttggttgcaggtgcagtgaagtccactgaaggtgtggtgcgaagaatgcagtccttcacccaggtcccaggagggaagaagggtgtgtgctaattcctggtgcccctcggcgggggccagagagaaggatggggacaacccagagagtcacaagaccagtgcctcccctcagggtgcctccaggctgaaaggggctcctggctctggtctctggggaccctgtgcccgttggttggtggtgtgagggaagagaatccataagagagtttctgagaattatggtgtcatgtccagaagctagagcttaccttgcatcaggggtctccacccactccttttccaacctcctgcgttgaggtttagaaaagagagaatcgactaggcactatggctcacgcctgtaatccaaggactttgggaagctgaggtgagaggatcacttgagctcaggagttcaagactagcctagccaacagcgagacccctgtctctactaaaaaatttggccaggcgtggtggctcacggctgtaatcccagcactttgggaggtgaggcgggcagatcacctgaggtcaggagttcgagacccagcctggccaacatggtgaaaccccatctctactaaaaatacaaaaattagccaggcatggtggcacattcctgt

SEQ ID NO: 312769 - DNA, 1526 bp, Homo sapiens
cccttgcactgcctctggcacctggggcagccgcgcccgcggagttttccgcccggcgctgacggctgctgcgcccgcggctccccagtgccccgagtgccccgcgggccccgcgagcgggagtgggacccagccctaggcagaacccaggcgccgcgcccgggacgcccgcggagagagccactcccgcccacgtcccatttcgcccctcgcgtccggagtccccgtggccaggtgtgtgtctggggaagagacttacagaagtggagttgctgagtcaaagatctaaccatgagctaccctggctatcccccgcccccaggtggctacccaccagctgcaccaggtggtggtccctggggaggtgctgcctaccctcctccgcccagcatgccccccatcgggctggataacgtggccacctatgcggggcagttcaaccaggactatctctcgggaatggcggccaacatgtctgggacatttggaggagccaacatgcccaacctgtaccctggggcccctggggctggctacccaccagtgccccctggcggctttgggcagcccccctctgcccagcagcctgttcctccctatgggatgtatccacccccaggaggaaacccaccctccaggatgccctcatatccgccatacccaggggcccctgtgccgggccagcccatgccaccccccggacagcagcccccaggggcctaccctgggcagccaccagtgacctaccctggtcagcctccagtgccactccctgggcagcagcagccagtgccgagctacccaggatacccggggtctgggactgtcacccccgctgtgcccccaacccagtttggaagccgaggcaccatcactgatgctcccggctttgaccccctgcgagatgccgaggtcctgcggaaggccatgaaaggcttcgggacggatgagcaggccatcattgactgcctggggagtcgctccaacaagcagcggcagcagatcctactttccttcaagacggcttacggcaaggcgagctgcggggtgggggcgcgggacagtgaggcgtgtcctgggctcagcacagccctgctctcccctgcttttccttgggtgggcccggatctcccggatggacagtaaggagcaggagggcatttccttctgcccatccagctggtggcatcgttgggaggtgaaggatgccaccgggtgctgaggtttgctgagaggctccagacatctatccctgggttctagcccttgctctgccacatctcactgaggttgtggccacatcattttccttcccctgccctcttcatgaccaccctggggggtttagctgatgtaagagctttgcagggaaaggctgtgagtgctgcccaagtacgaggggcgtgtatgagcatattttgaacttctggggttttgaatcttagaaagataaaaattcggtaaatattgattagattcgtgttctagcccagtgcttctcaaacttcattgtgtcaccgatcccc

SEQ ID NO: 312770 - DNA, 1824 bp, Homo sapiens
  misc_feature (19)..(20): n is a, c, g, or t
  misc_feature (22)..(22): n is a, c, g, or t
agttgaatgtaaggatgcnnangatgggagggcgatgaggactaggatgatggcgggcaggatagttcagacggtttctatttcctgagcgattggacatcagatcagagtataagcggatgtacggcaagtcgctgtaccacgacatctcgggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctgactcatgcaatcattcccctttgcctgtggctaagacttggcttcatttcgtcatgtaattgtatatttttatttggaggcatattttcttttcttacagtcattgccagacagaggcatacaagtctgtttgctgcatacacatttctggtgagggcgactgggtgggtgaagcaccgtgtcctcgctgaggagagaaagggaggcgtgcctgagagggtagcctgtgcatctggtgagtgtgtcacgagctttgttactgccaaactcactcctttttagaaaaaacaaaaaaaaagggccagaaagtcattccttccatcttccttgcagaaaccacgagaacaaagccagttccctgtcagtgacagggcttcttgtaatttgtggtatgtgccttaaacctgaatgtctgtagccaaaacttgtttccacattaagagtcagccagctctggaatggtctggaaatgtcttcctggtaccaacttgttttcttctgcttgattctgccctgtggctcagaggtctggccttatcagccagtgaaagttcatgtaaccttacgtagagatttgtgtgcaggaaaccctgagcatacactagtttgcagggactcgtaaggacatgggaagggaggttcccgaaatccaggcaggaggcccagacacctgaaaggcaaagggatcttggttggttgcaggtgcagtgaagtccactgaaggtgtggtgcgaagaatgcagtccttcacccaggtcccaggagggaagaagggtgtgtgctaattcctggtgcccctcggcgggggccagagagaaggatggggacaacccagagagtcacaagaccagtgcctcccctcagggtgcctccaggctgaaaggggctcctggctctggtctctggggaccctgtgcccgttggttggtggtgtgagggaagagaatccataagagagtttctgagaattatggtgtcatgtccagaagctagagcttaccttgcatcaggggtctccacccactccttttccaacctcctgcgttgaggtttagaaaagagagaatcgactaggcactatggctcacgcctgtaatccaaggactttgggaagctgaggtgagaggatcacttgagctcaggagttcaagactagcctagccaacagcgagacccctgtctctactaaaaaatttggccaggcgtggtggctcacggctgtaatcccagcactttgggaggtgaggcgggcagatcacctgaggtcaggagttcgagacccagcctggccaacatggtgaaaccccatctctactaaaaatacaaaaattagccaggcatggtggcacattcctgt

SEQ ID NO: 312771 - DNA, 1995 bp, Homo sapiens
agcataaatgcactgggaaaacagcaatattggttagccctgggaagtggtttttaggatgattataatttttttttgtgggtattcatttgatgtggatagctggggtgagtgctgctttccgtcttctgatgggggcctggagaaggctgaactgcattttttaaggtctgtgacgcctgctgcaggacctgcagtgggggaaaattccccagggtggggctttctccctataagggtgctcagggctgaatatcaggacccagaaggctgaaagtgactgtccctcccttaacggatgtcttccttgtttctgtggccagggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctgactcatgcaatcattcccctttgcctgtggctaagacttggcttcatttcgtcatgtaattgtatatttttatttggaggcatattttcttttcttacagtcattgccagacagaggcatacaagtctgtttgctgcatacacatttctggtgagggcgactgggtgggtgaagcaccgtgtcctcgctgaggagagaaagggaggcgtgcctgagagggtagcctgtgcatctggtgagtgtgtcacgagctttgttactgccaaactcactcctttttagaaaaaacaaaaaaaaagggccagaaagtcattccttccatcttccttgcagaaaccacgagaacaaagccagttccctgtcagtgacagggcttcttgtaatttgtggtatgtgccttaaacctgaatgtctgtagccaaaacttgtttccacattaagagtcagccagctctggaatggtctggaaatgtcttcctggtaccaacttgttttcttctgcttgattctgccctgtggctcagaggtctggccttatcagccagtgaaagttcatgtaaccttacgtagagatttgtgtgcaggaaaccctgagcatacactagtttgcagggactcgtaaggacatgggaagggaggttcccgaaatccaggcaggaggcccagacacctgaaaggcaaagggatcttggttggttgcaggtgcagtgaagtccactgaaggtgtggtgcgaagaatgcagtccttcacccaggtcccaggagggaagaagggtgtgtgctaattcctggtgcccctcggcgggggccagagagaaggatggggacaacccagagagtcacaagaccagtgcctcccctcagggtgcctccaggctgaaaggggctcctggctctggtctctggggaccctgtgcccgttggttggtggtgtgagggaagagaatccataagagagtttctgagaattatggtgtcatgtccagaagctagagcttaccttgcatcaggggtctccacccactccttttccaacctcctgcgttgaggtttagaaaagagagaatcgactaggcactatggctcacgcctgtaatccaaggactttgggaagctgaggtgagaggatcacttgagctcaggagttcaagactagcctagccaacagcgagacccctgtctctactaaaaaatttggccaggcgtggtggctcacggctgtaatcccagcactttgggaggtgaggcgggcagatcacctgaggtcaggagttcgagacccagcctggccaacatggtgaaaccccatctctactaaaaatacaaaaattagccaggcatggtggcacattcctgt

SEQ ID NO: 312772 - DNA, 2294 bp, Homo sapiens
caaaatacattctcagctgtgtggtctaacgctcaaattctgaactcacatgagccttgcaattgcaccatggggaccacgtcctcccaccttagactcagtagcatttgatgatggtgggcatgtcatcacaggaaactcactgtgtttccttggctgtatgaatgaagctgttgttagagaattagtgattctaggctgggcacagtggctcacgcctgtaatcccagcactttgggaggctgaggcaggtggatcatttgaggtcaggagttcgagaccagcctggccaacaaggtaaaaccctgtctctactaaaaatacaaaattagctgggcttgcctgtaatcccagctaattaggtaggctgcggcaggagaattgcttgaacccgggagacagaggttgcagtgagctgggatcacgccattccacttcagtcttggtgacagagtgagacttcgtctcaaaaaaaaaaagagagttaataattcattacagagtatctcctgcatgccagcaagctatggacatctggaagaagccacatgccttgccctcaagttgcttagggtggaaggaaatgattagaaatgagccaagccgagcctgcactcttagaggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctgactcatgcaatcattcccctttgcctgtggctaagacttggcttcatttcgtcatgtaattgtatatttttatttggaggcatattttcttttcttacagtcattgccagacagaggcatacaagtctgtttgctgcatacacatttctggtgagggcgactgggtgggtgaagcaccgtgtcctcgctgaggagagaaagggaggcgtgcctgagagggtagcctgtgcatctggtgagtgtgtcacgagctttgttactgccaaactcactcctttttagaaaaaacaaaaaaaaagggccagaaagtcattccttccatcttccttgcagaaaccacgagaacaaagccagttccctgtcagtgacagggcttcttgtaatttgtggtatgtgccttaaacctgaatgtctgtagccaaaacttgtttccacattaagagtcagccagctctggaatggtctggaaatgtcttcctggtaccaacttgttttcttctgcttgattctgccctgtggctcagaggtctggccttatcagccagtgaaagttcatgtaaccttacgtagagatttgtgtgcaggaaaccctgagcatacactagtttgcagggactcgtaaggacatgggaagggaggttcccgaaatccaggcaggaggcccagacacctgaaaggcaaagggatcttggttggttgcaggtgcagtgaagtccactgaaggtgtggtgcgaagaatgcagtccttcacccaggtcccaggagggaagaagggtgtgtgctaattcctggtgcccctcggcgggggccagagagaaggatggggacaacccagagagtcacaagaccagtgcctcccctcagggtgcctccaggctgaaaggggctcctggctctggtctctggggaccctgtgcccgttggttggtggtgtgagggaagagaatccataagagagtttctgagaattatggtgtcatgtccagaagctagagcttaccttgcatcaggggtctccacccactccttttccaacctcctgcgttgaggtttagaaaagagagaatcgactaggcactatggctcacgcctgtaatccaaggactttgggaagctgaggtgagaggatcacttgagctcaggagttcaagactagcctagccaacagcgagacccctgtctctactaaaaaatttggccaggcgtggtggctcacggctgtaatcccagcactttgggaggtgaggcgggcagatcacctgaggtcaggagttcgagacccagcctggccaacatggtgaaaccccatctctactaaaaatacaaaaattagccaggcatggtggcacattcctgt

SEQ ID NO: 312773 - DNA, 359 bp, Homo sapiens
cagcagatctgtgtccctcctcacaatttaactggcaggggacattgccaagggatccgtgttcagagggacttcgtgagagcaggtgtctcacctggcacctgtccaggctgctcttcctcccttactgacagatctgcaaatcacttacttctcttaatcagcagcctctactgcagaaacagggtgatgctgcctcatttgccctggttcttcaccctgcatcagatgaacctcctgagggccctttttgcttctaggaacgatgattccataccttaccaggtccccttgcctgatgaaccagaggttggagaatgaagagagacaggggcctctgacttcccctgttgctggag

SEQ ID NO: 312774 - DNA, 912 bp, Homo sapiens
aaccccattacggctaggtacgaggctgggtggtggacggctgctgcgcccgcggctccccagtgccccgagtgccccgcgggccccgcgagcgggagtgggacccagccctaggcagaacccaggcgccgcgcccgggacgcccgcggagagagccactcccgcccacgtcccatttcgcccctcgcgtccggagtccccgtggccagatctaaccatgagctaccctggctatcccccgcccccaggtggctacccaccagctgcaccaggtggtggtccctggggaggtgctgcctaccctcctccgcccagcatgccccccatcgggctggataacgtggccacctatgcggggcagttcaaccaggactatctctcgggaatggcggccaacatgtctgggacatttggaggagccaacatgcccaacctgtaccctggggcccctggggctggctacccaccagtgccccctggcggctttgggcagcccccctctgcccagcagcctgttcctccctatgggatgtatccacccccaggaggaaacccaccctccaggatgccctcatatccgccatacccaggggcccctgtgccgggccagcccatgccaccccccggacagcagcccccaggggcctaccctgggcagccaccagtgacctaccctggtcagcctccagtgccactccctgggcagcagcagccagtgccgagctacccaggatacccggggtctgggactgtcacccccgctgtgcccccaacccagagttggaagcgagggcatcacttgttctcccgggtttgaccccttcgaaattccgaggtctcggaagcgctaaggcgtcgacggataagcaggcacacttgaggcggggggcgcccaaggggcggggactactc

SEQ ID NO: 312775 - DNA, 3026 bp, Homo sapiens
cccttgcactgcctctggcacctggggcagccgcgcccgcggagttttccgcccggcgctgacggctgctgcgcccgcggctccccagtgccccgagtgccccgcgggccccgcgagcgggagtgggacccagccctaggcagaacccaggcgccgcgcccgggacgcccgcggagagagccactcccgcccacgtcccatttcgcccctcgcgtccggagtccccgtggccaggtgtgtgtctggggaagagacttacagaagtggagttgctgagtcaaagatctaaccatgagctaccctggctatcccccgcccccaggtggctacccaccagctgcaccaggtggtggtccctggggaggtgctgcctaccctcctccgcccagcatgccccccatcgggctggataacgtggccacctatgcggggcagttcaaccaggactatctctcgggaatggcggccaacatgtctgggacatttggaggagccaacatgcccaacctgtaccctggggcccctggggctggctacccaccagtgccccctggcggctttgggcagcccccctctgcccagcagcctgttcctccctatgggatgtatccacccccaggaggaaacccaccctccaggatgccctcatatccgccatacccaggggcccctgtgccgggccagcccatgccaccccccggacagcagcccccaggggcctaccctgggcagccaccagtgacctaccctggtcagcctccagtgccactccctgggcagcagcagccagtgccgagctacccaggatacccggggtctgggactgtcacccccgctgtgcccccaacccagtttggaagccgaggcaccatcactgatgctcccggctttgaccccctgcgagatgccgaggtcctgcggaaggccatgaaaggcttcgggacggatgagcaggccatcattgactgcctggggagtcgctccaacaagcagcggcagcagatcctactttccttcaagacggcttacggcaaggatttgatcaaagatctgaaatctgaactgtcaggaaactttgagaagacaatcttggctctgatgaagaccccagtcctctttgacatttatgagataaaggaagccatcaagggggttggcactgatgaagcctgcctgattgagatcctcgcttcccgcagcaatgagcacatccgagaattaaacagagcctacaaagcagaattcaaaaagaccctggaagaggccattcgaagcgacacatcagggcacttccagcggctcctcatctctctctctcagggaaaccgtgatgaaagcacaaacgtggacatgtcactcgcccagagagatgcccaggagctgtatgcggccggggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcgggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctgactcatgcaatcattcccctttgcctgtggctaagacttggcttcatttcgtcatgtaattgtatatttttatttggaggcatattttcttttcttacagtcattgccagacagaggcatacaagtctgtttgctgcatacacatttctggtgagggcgactgggtgggtgaagcaccgtgtcctcgctgaggagagaaagggaggcgtgcctgagagggtagcctgtgcatctggtgagtgtgtcacgagctttgttactgccaaactcactcctttttagaaaaaacaaaaaaaaagggccagaaagtcattccttccatcttccttgcagaaaccacgagaacaaagccagttccctgtcagtgacagggcttcttgtaatttgtggtatgtgccttaaacctgaatgtctgtagccaaaacttgtttccacattaagagtcagccagctctggaatggtctggaaatgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaacaaaacaccacacaaaaaaagaaggagggggggacgggcagctcacaactcaccagccgagagggggacacacgcagcagacgcacaccgacttgtagacaaagggcgacgcacacaaggggggtgatgacagatcaacacaggaggcacgggccgaaaaataacacagcacaggagaggaaaaaaaccgccagaccggggagagagagactagacaacagaaacatcctctcgcgcgacggaagacgcaaagacaacacaacgcacacgagaaagcccgcccagaacacaacagccagaagggtggtgcaacacaacagtcacccgggaaaagcgacgggcgggcaagaaaaatcacggg

SEQ ID NO: 312776 - DNA, 3521 bp, Homo sapiens
ctcattatgttgcccaggctggtgtcaaacttctgagctcaaatgatctgcctgcgtcagcctcccaaagtgctgggattataggcatgggccactgtgcctggcctcatcttgtcattttaaagaatatatcagcagggattattggacctgcctggtttaaactattgtcttagttaattttgtgctgctctaacaaaatatcacagactgagtaatttataagcaatagtagcttatttggctcacagttctggaggctgagaagatcgtgaggctgcatctggcaagggccttcttgctgcttcataacatggcagaagacatcatgcgggtgtgtgtctggggaagagacttacagaagtggagttgctgagtcaaagatctaaccatgagctaccctggctatcccccgcccccaggtggctacccaccagctgcaccaggtggtggtccctggggaggtgctgcctaccctcctccgcccagcatgccccccatcgggctggataacgtggccacctatgcggggcagttcaaccaggactatctctcgggaatggcggccaacatgtctgggacatttggaggagccaacatgcccaacctgtaccctggggcccctggggctggctacccaccagtgccccctggcggctttgggcagcccccctctgcccagcagcctgttcctccctatgggatgtatccacccccaggaggaaacccaccctccaggatgccctcatatccgccatacccaggggcccctgtgccgggccagcccatgccaccccccggacagcagcccccaggggcctaccctgggcagccaccagtgacctaccctggtcagcctccagtgccactccctgggcagcagcagccagtgccgagctacccaggatacccggggtctgggactgtcacccccgctgtgcccccaacccagtttggaagccgaggcaccatcactgatgctcccggctttgaccccctgcgagatgccgaggtcctgcggaaggccatgaaaggcttcgggacggatgagcaggccatcattgactgcctggggagtcgctccaacaagcagcggcagcagatcctactttccttcaagacggcttacggcaaggatttgatcaaagatctgaaatctgaactgtcaggaaactttgagaagacaatcttggctctgatgaagaccccagtcctctttgacatttatgagataaaggaagccatcaagggggttggcactgatgaagcctgcctgattgagatcctcgcttcccgcagcaatgagcacatccgagaattaaacagagcctacaaagcagaattcaaaaagaccctggaagaggccattcgaagcgacacatcagggcacttccagcggctcctcatctctctctctcagggaaaccgtgatgaaagcacaaacgtggacatgtcactcgcccagagagatgcccaggagctgtatgcggccggggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcgggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctgactcatgcaatcattcccctttgcctgtggctaagacttggcttcatttcgtcatgtaattgtatatttttatttggaggcatattttcttttcttacagtcattgccagacagaggcatacaagtctgtttgctgcatacacatttctggtgagggcgactgggtgggtgaagcaccgtgtcctcgctgaggagagaaagggaggcgtgcctgagagggtagcctgtgcatctggtgagtgtgtcacgagctttgttactgccaaactcactcctttttagaaaaaacaaaaaaaaagggccagaaagtcattccttccatcttccttgcagaaaccacgagaacaaagccagttccctgtcagtgacagggcttcttgtaatttgtggtatgtgccttaaacctgaatgtctgtagccaaaacttgtttccacattaagagtcagccagctctggaatggtctggaaatgtcttcctggtaccaacttgttttcttctgcttgattctgccctgtggctcagaggtctggccttatcagccagtgaaagttcatgtaaccttacgtagagatttgtgtgcaggaaaccctgagcatacactagtttgcagggactcgtaaggacatgggaagggaggttcccgaaatccaggcaggaggcccagacacctgaaaggcaaagggatcttggttggttgcaggtgcagtgaagtccactgaaggtgtggtgcgaagaatgcagtccttcacccaggtcccaggagggaagaagggtgtgtgctaattcctggtgcccctcggcgggggccagagagaaggatggggacaacccagagagtcacaagaccagtgcctcccctcagggtgcctccaggctgaaaggggctcctggctctggtctctggggaccctgtgcccgttggttggtggtgtgagggaagagaatccataagagagtttctgagaattatggtgtcatgtccagaagctagagcttaccttgcatcaggggtctccacccactccttttccaacctcctgcgttgaggtttagaaaagagagaatcgactaggcactatggctcacgcctgtaatccaaggactttgggaagctgaggtgagaggatcacttgagctcaggagttcaagactagcctagccaacagcgagacccctgtctctactaaaaaatttggccaggcgtggtggctcacggctgtaatcccagcactttgggaggtgaggcgggcagatcacctgaggtcaggagttcgagacccagcctggccaacatggtgaaaccccatctctactaaaaatacaaaaattagccaggcatggtggcacattcctgt

SEQ ID NO: 312777 - DNA, 3141 bp, Homo sapiens
aagcaggctgtaccggtcggaaggtctatgatccgcccccaggtggctacccaccagctgcaccaggtggtggtccctggggaggtgctgcctaccctcctccgcccagcatgccccccatcgggctggataacgtggccacctatgcggggcagttcaaccaggactatctctcgggaatggcggccaacatgtctgggacatttggaggagccaacatgcccaacctgtaccctggggcccctggggctggctacccaccagtgccccctggcggctttgggcagcccccctctgcccagcagcctgttcctccctatgggatgtatccacccccaggaggaaacccaccctccaggatgccctcatatccgccatacccaggggcccctgtgccgggccagcccatgccaccccccggacagcagcccccaggggcctaccctgggcagccaccagtgacctaccctggtcagcctccagtgccactccctgggcagcagcagccagtgccgagctacccaggatacccggggtctgggactgtcacccccgctgtgcccccaacccagtttggaagccgaggcaccatcactgatgctcccggctttgaccccctgcgagatgccgaggtcctgcggaaggccatgaaaggcttcgggacggatgagcaggccatcattgactgcctggggagtcgctccaacaagcagcggcagcagatcctactttccttcaagacggcttacggcaaggatttgatcaaagatctgaaatctgaactgtcaggaaactttgagaagacaatcttggctctgatgaagaccccagtcctctttgacatttatgagataaaggaagccatcaagggggttggcactgatgaagcctgcctgattgagatcctcgcttcccgcagcaatgagcacatccgagaattaaacagagcctacaaagcagaattcaaaaagaccctggaagaggccattcgaagcgacacatcagggcacttccagcggctcctcatctctctctctcagggaaaccgtgatgaaagcacaaacgtggacatgtcactcgcccagagagatgcccaggagctgtatgcggccggggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcgggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctgactcatgcaatcattcccctttgcctgtggctaagacttggcttcatttcgtcatgtaattgtatatttttatttggaggcatattttcttttcttacagtcattgccagacagaggcatacaagtctgtttgctgcatacacatttctggtgagggcgactgggtgggtgaagcaccgtgtcctcgctgaggagagaaagggaggcgtgcctgagagggtagcctgtgcatctggtgagtgtgtcacgagctttgttactgccaaactcactcctttttagaaaaaacaaaaaaaaagggccagaaagtcattccttccatcttccttgcagaaaccacgagaacaaagccagttccctgtcagtgacagggcttcttgtaatttgtggtatgtgccttaaacctgaatgtctgtagccaaaacttgtttccacattaagagtcagccagctctggaatggtctggaaatgtcttcctggtaccaacttgttttcttctgcttgattctgccctgtggctcagaggtctggccttatcagccagtgaaagttcatgtaaccttacgtagagatttgtgtgcaggaaaccctgagcatacactagtttgcagggactcgtaaggacatgggaagggaggttcccgaaatccaggcaggaggcccagacacctgaaaggcaaagggatcttggttggttgcaggtgcagtgaagtccactgaaggtgtggtgcgaagaatgcagtccttcacccaggtcccaggagggaagaagggtgtgtgctaattcctggtgcccctcggcgggggccagagagaaggatggggacaacccagagagtcacaagaccagtgcctcccctcagggtgcctccaggctgaaaggggctcctggctctggtctctggggaccctgtgcccgttggttggtggtgtgagggaagagaatccataagagagtttctgagaattatggtgtcatgtccagaagctagagcttaccttgcatcaggggtctccacccactccttttccaacctcctgcgttgaggtttagaaaagagagaatcgactaggcactatggctcacgcctgtaatccaaggactttgggaagctgaggtgagaggatcacttgagctcaggagttcaagactagcctagccaacagcgagacccctgtctctactaaaaaatttggccaggcgtggtggctcacggctgtaatcccagcactttgggaggtgaggcgggcagatcacctgaggtcaggagttcgagacccagcctggccaacatggtgaaaccccatctctactaaaaatacaaaaattagccaggcatggtggcacattcctgt

SEQ ID NO: 312778 - DNA, 2829 bp, Homo sapiens
aaccccattacggctaggtacgaggctgggtggtggacccctccaggatgccctcatatccgccatacccaggggcccctgtgccgggccagcccatgccaccccccggacagcagcccccaggggcctaccctgggcagccaccagtgacctaccctggtcagcctccagtgccactccctgggcagcagcagccagtgccgagctacccaggatacccggggtctgggactgtcacccccgctgtgcccccaacccagtttggaagccgaggcaccatcactgatgctcccggctttgaccccctgcgagatgccgaggtcctgcggaaggccatgaaaggcttcgggacggatgagcaggccatcattgactgcctggggagtcgctccaacaagcagcggcagcagatcctactttccttcaagacggcttacggcaaggatttgatcaaagatctgaaatctgaactgtcaggaaactttgagaagacaatcttggctctgatgaagaccccagtcctctttgacatttatgagataaaggaagccatcaagggggttggcactgatgaagcctgcctgattgagatcctcgcttcccgcagcaatgagcacatccgagaattaaacagagcctacaaagcagaattcaaaaagaccctggaagaggccattcgaagcgacacatcagggcacttccagcggctcctcatctctctctctcagggaaaccgtgatgaaagcacaaacgtggacatgtcactcgcccagagagatgcccaggagctgtatgcggccggggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcgggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctgactcatgcaatcattcccctttgcctgtggctaagacttggcttcatttcgtcatgtaattgtatatttttatttggaggcatattttcttttcttacagtcattgccagacagaggcatacaagtctgtttgctgcatacacatttctggtgagggcgactgggtgggtgaagcaccgtgtcctcgctgaggagagaaagggaggcgtgcctgagagggtagcctgtgcatctggtgagtgtgtcacgagctttgttactgccaaactcactcctttttagaaaaaacaaaaaaaaagggccagaaagtcattccttccatcttccttgcagaaaccacgagaacaaagccagttccctgtcagtgacagggcttcttgtaatttgtggtatgtgccttaaacctgaatgtctgtagccaaaacttgtttccacattaagagtcagccagctctggaatggtctggaaatgtcttcctggtaccaacttgttttcttctgcttgattctgccctgtggctcagaggtctggccttatcagccagtgaaagttcatgtaaccttacgtagagatttgtgtgcaggaaaccctgagcatacactagtttgcagggactcgtaaggacatgggaagggaggttcccgaaatccaggcaggaggcccagacacctgaaaggcaaagggatcttggttggttgcaggtgcagtgaagtccactgaaggtgtggtgcgaagaatgcagtccttcacccaggtcccaggagggaagaagggtgtgtgctaattcctggtgcccctcggcgggggccagagagaaggatggggacaacccagagagtcacaagaccagtgcctcccctcagggtgcctccaggctgaaaggggctcctggctctggtctctggggaccctgtgcccgttggttggtggtgtgagggaagagaatccataagagagtttctgagaattatggtgtcatgtccagaagctagagcttaccttgcatcaggggtctccacccactccttttccaacctcctgcgttgaggtttagaaaagagagaatcgactaggcactatggctcacgcctgtaatccaaggactttgggaagctgaggtgagaggatcacttgagctcaggagttcaagactagcctagccaacagcgagacccctgtctctactaaaaaatttggccaggcgtggtggctcacggctgtaatcccagcactttgggaggtgaggcgggcagatcacctgaggtcaggagttcgagacccagcctggccaacatggtgaaaccccatctctactaaaaatacaaaaattagccaggcatggtggcacattcctgt

SEQ ID NO: 312779 - DNA, 3271 bp, Homo sapiens
cccttgcactgcctctggcacctggggcagccgcgcccgcggagttttccgcccggcgctgacggctgctgcgcccgcggctccccagtgccccgagtgccccgcgggccccgcgagcgggagtgggacccagccctaggcagaacccaggcgccgcgcccgggacgcccgcggagagagccactcccgcccacgtcccatttcgcccctcgcgtccggagtccccgtggccaggtgtgtgtctggggaagagacttacagaagtggagttgctgagtcaaagatctaaccatgagctaccctggctatcccccgcccccaggtggctacccaccagctgcaccaggtggtggtccctggggaggtgctgcctaccctcctccgcccagcatgccccccatcgggctggataacgtggccacctatgcggggcagttcaaccaggactatctctcgggaatggcggccaacatgtctgggacatttggaggagccaacatgcccaacctgtaccctgcccctgtgccgggccagcccatgccaccccccggacagcagcccccaggggcctaccctgggcagccaccagtgacctaccctggtcagcctccagtgccactccctgggcagcagcagccagtgccgagctacccaggatacccggggtctgggactgtcacccccgctgtgcccccaacccagtttggaagccgaggcaccatcactgatgctcccggctttgaccccctgcgagatgccgaggtcctgcggaaggccatgaaaggcttcgggacggatgagcaggccatcattgactgcctggggagtcgctccaacaagcagcggcagcagatcctactttccttcaagacggcttacggcaaggatttgatcaaagatctgaaatctgaactgtcaggaaactttgagaagacaatcttggctctgatgaagaccccagtcctctttgacatttatgagataaaggaagccatcaagggggttggcactgatgaagcctgcctgattgagatcctcgcttcccgcagcaatgagcacatccgagaattaaacagagcctacaaagcagaattcaaaaagaccctggaagaggccattcgaagcgacacatcagggcacttccagcggctcctcatctctctctctcagggaaaccgtgatgaaagcacaaacgtggacatgtcactcgcccagagagatgcccaggagctgtatgcggccggggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcgggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctgactcatgcaatcattcccctttgcctgtggctaagacttggcttcatttcgtcatgtaattgtatatttttatttggaggcatattttcttttcttacagtcattgccagacagaggcatacaagtctgtttgctgcatacacatttctggtgagggcgactgggtgggtgaagcaccgtgtcctcgctgaggagagaaagggaggcgtgcctgagagggtagcctgtgcatctggtgagtgtgtcacgagctttgttactgccaaactcactcctttttagaaaaaacaaaaaaaaagggccagaaagtcattccttccatcttccttgcagaaaccacgagaacaaagccagttccctgtcagtgacagggcttcttgtaatttgtggtatgtgccttaaacctgaatgtctgtagccaaaacttgtttccacattaagagtcagccagctctggaatggtctggaaatgtcttcctggtaccaacttgttttcttctgcttgattctgccctgtggctcagaggtctggccttatcagccagtgaaagttcatgtaaccttacgtagagatttgtgtgcaggaaaccctgagcatacactagtttgcagggactcgtaaggacatgggaagggaggttcccgaaatccaggcaggaggcccagacacctgaaaggcaaagggatcttggttggttgcaggtgcagtgaagtccactgaaggtgtggtgcgaagaatgcagtccttcacccaggtcccaggagggaagaagggtgtgtgctaattcctggtgcccctcggcgggggccagagagaaggatggggacaacccagagagtcacaagaccagtgcctcccctcagggtgcctccaggctgaaaggggctcctggctctggtctctggggaccctgtgcccgttggttggtggtgtgagggaagagaatccataagagagtttctgagaattatggtgtcatgtccagaagctagagcttaccttgcatcaggggtctccacccactccttttccaacctcctgcgttgaggtttagaaaagagagaatcgactaggcactatggctcacgcctgtaatccaaggactttgggaagctgaggtgagaggatcacttgagctcaggagttcaagactagcctagccaacagcgagacccctgtctctactaaaaaatttggccaggcgtggtggctcacggctgtaatcccagcactttgggaggtgaggcgggcagatcacctgaggtcaggagttcgagacccagcctggccaacatggtgaaaccccatctctactaaaaatacaaaaattagccaggcatggtggcacattcctgt

SEQ ID NO: 312780 - DNA, 2625 bp, Homo sapiens
ggcagcgcgccacgcgggacaagtgcacacaccccaaaaacaggtggttgaggacgtttggaagccgaggcaccatcactgatgctcccggctttgaccccctgcgagatgccgaggtcctgcggaaggccatgaaaggcttcgggacggatgagcaggccatcattgactgcctggggagtcgctccaacaagcagcggcagcagatcctactttccttcaagacggcttacggcaaggatttgatcaaagatctgaaatctgaactgtcaggaaactttgagaagacaatcttggctctgatgaagaccccagtcctctttgacatttatgagataaaggaagccatcaagggggttggcactgatgaagcctgcctgattgagatcctcgcttcccgcagcaatgagcacatccgagaattaaacagagcctacaaagcagaattcaaaaagaccctggaagaggccattcgaagcgacacatcagggcacttccagcggctcctcatctctctctctcagggaaaccgtgatgaaagcacaaacgtggacatgtcactcgcccagagagatgcccaggagctgtatgcggccggggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcgggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctgactcatgcaatcattcccctttgcctgtggctaagacttggcttcatttcgtcatgtaattgtatatttttatttggaggcatattttcttttcttacagtcattgccagacagaggcatacaagtctgtttgctgcatacacatttctggtgagggcgactgggtgggtgaagcaccgtgtcctcgctgaggagagaaagggaggcgtgcctgagagggtagcctgtgcatctggtgagtgtgtcacgagctttgttactgccaaactcactcctttttagaaaaaacaaaaaaaaagggccagaaagtcattccttccatcttccttgcagaaaccacgagaacaaagccagttccctgtcagtgacagggcttcttgtaatttgtggtatgtgccttaaacctgaatgtctgtagccaaaacttgtttccacattaagagtcagccagctctggaatggtctggaaatgtcttcctggtaccaacttgttttcttctgcttgattctgccctgtggctcagaggtctggccttatcagccagtgaaagttcatgtaaccttacgtagagatttgtgtgcaggaaaccctgagcatacactagtttgcagggactcgtaaggacatgggaagggaggttcccgaaatccaggcaggaggcccagacacctgaaaggcaaagggatcttggttggttgcaggtgcagtgaagtccactgaaggtgtggtgcgaagaatgcagtccttcacccaggtcccaggagggaagaagggtgtgtgctaattcctggtgcccctcggcgggggccagagagaaggatggggacaacccagagagtcacaagaccagtgcctcccctcagggtgcctccaggctgaaaggggctcctggctctggtctctggggaccctgtgcccgttggttggtggtgtgagggaagagaatccataagagagtttctgagaattatggtgtcatgtccagaagctagagcttaccttgcatcaggggtctccacccactccttttccaacctcctgcgttgaggtttagaaaagagagaatcgactaggcactatggctcacgcctgtaatccaaggactttgggaagctgaggtgagaggatcacttgagctcaggagttcaagactagcctagccaacagcgagacccctgtctctactaaaaaatttggccaggcgtggtggctcacggctgtaatcccagcactttgggaggtgaggcgggcagatcacctgaggtcaggagttcgagacccagcctggccaacatggtgaaaccccatctctactaaaaatacaaaaattagccaggcatggtggcacattcctgt

SEQ ID NO: 312781 - DNA, 2542 bp, Homo sapiens
acgatacagagaagattaggatggcccctgcgcaaggatgacacgcaaattcgtgaagcgttccatattttttggctcttattagtcacttcctgtggattttttaaatagacttgtttttttttttgttggttgtttgtttgaatatccaatcaggatttgatcaaagatctgaaatctgaactgtcaggaaactttgagaagacaatcttggctctgatgaagaccccagtcctctttgacatttatgagataaaggaagccatcaagggggttggcactgatgaagcctgcctgattgagatcctcgcttcccgcagcaatgagcacatccgagaattaaacagagcctacaaagcagaattcaaaaagaccctggaagaggccattcgaagcgacacatcagggcacttccagcggctcctcatctctctctctcagggaaaccgtgatgaaagcacaaacgtggacatgtcactcgcccagagagatgcccaggagctgtatgcggccggggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcgggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctgactcatgcaatcattcccctttgcctgtggctaagacttggcttcatttcgtcatgtaattgtatatttttatttggaggcatattttcttttcttacagtcattgccagacagaggcatacaagtctgtttgctgcatacacatttctggtgagggcgactgggtgggtgaagcaccgtgtcctcgctgaggagagaaagggaggcgtgcctgagagggtagcctgtgcatctggtgagtgtgtcacgagctttgttactgccaaactcactcctttttagaaaaaacaaaaaaaaagggccagaaagtcattccttccatcttccttgcagaaaccacgagaacaaagccagttccctgtcagtgacagggcttcttgtaatttgtggtatgtgccttaaacctgaatgtctgtagccaaaacttgtttccacattaagagtcagccagctctggaatggtctggaaatgtcttcctggtaccaacttgttttcttctgcttgattctgccctgtggctcagaggtctggccttatcagccagtgaaagttcatgtaaccttacgtagagatttgtgtgcaggaaaccctgagcatacactagtttgcagggactcgtaaggacatgggaagggaggttcccgaaatccaggcaggaggcccagacacctgaaaggcaaagggatcttggttggttgcaggtgcagtgaagtccactgaaggtgtggtgcgaagaatgcagtccttcacccaggtcccaggagggaagaagggtgtgtgctaattcctggtgcccctcggcgggggccagagagaaggatggggacaacccagagagtcacaagaccagtgcctcccctcagggtgcctccaggctgaaaggggctcctggctctggtctctggggaccctgtgcccgttggttggtggtgtgagggaagagaatccataagagagtttctgagaattatggtgtcatgtccagaagctagagcttaccttgcatcaggggtctccacccactccttttccaacctcctgcgttgaggtttagaaaagagagaatcgactaggcactatggctcacgcctgtaatccaaggactttgggaagctgaggtgagaggatcacttgagctcaggagttcaagactagcctagccaacagcgagacccctgtctctactaaaaaatttggccaggcgtggtggctcacggctgtaatcccagcactttgggaggtgaggcgggcagatcacctgaggtcaggagttcgagacccagcctggccaacatggtgaaaccccatctctactaaaaatacaaaaattagccaggcatggtggcacattcctgt

SEQ ID NO: 312782 - DNA, 2186 bp, Homo sapiens
cccttgcactgcctctggcacctggggcagccgcgcccgcggagttttccgcccggcgctgacggctgctgcgcccgcggctccccagtgccccgagtgccccgcgggccccgcgagcgggagtgggacccagccctaggcagaacccaggcgccgcgcccgggacgcccgcggagagagccactcccgcccacgtcccatttcgcccctcgcgtccggagtccccgtggccaggtgtgtgtctggggaagagacttacagaagtggagttgctgagtcaaagatctaaccatgagctaccctggctatcccccgcccccaggtggctacccaccagctgcaccaggtggtggtccctggggaggtgctgcctaccctcctccgcccagcatgccccccatcgggctggataacgtggccacctatgcggggcagttcaaccaggactatctctcgggaatggcggccaacatgtctgggacatttggaggagccaacatgcccaacctgtaccctggggcccctggggctggctacccaccagtgccccctggcggctttgggcagcccccctctgcccagcagcctgttcctccctatgggatgtatccacccccaggaggaaacccaccctccaggatgccctcatatccgccatacccaggggcccctgtgccgggccagcccatgccaccccccggacagcagcccccaggggcctaccctgggcagccaccagtgacctaccctggtcagcctccagtgccactccctgggcagcagcagccagtgccgagctacccaggatacccggggtctgggactgtcacccccgctgtgcccccaacccagtttggaagccgaggcaccatcactgatgctcccggctttgaccccctgcgagatgccgaggtcctgcggaaggccatgaaaggcttcgggacggatgagcaggccatcattgactgcctggggagtcgctccaacaagcagcggcagcagatcctactttccttcaagacggcttacggcaaggatttgatcaaagatctgaaatctgaactgtcaggaaactttgagaagacaatcttggctctgatgaagaccccagtcctctttgacatttatgagataaaggaagccatcaagggggttggcactgatgaagcctgcctgattgagatcctcgcttcccgcagcaatgagcacatccgagaattaaacagagcctacaaagcagaattcaaaaagaccctggaagaggccattcgaagcgacacatcagggcacttccagcggctcctcatctctctctctcagggaaaccgtgatgaaagcacaaacgtggacatgtcactcgcccagagagatgcccaggagctgtatgcggccggggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcgggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctaaaaaaaaaaaagggggggggccaaagattcttgggggcccaggttggcgtcccggttttgtcaagggcctcaagggacgcttaaagagggggggggtaaacgggtggaaagggccgggcttg

SEQ ID NO: 312783 - DNA, 2283 bp, Homo sapiens
aaaaagaccctggaagaggccattcgaattctgctttgtaggctctgtttaattctcggatgtgctcattgctgcgggaattaaacagagcctacaaagcagaattcaaaaagaccctggaagaggccattcgaagcgacacatcagggcacttccagcggctcctcatctctctctctcagggaaaccgtgatgaaagcacaaacgtggacatgtcactcgcccagagagatgcccaggagctgtatgcggccggggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcgggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctgactcatgcaatcattcccctttgcctgtggctaagacttggcttcatttcgtcatgtaattgtatatttttatttggaggcatattttcttttcttacagtcattgccagacagaggcatacaagtctgtttgctgcatacacatttctggtgagggcgactgggtgggtgaagcaccgtgtcctcgctgaggagagaaagggaggcgtgcctgagagggtagcctgtgcatctggtgagtgtgtcacgagctttgttactgccaaactcactcctttttagaaaaaacaaaaaaaaagggccagaaagtcattccttccatcttccttgcagaaaccacgagaacaaagccagttccctgtcagtgacagggcttcttgtaatttgtggtatgtgccttaaacctgaatgtctgtagccaaaacttgtttccacattaagagtcagccagctctggaatggtctggaaatgtcttcctggtaccaacttgttttcttctgcttgattctgccctgtggctcagaggtctggccttatcagccagtgaaagttcatgtaaccttacgtagagatttgtgtgcaggaaaccctgagcatacactagtttgcagggactcgtaaggacatgggaagggaggttcccgaaatccaggcaggaggcccagacacctgaaaggcaaagggatcttggttggttgcaggtgcagtgaagtccactgaaggtgtggtgcgaagaatgcagtccttcacccaggtcccaggagggaagaagggtgtgtgctaattcctggtgcccctcggcgggggccagagagaaggatggggacaacccagagagtcacaagaccagtgcctcccctcagggtgcctccaggctgaaaggggctcctggctctggtctctggggaccctgtgcccgttggttggtggtgtgagggaagagaatccataagagagtttctgagaattatggtgtcatgtccagaagctagagcttaccttgcatcaggggtctccacccactccttttccaacctcctgcgttgaggtttagaaaagagagaatcgactaggcactatggctcacgcctgtaatccaaggactttgggaagctgaggtgagaggatcacttgagctcaggagttcaagactagcctagccaacagcgagacccctgtctctactaaaaaatttggccaggcgtggtggctcacggctgtaatcccagcactttgggaggtgaggcgggcagatcacctgaggtcaggagttcgagacccagcctggccaacatggtgaaaccccatctctactaaaaatacaaaaattagccaggcatggtggcacattcctgt

SEQ ID NO: 312784 - DNA, 3542 bp, Homo sapiens
cccttgcactgcctctggcacctggggcagccgcgcccgcggagttttccgcccggcgctgacggctgctgcgcccgcggctccccagtgccccgagtgccccgcgggccccgcgagcgggagtgggacccagccctaggcagaacccaggcgccgcgcccgggacgcccgcggagagagccactcccgcccacgtcccatttcgcccctcgcgtccggagtccccgtggccaggtgtgtgtctggggaagagacttacagaagtggagttgctgagtcaaagatctaaccatgagctaccctggctatcccccgcccccaggtggctacccaccagctgcaccaggtggtggtccctggggaggtgctgcctaccctcctccgcccagcatgccccccatcgggctggataacgtggccacctatgcggggcagttcaaccaggactatctctcgggaatggcggccaacatgtctgggacatttggaggagccaacatgcccaacctgtaccctggggcccctggggctggctacccaccagtgccccctggcggctttgggcagcccccctctgcccagcagcctgttcctccctatgggatgtatccacccccaggaggaaacccaccctccaggatgccctcatatccgccatacccaggggcccctgtgccgggccagcccatgccaccccccggacagcagcccccaggggcctaccctgggcagccaccagtgacctaccctggtcagcctccagtgccactccctgggcagcagcagccagtgccgagctacccaggatacccggggtctgggactgtcacccccgctgtgcccccaacccagtttggaagccgaggcaccatcactgatgctcccggctttgaccccctgcgagatgccgaggtcctgcggaaggccatgaaaggcttcgggacggatgagcaggccatcattgactgcctggggagtcgctccaacaagcagcggcagcagatcctactttccttcaagacggcttacggcaaggatttgatcaaagatctgaaatctgaactgtcaggaaactttgagaagacaatcttggctctgatgaagaccccagtcctctttgacatttatgagataaaggaagccatcaagggggttggcactgatgaagcctgcctgattgagatcctcgcttcccgcagcaatgagcacatccgagaattaaacagagcctacaaagcagaattcaaaaagaccctggaagaggccattcgaagcgacacatcagggcacttccagcggctcctcatctctctctctcagggaaaccgtgatgaaagcacaaacgtggacatgtcactcgcccagagagatgcccaggagctgtatgcggccggggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcgagtatctcctgcatgccagcaagctatggacatctggaagaagccacatgccttgccctcaagttgcttagggtggaaggaaatgattagaaatgagccaagccgagcctgcactcttagaggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctgactcatgcaatcattcccctttgcctgtggctaagacttggcttcatttcgtcatgtaattgtatatttttatttggaggcatattttcttttcttacagtcattgccagacagaggcatacaagtctgtttgctgcatacacatttctggtgagggcgactgggtgggtgaagcaccgtgtcctcgctgaggagagaaagggaggcgtgcctgagagggtagcctgtgcatctggtgagtgtgtcacgagctttgttactgccaaactcactcctttttagaaaaaacaaaaaaaaagggccagaaagtcattccttccatcttccttgcagaaaccacgagaacaaagccagttccctgtcagtgacagggcttcttgtaatttgtggtatgtgccttaaacctgaatgtctgtagccaaaacttgtttccacattaagagtcagccagctctggaatggtctggaaatgtcttcctggtaccaacttgttttcttctgcttgattctgccctgtggctcagaggtctggccttatcagccagtgaaagttcatgtaaccttacgtagagatttgtgtgcaggaaaccctgagcatacactagtttgcagggactcgtaaggacatgggaagggaggttcccgaaatccaggcaggaggcccagacacctgaaaggcaaagggatcttggttggttgcaggtgcagtgaagtccactgaaggtgtggtgcgaagaatgcagtccttcacccaggtcccaggagggaagaagggtgtgtgctaattcctggtgcccctcggcgggggccagagagaaggatggggacaacccagagagtcacaagaccagtgcctcccctcagggtgcctccaggctgaaaggggctcctggctctggtctctggggaccctgtgcccgttggttggtggtgtgagggaagagaatccataagagagtttctgagaattatggtgtcatgtccagaagctagagcttaccttgcatcaggggtctccacccactccttttccaacctcctgcgttgaggtttagaaaagagagaatcgactaggcactatggctcacgcctgtaatccaaggactttgggaagctgaggtgagaggatcacttgagctcaggagttcaagactagcctagccaacagcgagacccctgtctctactaaaaaatttggccaggcgtggtggctcacggctgtaatcccagcactttgggaggtgaggcgggcagatcacctgaggtcaggagttcgagacccagcctggccaacatggtgaaaccccatctctactaaaaatacaaaaattagccaggcatggtggcacattcctgt

SEQ ID NO: 312785 - DNA, 2002 bp, Homo sapiens
cacgaggtgttttttctaaaaaggagtgagtttggcagtaacaaagctcgtgacacactcaccagatgcacaggctaccctctcaggcacgcctccctttctctcctcagcgaggacacggtgcttcacccacccagtcgccctcacctgaaatgtctcaagaataccccagccttctttgcggagaggctcaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcgggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctgactcatgcaatcattcccctttgcctgtggctaagacttggcttcatttcgtcatgtaattgtatatttttatttggaggcatattttcttttcttacagtcattgccagacagaggcatacaagtctgtttgctgcatacacatttctggtgagggcgactgggtgggtgaagcaccgtgtcctcgctgaggagagaaagggaggcgtgcctgagagggtagcctgtgcatctggtgagtgtgtcacgagctttgttactgccaaactcactcctttttagaaaaaacaaaaaaaaagggccagaaagtcattccttccatcttccttgcagaaaccacgagaacaaagccagttccctgtcagtgacagggcttcttgtaatttgtggtatgtgccttaaacctgaatgtctgtagccaaaacttgtttccacattaagagtcagccagctctggaatggtctggaaatgtcttcctggtaccaacttgttttcttctgcttgattctgccctgtggctcagaggtctggccttatcagccagtgaaagttcatgtaaccttacgtagagatttgtgtgcaggaaaccctgagcatacactagtttgcagggactcgtaaggacatgggaagggaggttcccgaaatccaggcaggaggcccagacacctgaaaggcaaagggatcttggttggttgcaggtgcagtgaagtccactgaaggtgtggtgcgaagaatgcagtccttcacccaggtcccaggagggaagaagggtgtgtgctaattcctggtgcccctcggcgggggccagagagaaggatggggacaacccagagagtcacaagaccagtgcctcccctcagggtgcctccaggctgaaaggggctcctggctctggtctctggggaccctgtgcccgttggttggtggtgtgagggaagagaatccataagagagtttctgagaattatggtgtcatgtccagaagctagagcttaccttgcatcaggggtctccacccactccttttccaacctcctgcgttgaggtttagaaaagagagaatcgactaggcactatggctcacgcctgtaatccaaggactttgggaagctgaggtgagaggatcacttgagctcaggagttcaagactagcctagccaacagcgagacccctgtctctactaaaaaatttggccaggcgtggtggctcacggctgtaatcccagcactttgggaggtgaggcgggcagatcacctgaggtcaggagttcgagacccagcctggccaacatggtgaaaccccatctctactaaaaatacaaaaattagccaggcatggtggcacattcctgt

SEQ ID NO: 312786 - DNA, 2389 bp, Homo sapiens
cccttgcactgcctctggcacctggggcagccgcgcccgcggagttttccgcccggcgctgacggctgctgcgcccgcggctccccagtgccccgagtgccccgcgggccccgcgagcgggagtgggacccagccctaggcagaacccaggcgccgcgcccgggacgcccgcggagagagccactcccgcccacgtcccatttcgcccctcgcgtccggagtccccgtggccaggtgtgtgtctggggaagagacttacagaagtggagttgctgagtcaaagatctaaccatgagctaccctggctatcccccgcccccaggtggctacccaccagctgcaccaggtggtggtccctggggaggtgctgcctaccctcctccgcccagcatgccccccatcgggctggataacgtggccacctatgcggggcagttcaaccaggactatctctcgggaatggcggccaacatgtctgggacatttggaggagccaacatgcccaacctgtaccctggggcccctggggctggctacccaccagtgccccctggcggctttgggcagcccccctctgcccagcagcctgttcctccctatgggatgtatccacccccaggaggaaacccaccctccaggatgccctcatatccgccatacccaggggcccctgtgccgggccagcccatgccaccccccggacagcagcccccaggggcctaccctgggcagccaccagtgacctaccctggtcagcctccagtgccactccctgggcagcagcagccagtgccgagctacccaggatacccggggtctgggactgtcacccccgctgtgcccccaacccagtttggaagccgaggcaccatcactgatgctcccggctttgaccccctgcgagatgccgaggtcctgcggaaggccatgaaaggcttcgggacggatgagcaggccatcattgactgcctggggagtcgctccaacaagcagcggcagcagatcctactttccttcaagacggcttacggcaaggatttgatcaaagatctgaaatctgaactgtcaggaaactttgagaagacaatcttggctctgatgaagaccccagtcctctttgacatttatgagataaaggaagccatcaagggggttggcactgatgaagcctgcctgattgagatcctcgcttcccgcagcaatgagcacatccgagaattaaacagagcctacaaagcagaattcaaaaagaccctggaagaggccattcgaagcgacacatcagggcacttccagcggctcctcatctctctctctcagggaaaccgtgatgaaagcacaaacgtggacatgtcactcgcccagagagatgcccaggagctgtatgcggccggggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcggtacgggcctgctgcaggccaactgggctcccttttggcatctcagtcacctgtggaacctccctccttggagtggccatatgcttggcctctgtgctgtgtgtgggcatcttgattatggacctcggacttgttcatccccttgcccttaaacagattataaatttctgagggcaggtggatcatgaccttgctgtcgcccccaccttgcatcccccagcagcatcagagaacactcgggacctccccaaccttgaccgtgaccttcagcgttccgatcaccgtgtgattccttgatctgtcagtgagaactcatgtcccaaaggctctgtggagctctgctgtcactccctgacaaagcacttcctgcactcagctttatggcgtaggccacatagtaaggccgttcagagcgagggccctgggggtcacgccacttggagtccagcttttctacttgctaactgtgtgaccttgaatggctcccttaaatctccctgaaccccagctccattgtctttaagatgagaaaataatcgttccttcctgggaatgttgtgagtattgagtgaggcagtgcaggtcaagtgtctattaaacactagccacagttgtatcgctgtgtggcagagccagtctg

SEQ ID NO: 312787 - DNA, 2592 bp, Homo sapiens
cccttgcactgcctctggcacctggggcagccgcgcccgcggagttttccgcccggcgctgacggctgctgcgcccgcggctccccagtgccccgagtgccccgcgggccccgcgagcgggagtgggacccagccctaggcagaacccaggcgccgcgcccgggacgcccgcggagagagccactcccgcccacgtcccatttcgcccctcgcgtccggagtccccgtggccaggtgtgtgtctggggaagagacttacagaagtggagttgctgagtcaaagatctaaccatgagctaccctggctatcccccgcccccaggtggctacccaccagctgcaccaggtggtggtccctggggaggtgctgcctaccctcctccgcccagcatgccccccatcgggctggataacgtggccacctatgcggggcagttcaaccaggactatctctcgggaatggcggccaacatgtctgggacatttggaggagccaacatgcccaacctgtaccctggggcccctggggctggctacccaccagtgccccctggcggctttgggcagcccccctctgcccagcagcctgttcctccctatgggatgtatccacccccaggaggaaacccaccctccaggatgccctcatatccgccatacccaggggcccctgtgccgggccagcccatgccaccccccggacagcagcccccaggggcctaccctgggcagccaccagtgacctaccctggtcagcctccagtgccactccctgggcagcagcagccagtgccgagctacccaggatacccggggtctgggactgtcacccccgctgtgcccccaacccagtttggaagccgaggcaccatcactgatgctcccggctttgaccccctgcgagatgccgaggtcctgcggaaggccatgaaaggcttcgggacggatgagcaggccatcattgactgcctggggagtcgctccaacaagcagcggcagcagatcctactttccttcaagacggcttacggcaaggatttgatcaaagatctgaaatctgaactgtcaggaaactttgagaagacaatcttggctctgatgaagaccccagtcctctttgacatttatgagataaaggaagccatcaagggggttggcactgatgaagcctgcctgattgagatcctcgcttcccgcagcaatgagcacatccgagaattaaacagagcctacaaagcagaattcaaaaagaccctggaagaggccattcgaagcgacacatcagggcacttccagcggctcctcatctctctctctcagggaaaccgtgatgaaagcacaaacgtggacatgtcactcgcccagagagatgcccaggagctgtatgcggccggggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgagggtatgtaacttccatgtgcaggttgcgatggaaccttagcctcgcctgtgcctgggaccaagggctgagggcagaaggcctggggagagctaaatctcagctgagagttccgaggacctgggtagggaggggactggagggcccagggcaggtgggaaggtgaggaggcctggtgctcatgctcttgggtggactctctttagggggcaggaacaaaggaccggaccctgattcgcatcatggtgtctcgcagcgagaccgacctcctggacatcagatcagagtataagcggatgtacggcaagtcgctgtaccacgacatctcggtacgggcctgctgcaggccaactgggctcccttttggcatctcagtcacctgtggaacctccctccttggagtggccatatgcttggcctctgtgctgtgtgtgggcatcttgattatggacctcggacttgttcatccccttgcccttaaacagattataaatttctgagggcaggtggatcatgaccttgctgtcgcccccaccttgcatcccccagcagcatcagagaacactcgggacctccccaaccttgaccgtgaccttcagcgttccgatcaccgtgtgattccttgatctgtcagtgagaactcatgtcccaaaggctctgtggagctctgctgtcactccctgacaaagcacttcctgcactcagctttatggcgtaggccacatagtaaggccgttcagagcgagggccctgggggtcacgccacttggagtccagcttttctacttgctaactgtgtgaccttgaatggctcccttaaatctccctgaaccccagctccattgtctttaagatgagaaaataatcgttccttcctgggaatgttgtgagtattgagtgaggcagtgcaggtcaagtgtctattaaacactagccacagttgtatcgctgtgtggcagagccagtctg

SEQ ID NO: 312788 - DNA, 937 bp, Homo sapiens
cccttgcactgcctctggcacctggggcagccgcgcccgcggagttttccgcccggcgctgacggctgctgcgcccgcggctccccagtgccccgagtgccccgcgggccccgcgagcgggagtgggacccagccctaggcagaacccaggcgccgcgcccgggacgcccgcggagagagccactcccgcccacgtcccatttcgcccctcgcgtccggagtccccgtggccagatctaaccatgagctaccctggctatcccccgcccccaggtggctacccaccagctgcaccaggtggtggtccctggggaggtgctgcctaccctcctccgcccagcatgccccccatcgggctggataacgtggccacctatgcggggcagttcaaccaggactatctctcgggaatggcggccaacatgtctgggacatttggaggagccaacatgcccaacctgtaccctggggcccctggggctggctacccaccagtgccccctggcggctttgggcagcccccctctgcccagcagcctgttcctccctatgggatgtatccacccccaggaggaaacccaccctccaggatgccctcatatccgccatacccaggggcccctgtgccgggccagcccatgccaccccccggacagcagcccccaggggcctaccctgggcagccaccagtgacctaccctggtcagcctccagtgccactccctgggcagcagcagccagtgccgagctacccaggatacccggggtctgggactgtcacccccgctgtgcccccaacccagagttggaagcgagggcatcacttgttctcccgggtttgaccccttcgaaattccgaggtctcggaagcgctaaggcgtcgacggataagcaggcacacttgaggcggggggcgcccaaggggcggggactactc

SEQ ID NO: 312789 - DNA, 1095 bp, Homo sapiens
cgcgggctgccgggaacggggcggagcgcggctgcgccggcgcgtcgaggggagaggcagcagccgcgatggacgtgttcctcatgatccggcgccacaagaccaccatcttcacggacgccaaggagtccagcacggtgttcgaactgaagcgcatcgtcgagggcatcctcaagcggcctcctgacgagcagcggctgtacaaggatgaccaactcttggatgatggcaagacactgggcgagtgtggcttcaccagtcaaacagcacggccacaggccccagccacagtggggctggccttccgggcagatgacacctttgaggccctgtgcatcgagccgttttccagcccgccagagctgcccgatgtgatgaagccccaggactcgggaagcagtgccaatgaacaagccgtgcagtgagacccccaagaggcccatttcccccaataaaagagatttgggagtctgcctggttgctgcctctttttcccgcccctccctgggatgggtcccactccctgtgggctccttttggggcttgtgcttggcagttcctgtgctgtcctgtctcccagatcctgagaccctggctgagaacttggcccagcctgctgcttaaaggcaccatggggacctgggttgccctcagacccaagccattgttagcagctagccagccacaccaaccacgccagggggaggaaagggaaggactgggagagacacaaagaccagagccagcctcagggacaagagattccagttttaggcctttctccttctaagtgccccccacccccatagcctgcatgtccactcccagacgatggccaagagcagaaacacaagctggagccagtgtcctggtttgacagcatgttcaacgagggaaccccaagacggacccacacaggtccacccacgctgggggctgtaatcacggagggaagtggctgcccccttaacacacctttaataaacagtctacagacccaaaaaaaaaaatcattgtctcgtaggccttagtggtgaagctctgcagccgattcctttatcgaggcgtaatccatgatcctcgctactgactctt

SEQ ID NO: 312790 - DNA, 1000 bp, Homo sapiens
cgcgggctgccgggaacggggcggagcgcggctgcgccggcgcgtcgaggggagaggcagcagccgcgatggacgtgttcctcatgatccggcgccacaagaccaccatcttcacggacgccaaggagtccagcacggtgttcgaactgaagcgcatcgtcgagggcatcctcaagcggcctcctgacgagcagcggctgtacaaggatgaccaactcttggatgatggcaagacactgggcgagtgtggcttcaccagtcaaacagcacggccacaggccccagccacagtggggctggccttccgggcagatgacacctttgaggccctgtgcatcgagccgttttccagcccgccagagctgcccgatgtgatgaagccccaggactcgggaagcagtgccaatgaacaagccgtgcagtgagacccccaagaggcccatttcccccaataaaagagatttgggagtctgcctggttgctgcctctttttcccgcccctccctgggatgggtcccactccctgtgggctccttttggggcttgtgcttggcagttcctgtgctgtcctgtctcccagatcctgagaccctggctgagaacttggcccagcctgctgcttaaaggcaccatggggacctgggttgccctcagacccaagccattgttagcagctagccagccacaccaaccacgccagggggaggaaagggaaggactgggagagacacaaagaccagagccagcctcagggacaagagattccagttttaggcctttctccttctaagtgccccccacccccatagcctgcatgtccactcccagacgatggccaagagcagaaacacaagctggagccagtgtcctggtttgacagcatgttcaacgagggaaccccaagacggacccacacaggtccacccacgctgggggctgtaatcacggagggaagtggctgcccccttaacacacctttaataaacagtctacagaccca

SEQ ID NO: 312791 - DNA, 468 bp, Homo sapiens
  misc_feature (26)..(26): n is a, c, g, or t
gcggcggggggcggctgggccgcgcngggggcccgggcttcgtgctcacgccggcccgccgcccccaggacgtgttcctcatgatccggcgccacaagaccaccatcttcacggacgccaaggagtccagcacggtgttcgaactgaagcgcatcgtcgagggcatcctcaagcggcctcctgacgagcagcggctgtacaaggatgaccaactcttggatgatggcaagacactgggcgagtgtggcttcaccagtcaaacagcacggccacaggccccagccacagtggggctggccttccgggcagatgacacctttgaggccctgtgcatcgagccgttttccagcccgccagagctgcccgatgtgatgaagccccaggactcgggaagcagtgccaatgaacaagccgtgcagtgagacccccaagaggcccatttcccccaataaaagagatttgggagtc

SEQ ID NO: 312792 - DNA, 595 bp, Homo sapiens
  misc_feature (26)..(26): n is a, c, g, or t
gcggcggggggcggctgggccgcgcngggggcccgggcttcgtgctcacgccggcccgccgcccccaggacgtgttcctcatgatccggcgccacaagaccaccatcttcacggacgccaaggagtccagcacggtgttcgaactgaagcgcatcgtcgagggcatcctcaagcggcctcctgacgagcagcggctgtacaaggatgaccaactcttggatgatggcaagacactgggcgagtgtggcttcaccagtcaaacagcacggccacaggccccagccacagtggggctggccttccgggcagatgacacctttgaggccctgtgcatcgagccgttttccagcccgccagagctgcccgatgtgatgaagccccaggactcgggaagcagtgccaatgaacaagccgtgcagtgagacccccaagaggcccatttcccccaataaaagagatttgggagtcaaaaaaaaaaaaaaaaaaccccaaaccaacaaaaaacaaaacttttagattcgggaagccttacgtttggcccaatttttgctctattgcccaattccccttatgggggggttattaaattccgggt

SEQ ID NO: 312793 - DNA, 999 bp, Homo sapiens
ctagctgggggcgaactgggggagaggcagcagccgcgatggacgtgttcctcatgatccggcgccacaagaccaccatcttcacggacgccaaggagtccagcacggtgttcgaactgaagcgcatcgtcgagggcatcctcaagcggcctcctgacgagcagcggctgtacaaggatgaccaactcttggatgatggcaagacactgggcgagtgtggcttcaccagtcaaacagcacggccacaggccccagccacagtggggctggccttccgggcagatgacacctttgaggccctgtgcatcgagccgttttccagcccgccagagctgcccgatgtgatgaagccccaggactcgggaagcagtgccaatgaacaagccgtgcacctgcatgtccactcccagacgatggccaagagcagaaacacaagctggagccagtgtcctggtttgacagcatgttcaacgagggaaccccaagacggacccacacaggtccacccacgctgggggctgtaatcacggagggaagtggctgcccccttaacacacctttaataaacagtctacagacccaaaaacaacccaaaaaaaacatcgaagaatcaaaggaccggggtgcggcaaaaagagcgcaccgaaagggccccacgggacacagaggaacccagcacacgcccaacggaaccacaggggccaacactcgacgggacccaccaccgacagagagcgaacacaataccactcgccgaagaaacacacggtgacacccgcgccctaaaggacacccaagacacgagcagagcgcgacaacacagacaagaccacgagcgagacacaaaggacagccggggacacaccaacagacgggagcaagcgacacacacgcacagcagcaacgacctaacaagagaacacagacgccaccagaagcggacacgagcaacacaggaagacagaaacaacagatcacgcacacaagacgacagcgacc

SEQ ID NO: 312794 - DNA, 1282 bp, Homo sapiens
cgcgggctgccgggaacggggcggagcgcggctgcgccggcgcgtcgaggggagaggcagcagccgcgatggacgtgttcctcatgatccggcgccacaagaccaccatcttcacggacgccaaggagtccagcacggtgttcgaactgaagcgcatcgtcgagggcatcctcaagcggcctcctgacgagcagcggctgtacaaggatgaccaactcttggatgatggcaagacactgggcgagtgtggcttcaccagtcaaacagcacggccacaggccccagccacagtggggctggccttccgggcagatgacacctttgaggccctgtgcatcgagccgttttccagcccgccagagctgcccgatgtgatgaagccccaggactcgggaagcagtgccaatgaacaagccgtgcagtgagacccccaagaggcccatttcccccaataaaagagatttgggagtcaaaaaaaaaaaaaaaaaaaaaaaaaaaaacaaaaaaaaaaaaaaaaaaaaaaaaaaaaaaaaaaaaaaaaaaaaaaaaaaaaaaaaggggggggggggcaaaaaccggggggcgccaccaaacgatcgcacccccccccgcactttttctagacagaagaggggcgggccaaccaaaacagaaggcaggccataatctaaacaagaaagagccgagcgggcggcgcaccttaaaacacacaccgcctcgagcggcgaagaaaaagaacaccacagtccgcagcgagcaatccatagtaaggggaaggacacccaactcagtgcgggagggcggagcaacaagacgtagcgcacaccaacactaaagaaaaataaagcgcccgaggagcaaaaaacaacccaaccgcgaggatgggtgggagaaacacacaccgcagtaattcgttccgcccaaggacaaaaaaagctcgcacacgaggagaggtaaaaatagataaagaaaatttcaacccggccgctggctcggatacacaatcgtccgcacctaatgaatcacaattctactagaaaaaactcagcaacgacagcatatgccgaatgtccattcatcaactcagcctgaatacatgcatacgataaaatgtccatacacatactatctcccccacaccgcacacccacgaacagacctaaacacagctactcaaacacacagcaactcacaaagcaccacaccacgcacaataaagagcacactccccacaatccacatatctacccaccttctccaccaccaccacgctactaagaaa

SEQ ID NO: 312795 - DNA, 1029 bp, Homo sapiens
cgcgggctgccgggaacggggcggagcgcggctgcgccggcgcgtcgaggggagaggcagcagccgcgatggacgtgttcctcatgatccggcgccacaagaccaccatcttcacggacgccaaggagtccagcacggtgttcgaactgaagcgcatcgtcgagggcatcctcaagcggcctcctgacgagcagcggctgtacaaggatgaccaactcttggatgatggcaagacactgggcgagtgtggcttcaccagtcaaacagcacggccacaggccccagccacagtggggctggccttccgggcagatgacacctttgaggccctgtgcatcgagccgttttccagcccgccagagctgcccgatgtgatgaagccccaggactcgggaagcagtgccaatgaacaagccgtgcacctgcatgtccactcccagacgatggccaagagcagaaacacaagctggagccagtgtcctggtttgacagcatgttcaacgagggaaccccaagacggacccacacaggtccacccacgctgggggctgtaatcacggagggaagtggctgcccccttaacacacctttaataaacagtctacagacccaaaaacaacccaaaaaaaacatcgaagaatcaaaggaccggggtgcggcaaaaagagcgcaccgaaagggccccacgggacacagaggaacccagcacacgcccaacggaaccacaggggccaacactcgacgggacccaccaccgacagagagcgaacacaataccactcgccgaagaaacacacggtgacacccgcgccctaaaggacacccaagacacgagcagagcgcgacaacacagacaagaccacgagcgagacacaaaggacagccggggacacaccaacagacgggagcaagcgacacacacgcacagcagcaacgacctaacaagagaacacagacgccaccagaagcggacacgagcaacacaggaagacagaaacaacagatcacgcacacaagacgacagcgacc

SEQ ID NO: 312796 - DNA, 928 bp, Homo sapiens
caacggtatcgcccgcgccgtgcagttgacgaaattgaggatgaccaactcttggatgatggcaagacactgggcgagtgtggcttcaccagtcaaacagcacggccacaggccccagccacagtggggctggccttccgggcagatgacacctttgaggccctgtgcatcgagccgttttccagcccgccagagctgcccgatgtgatgaagccccaggactcgggaagcagtgccaatgaacaagccgtgcagtgagacccccaagaggcccatttcccccaataaaagagatttgggagtctgcctggttgctgcctctttttcccgcccctccctgggatgggtcccactccctgtgggctccttttggggcttgtgcttggcagttcctgtgctgtcctgtctcccagatcctgagaccctggctgagaacttggcccagcctgctgcttaaaggcaccatggggacctgggttgccctcagacccaagccattgttagcagctagccagccacaccaaccacgccagggggaggaaagggaaggactgggagagacacaaagaccagagccagcctcagggacaagagattccagttttaggcctttctccttctaagtgccccccacccccatagcctgcatgtccactcccagacgatggccaagagcagaaacacaagctggagccagtgtcctggtttgacagcatgttcaacgagggaaccccaagacggacccacacaggtccacccacgctgggggctgtaatcacggagggaagtggctgcccccttaacacacctttaataaacagtctacagacccaaaaaaaaaaatcattgtctcgtaggccttagtggtgaagctctgcagccgattcctttatcgaggcgtaatccatgatcctcgctactgactctt

SEQ ID NO: 312797 - DNA, 338 bp, Homo sapiens
cgcgggctgccgggaacggggcggagcgcggctgcgccggcgcgtcgaggggagaggcagcagccgcgatggacgtgttcctcatgatccggcgccacaagaccaccatcttcacggacgccaaggagtccagcacggtgttcgaactgaagcgcatcgtcgagggcatcctcaagcggcctcctgacgagcagcggctgtacaaggatgaccaactcttggatgatggcaagacactgggcgagtgtggcttcaccagtcaaacagcacggccacaggccccagccacagtggggctggccttccgggcaggtgagaggcccaccacccactgggct

SEQ ID NO: 312798 - DNA, 365 bp, Homo sapiens
cgcgggctgccgggaacggggcggagcgcggctgcgccggcgcgtcgaggggagaggcagcagccgcgatggacgtgttcctcatgatccggcgccacaagaccaccatcttcacggacgccaaggagtccagcacggtgttcgaactgaagcgcatcgtcgagggcatcctcaagcggcctcctgacgagcagcggctgtacaagatgacacctttgaggccctgtgcatcgagccgttttccagcccgccagagctgcccgatgtgatgaagccccaggactcgggaagcagtgccaatgaacaagccgtgcagtgagacccccaagaggcccatttcccccaataaaagagatttgggagtc

SEQ ID NO: 312799 - DNA, 471 bp, Homo sapiens
cgcgggctgccgggaacggggcggagcgcggctgcgccggcgcgtcgaggggagaggcagcagccgcgatggacgtgttcctcatgatccggcgccacaagaccaccatcttcacggacgccaaggagtccagcacggtgttcgaactgaagcgcatcgtcgagggcatcctcaagcggcctcctgacgagcagcggctgtacaaggatgaccaactcttggatgatggcaagacactgggcgagtgtggcttcaccagtcaaacagcacggccacaggccccagccacagtggggctggccttccgggcagatgacacctttgaggccctgtgcatcgagccgttttccagcccgccagagctgcccgatgtgatgaagccccaggactcgggaagcagtgccaatgaacaagccgtgcagtgagacccccaagaggcccatttcccccaataaaagagatttgggagtc

SEQ ID NO: 312800 - DNA, 646 bp, Homo sapiens
cgcgggctgccgggaacggggcggagcgcggctgcgccggcgcgtcgaggggagaggcagcagccgcgatggacgtgttcctcatgatccggcgccacaagaccaccatcttcacggacgccaaggagtccagcacggtgttcgaactgaagcgcatcgtcgagggcatcctcaagcggcctcctgacgagcagcggctgtacaaggatgaccaactcttggatgatggcaagacactgggcgagtgtggcttcaccagtcaaacagcacggccacaggccccagccacagtggggctggccttccgggcagatgacacctttgaggccctgtgcatcgagccgttttccagcccgccagagctgcccgatgtgatgaagccccaggactcgggaagcagtgccaatgaacaagccgtgcagtgagacccccaagaggcccatttcccccaataaaagagatttgggagtcaaaaaaaaaaaaaaaaaaaaaaaaaaaaacaaaaaaaaaaaaaaaaaaaaaaaaaaaaaaaaaaaaccccaaaccaacaaaaaacaaaacttttagattcgggaagccttacgtttggcccaatttttgctctattgcccaattccccttatgggggggttattaaattccgggt

SEQ ID NO: 312801 - DNA, 660 bp, Homo sapiens
cgcgggctgccgggaacggggcggagcgcggctgcgccggcgcgtcgaggggagaggcagcagccgcgatggacgtgttcctcatgatccggcgccacaagaccaccatcttcacggacgccaaggagtccagcacggtgttcgaactgaagcgcatcgtcgagggcatcctcaagcggcctcctgacgagcagcggctgtacaaggatgaccaactcttggatgatggcaagacactgggcgagtgtggcttcaccagtcaaacagcacggccacaggccccagccacagtggggctggccttccgggcagatgacacctttgaggccctgtgcatcgagccgttttccagcccgccagagctgcccgatgtgatgaagccccaggactcgggaagcagtgccaatgaacaagccgtgcagtgagacccccaagaggcccatttcccccaataaaagagatttgggagtcaactgcctcctgccagctctcatctcccctgacagcttgacctagccgccacaggcagggctgtatgccacgaatttactgactaacaccattggggccgtttggccccatcagcttttagattgggccaagcttatcttcggcccaatttcgggctcactggcccatttcccctatgggggccgtttc

SEQ ID NO: 312802 - DNA, 582 bp, Homo sapiens
ctagctgggggcgaactgggggagaggcagcagccgcgatggacgtgttcctcatgatccggcgccacaagaccaccatcttcacggacgccaaggagtccagcacggtgttcgaactgaagcgcatcgtcgagggcatcctcaagcggcctcctgacgagcagcggctgtacaaggatgaccaactcttggatgatggcaagacactgggcgagtgtggcttcaccagtcaaacagcacggccacaggccccagccacagtggggctggccttccgggcagatgacacctttgaggccctgtgcatcgagccgttttccagcccgccagagctgcccgatgtgatgaagccccaggactcgggaagcagtgccaatgaacaagccgtgcacctgcatgtccactcccagacgatggccaagagcagaaacacaagctggagccagtgtcctggtttgacagcatgttcaacgagggaaccccaagacggacccacacaggtccacccacgctgggggctgtaatcacggagggaagtggctgcccccttaacacacctttaataaacagtctacagaccca

SEQ ID NO: 312803 - DNA, 1065 bp, Homo sapiens
ctagctgggggcgaactgggggagaggcagcagccgcgatggacgtgttcctcatgatccggcgccacaagaccaccatcttcacggacgccaaggagtccagcacggtgttcgaactgaagcgcatcgtcgagggcatcctcaagcggcctcctgacgagcagcggctgtacaaggatgaccaactcttggatgatggcaagacactgggcgagtgtggcttcaccagtcaaacagcacggccacaggccccagccacagtggggctggccttccgggcagatgacacctttgaggccctgtgcatcgagccgttttccagcccgccagagctgcccgatgtgatgaagccccaggactcgggaagcagtgccaatgaacaagccgtgcagtgagacccccaagaggcccatttcccccaataaaagagatttgggagtctgcctggttgctgcctctttttcccgcccctccctgggatgggtcccactccctgtgggctccttttggggcttgtgcttggcagttcctgtgctgtcctgtctcccagatcctgagaccctggctgagaacttggcccagcctgctgcttaaaggcaccatggggacctgggttgccctcagacccaagccattgttagcagctagccagccacaccaaccacgccagggggaggaaagggaaggactgggagagacacaaagaccagagccagcctcagggacaagagattccagttttaggcctttctccttctaagtgccccccacccccatagcctgcatgtccactcccagacgatggccaagagcagaaacacaagctggagccagtgtcctggtttgacagcatgttcaacgagggaaccccaagacggacccacacaggtccacccacgctgggggctgtaatcacggagggaagtggctgcccccttaacacacctttaataaacagtctacagacccaaaaaaaaaaatcattgtctcgtaggccttagtggtgaagctctgcagccgattcctttatcgaggcgtaatccatgatcctcgctactgactctt

SEQ ID NO: 312804 - DNA, 1092 bp, Homo sapiens
  misc_feature (26)..(26): n is a, c, g, or t
gcggcggggggcggctgggccgcgcngggggcccgggcttcgtgctcacgccggcccgccgcccccaggacgtgttcctcatgatccggcgccacaagaccaccatcttcacggacgccaaggagtccagcacggtgttcgaactgaagcgcatcgtcgagggcatcctcaagcggcctcctgacgagcagcggctgtacaaggatgaccaactcttggatgatggcaagacactgggcgagtgtggcttcaccagtcaaacagcacggccacaggccccagccacagtggggctggccttccgggcagatgacacctttgaggccctgtgcatcgagccgttttccagcccgccagagctgcccgatgtgatgaagccccaggactcgggaagcagtgccaatgaacaagccgtgcagtgagacccccaagaggcccatttcccccaataaaagagatttgggagtctgcctggttgctgcctctttttcccgcccctccctgggatgggtcccactccctgtgggctccttttggggcttgtgcttggcagttcctgtgctgtcctgtctcccagatcctgagaccctggctgagaacttggcccagcctgctgcttaaaggcaccatggggacctgggttgccctcagacccaagccattgttagcagctagccagccacaccaaccacgccagggggaggaaagggaaggactgggagagacacaaagaccagagccagcctcagggacaagagattccagttttaggcctttctccttctaagtgccccccacccccatagcctgcatgtccactcccagacgatggccaagagcagaaacacaagctggagccagtgtcctggtttgacagcatgttcaacgagggaaccccaagacggacccacacaggtccacccacgctgggggctgtaatcacggagggaagtggctgcccccttaacacacctttaataaacagtctacagacccaaaaaaaaaaatcattgtctcgtaggccttagtggtgaagctctgcagccgattcctttatcgaggcgtaatccatgatcctcgctactgactctt

SEQ ID NO: 312805 - DNA, 612 bp, Homo sapiens
cgcgggctgccgggaacggggcggagcgcggctgcgccggcgcgtcgaggggagaggcagcagccgcgatggacgtgttcctcatgatccggcgccacaagaccaccatcttcacggacgccaaggagtccagcacggtgttcgaactgaagcgcatcgtcgagggcatcctcaagcggcctcctgacgagcagcggctgtacaaggatgaccaactcttggatgatggcaagacactgggcgagtgtggcttcaccagtcaaacagcacggccacaggccccagccacagtggggctggccttccgggcagatgacacctttgaggccctgtgcatcgagccgttttccagcccgccagagctgcccgatgtgatgaagccccaggactcgggaagcagtgccaatgaacaagccgtgcacctgcatgtccactcccagacgatggccaagagcagaaacacaagctggagccagtgtcctggtttgacagcatgttcaacgagggaaccccaagacggacccacacaggtccacccacgctgggggctgtaatcacggagggaagtggctgcccccttaacacacctttaataaacagtctacagaccca

SEQ ID NO: 312806 - DNA, 1164 bp, Homo sapiens
cgcgggctgccgggaacggggcggagcgcggctgcgccggcgcgtcgaggggagaggcagcagccgcgatggacgtgttcctcatgatccggcgccacaagaccaccatcttcacggacgccaaggagtccagcacggtgttcgaactgaagcgcatcgtcgagggcatcctcaagcggcctcctgacgagcagcggctgtacaagttgctggtcagaagtctttgggacttgccccacgtagggcctctcccaagatcctgcttctctcctcaggatgaccaactcttggatgatggcaagacactgggcgagtgtggcttcaccagtcaaacagcacggccacaggccccagccacagtggggctggccttccgggcagatgacacctttgaggccctgtgcatcgagccgttttccagcccgccagagctgcccgatgtgatgaagccccaggactcgggaagcagtgccaatgaacaagccgtgcagtgagacccccaagaggcccatttcccccaataaaagagatttgggagtctgcctggttgctgcctctttttcccgcccctccctgggatgggtcccactccctgtgggctccttttggggcttgtgcttggcagttcctgtgctgtcctgtctcccagatcctgagaccctggctgagaacttggcccagcctgctgcttaaaggcaccatggggacctgggttgccctcagacccaagccattgttagcagctagccagccacaccaaccacgccagggggaggaaagggaaggactgggagagacacaaagaccagagccagcctcagggacaagagattccagttttaggcctttctccttctaagtgccccccacccccatagcctgcatgtccactcccagacgatggccaagagcagaaacacaagctggagccagtgtcctggtttgacagcatgttcaacgagggaaccccaagacggacccacacaggtccacccacgctgggggctgtaatcacggagggaagtggctgcccccttaacacacctttaataaacagtctacagacccaaaaaaaaaaatcattgtctcgtaggccttagtggtgaagctctgcagccgattcctttatcgaggcgtaatccatgatcctcgctactgactctt

SEQ ID NO: 312807 - DNA, 540 bp, Homo sapiens
cgcgggctgccgggaacggggcggagcgcggctgcgccggcgcgtcgaggggagaggcagcagccgcgatggacgtgttcctcatgatccggcgccacaagaccaccatcttcacggacgccaaggagtccagcacggtgttcgaactgaagcgcatcgtcgagggcatcctcaagcggcctcctgacgagcagcggctgtacaagttgctggtcagaagtctttgggacttgccccacgtagggcctctcccaagatcctgcttctctcctcaggatgaccaactcttggatgatggcaagacactgggcgagtgtggcttcaccagtcaaacagcacggccacaggccccagccacagtggggctggccttccgggcagatgacacctttgaggccctgtgcatcgagccgttttccagcccgccagagctgcccgatgtgatgaagccccaggactcgggaagcagtgccaatgaacaagccgtgcagtgagacccccaagaggcccatttcccccaataaaagagatttgggagtc

SEQ ID NO: 312808 - DNA, 488 bp, Homo sapiens
  misc_feature (26)..(26): n is a, c, g, or t
gcggcggggggcggctgggccgcgcngggggcccgggcttcgtgctcacgccggcccgccgcccccaggacgtgttcctcatgatccggcgccacaagaccaccatcttcacggacgccaaggagtccagcacggtgttcgaactgaagcgcatcgtcgagggcatcctcaagcggcctcctgacgagcagcggctgtacaaggatgaccaactcttggatgatggcaagacactgggcgagtgtggcttcaccagtcaaacagcacggccacaggccccagccacagtggggctggccttccgggcagctctgctgcttcctccacagatgacacctttgaggccctgtgcatcgagccgttttccagcccgccagagctgcccgatgtgatgaagccccaggactcgggaagcagtgccaatgaacaagccgtgcagtgagacccccaagaggcccatttcccccaataaaagagatttgggagtc

SEQ ID NO: 312809 - DNA, 2399 bp, Homo sapiens
atttaacggaaactgtgggcggtgagaagttccttatgacacactaatcccaacctgctgaccggaccacgcctccagcggagggaacctctagagctccaggacattcaggtaccaggtagccccaaggaggagctgccgacctggcagggaacaaccaagactggggttaaatctcacagcctgcaagtggaagagaagaacttgaacccaggtccaacttttgcgccacagcaggctgcctcttggtcctgacaggaagtcacaacttgggtctgagtactgatccctggctattttttggctgtgttaccttggacaagtcacttattcctcctcccgtttcctcctatgtaaaatggaaataataatgttgaccctgggtctgagagagtggatttgaaagtacttagtgcatcacaaagcacagaacacacttccagtctcgtgattatgtacttatgtaactggtcatcacccatcttgagaatgaatgcattggggaaagggccatccactaggctgcgaagtttctgagggactccttcgggctggagaaggatggccacaggagggaggagagattgccttatcctgcagtgatcatgtcattgagaacagagccagattctttttttcctggcagggccaacttgttttaacatctaaggactgagctatttgtgtctgtgccctttgtccaagcagtgtttcccaaagtgtagcccaagaaccatctccctcagagccaccaggaagtgctttaaattgcaggttcctaggccacagcctgcacctgcagagtcagaatcatggaggttgggacccaggcacctgcgtttctaacaaatgcctcgggtgattctgatgcaattgaaagtttgagatccacagttctgagacaataacagaatggtttttctaacccctgcagccctgacttcctatcctagggaaggggccggctggagaggccaggacagagaaagcagatcccttctttttccaaggactctgtgtcttccataggcaacatgtcagaaggggtgggcacgttccgcatggtacctgaagaggaacaggagctccgtgcccaactggagcagctcacaaccaaggaccatggacctgtctttggcccgtgcagccagctgccccgccacaccttgcagaaggccaaggatgagctgaacgagagagaggagacccgggaggaggcagtgcgagagctgcaggagatggtgcaggcgcaggcggcctcgggggaggagctggcggtggccgtggcggagagggtgcaagagaaggacagcggcttcttcctgcgcttcatccgcgcacggaagttcaacgtgggccgtgcctatgagctgctcagaggctatgtgaatttccggctgcagtaccctgagctctttgacagcctgtccccagaggctgtccgctgcaccattgaagctggctaccctggtgtcctctctagtcgggacaagtatggccgagtggtcatgctcttcaacattgagaactggcaaagtcaagaaatcacctttgatgagatcttgcaggcatattgcttcatcctggagaagctgctggagaatgaggaaactcaaatcaatggcttctgcatcattgagaacttcaagggctttaccatgcagcaggctgctagtctccggacttcagatctcaggaagatggtggacatgctccaggattccttcccagcccggttcaaagccatccacttcatccaccagccatggtacttcaccacgacctacaatgtggtcaagcccttcttgaagagcaagctgcttgagagggtctttgtccacggggatgacctttctggtttctaccaggagatcgatgagaacatcctgccctctgacttcgggggcacgctgcccaagtatgatggcaaggccgttgctgagcagctctttggcccccaggcccaagctgagaacacagccttctgaaaacatctcctgccagctgaactgtagttagaatctctgggcctctcctcaactgtcctggacccaaggctaggaaagggctgcttgagatgactgtggtccccccttagactccctaagcccgagtgagctcaggtgtcaccctgttctcaagttgggggatggggaataaaggagggggaattcccttgaacaagaagaactggggatagttatatttccacctgcccttgaagctttaagacagtgatttttgtgtaaggttgtatttcaaagactcgaattcattttctcaatcatttcctttgtaacagagttttacgacttagagtctgtgaaaacaggcaaggagcccgggttaaaatatccccctattcgcccccaaaatgcaataaaagaagataaaagaga

SEQ ID NO: 312810 - DNA, 926 bp, Homo sapiens
  misc_feature (70)..(70): n is a, c, g, or t
  misc_feature (77)..(78): n is a, c, g, or t
  misc_feature (85)..(85): n is a, c, g, or t
atgatatatcaaataagtacaacttggcaagaagcgaaaggaggagcctaggcgtcaactgactctcttnttaaccnncgctacngatcttgcaggcatattgcttcatcctggagaagctgctggagaatgaggaaactcaaatcaatggcttctgcatcattgagaacttcaagggctttaccatgcagcaggctgctagtctccggacttcagatctcaggaagatggtggacatgctccaggattccttcccagcccggttcaaagccatccacttcatccaccagccatggtacttcaccacgacctacaatgtggtcaagcccttcttgaagagcaagctgcttgagagggtctttgtccacggggatgacctttctggtttctaccaggagatcgatgagaacatcctgccctctgacttcgggggcacgctgcccaagtatgatggcaaggccgttgctgagcagctctttggcccccaggcccaagctgagaacacagccttctgaaaacatctcctgccagctgaactgtagttagaatctctgggcctctcctcaactgtcctggacccaaggctaggaaagggctgcttgagatgactgtggtccccccttagactccctaagcccgagtgagctcaggtgtcaccctgttctcaagttgggggatggggaataaaggagggggaattcccttgaacaagaagaactggggatagttatatttccacctgcccttgaagctttaagacagtgatttttgtgtaaggttgtatttcaaagactcgaattcattttctcaatcatttcctttgtaacagagttttacgacttagagtctgtgaaaacaggcaaggagcccgggttaaaatatccccctattcgcccccaaaatgcaataaaagaagataaaagaga

SEQ ID NO: 312811 - DNA, 1738 bp, Homo sapiens
atttaacggaaactgtgggcggtgagaagttccttatgacacactaatcccaacctgctgaccggaccacgcctccagcggagggaacctctagagctccaggacattcaggtaccaggtagccccaaggaggagctgccgacctggcagggaacaaccaagactggggttaaatctcacagcctgcaagtggaagagaagaacttgaacccaggtccaacttttgcgccacagcaggctgcctcttggtcctgacaggaagtcacaacttggccctgacttcctatcctagggaaggggccggctggagaggccaggacagagaaagcagatcccttctttttccaaggactctgtgtcttccataggcaacatgtcagaaggggtgggcacgttccgcatggtacctgaagaggaacaggagctccgtgcccaactggagcagctcacaaccaaggaccatggacctgtctttggcccgtgcagccagctgccccgccacaccttgcagaaggccaaggatgagctgaacgagagagaggagacccgggaggaggcagtgcgagagctgcaggagatggtgcaggcgcaggcggcctcgggggaggagctggcggtggccgtggcggagagggtgcaagagaaggacagcggcttcttcctgcgcttcatccgcgcacggaagttcaacgtgggccgtgcctatgagctgctcagaggctatgtgaatttccggctgcagtaccctgagctctttgacagcctgtccccagaggctgtccgctgcaccattgaagctggctaccctggtgtcctctctagtcgggacaagtatggccgagtggtcatgctcttcaacattgagaactggcaaagtcaagaaatcacctttgatgagatcttgcaggcatattgcttcatcctggagaagctgctggagaatgaggaaactcaaatcaatggcttctgcatcattgagaacttcaagggctttaccatgcagcaggctgctagtctccggacttcagatctcaggaagatggtggacatgctccaggattccttcccagcccggttcaaagccatccacttcatccaccagccatggtacttcaccacgacctacaatgtggtcaagcccttcttgaagagcaagctgcttgagagggtctttgtccacggggatgacctttctggtttctaccaggagatcgatgagaacatcctgccctctgacttcgggggcacgctgcccaagtatgatggcaaggccgttgctgagcagctctttggcccccaggcccaagctgagaacacagccttctgaaaacatctcctgccagctgaactgtagttagaatctctgggcctctcctcaactgtcctggacccaaggctaggaaagggctgcttgagatgactgtggtccccccttagactccctaagcccgagtgagctcaggtgtcaccctgttctcaagttgggggatggggaataaaggagggggaattcccttgaacaagaagaactggggatagttatatttccacctgcccttgaagctttaagacagtgatttttgtgtaaggttgtatttcaaagactcgaattcattttctcaatcatttcctttgtaacagagttttacgacttagagtctgtgaaaacaggcaaggagcccgggttaaaatatccccctattcgcccccaaaatgcaataaaagaagataaaagaga

SEQ ID NO: 312812 - DNA, 1449 bp, Homo sapiens
  misc_feature (35)..(35): n is a, c, g, or t
  misc_feature (58)..(58): n is a, c, g, or t
  misc_feature (62)..(63): n is a, c, g, or t
atggaagacacagatccttggaaaaaagaaggganctgctttctctgtcctggcctcnccanncggccccttccctaggcaacatgtcaagaaggggtgggcacgttccgcatggtacctgaagaggaacaggagctccgtgcccaactggagcagctcacaaccaaggaccatggacctgtctttggcccgtgcagccagctgccccgccacaccttgcagaaggccaaggatgagctgaacgagagagaggagacccgggaggaggcagtgcgagagctgcaggagatggtgcaggcgcaggcggcctcgggggaggagctggcggtggccgtggcggagagggtgcaagagaaggacagcggcttcttcctgcgcttcatccgcgcacggaagttcaacgtgggccgtgcctatgagctgctcagaggctatgtgaatttccggctgcagtaccctgagctctttgacagcctgtccccagaggctgtccgctgcaccattgaagctggctaccctggtgtcctctctagtcgggacaagtatggccgagtggtcatgctcttcaacattgagaactggcaaagtcaagaaatcacctttgatgagatcttgcaggcatattgcttcatcctggagaagctgctggagaatgaggaaactcaaatcaatggcttctgcatcattgagaacttcaagggctttaccatgcagcaggctgctagtctccggacttcagatctcaggaagatggtggacatgctccaggattccttcccagcccggttcaaagccatccacttcatccaccagccatggtacttcaccacgacctacaatgtggtcaagcccttcttgaagagcaagctgcttgagagggtctttgtccacggggatgacctttctggtttctaccaggagatcgatgagaacatcctgccctctgacttcgggggcacgctgcccaagtatgatggcaaggccgttgctgagcagctctttggcccccaggcccaagctgagaacacagccttctgaaaacatctcctgccagctgaactgtagttagaatctctgggcctctcctcaactgtcctggacccaaggctaggaaagggctgcttgagatgactgtggtccccccttagactccctaagcccgagtgagctcaggtgtcaccctgttctcaagttgggggatggggaataaaggagggggaattcccttgaacaagaagaactggggatagttatatttccacctgcccttgaagctttaagacagtgatttttgtgtaaggttgtatttcaaagactcgaattcattttctcaatcatttcctttgtaacagagttttacgacttagagtctgtgaaaacaggcaaggagcccgggttaaaatatccccctattcgcccccaaaatgcaataaaagaagataaaagaga

SEQ ID NO: 312813 - DNA, 389 bp, Homo sapiens
  misc_feature (8)..(8): n is a, c, g, or t
gcggccgnctactactactaaattcgcggccgcgtcggaacaaatggggaaaactgaaaactaaaaattttaaatgtattaaatgccatccctgagcctaaatctagtatttgtagtttatttctaggtctgctagaacctgaaaacctgaatgaaaaaaggtgtgctgacactaatcaagtcctgtgaggtttaaattattgacctatccactctacctccattgtacaaaaaatattttacaacaagcctgggtaagattcaacagcatagtagttttgtatccaaggttacttccccacaaccactttaaacataagaaatgtggtggcaatataaagtttgtagcctttccaataaaggtttataaaacagttaaaaagtgtagt

SEQ ID NO: 312814 - DNA, 2071 bp, Homo sapiens
ctcgggcgctcgggggcgggctctgcacagcgacgtcacgggcaccgtgcgctgcggaaagttcagccccgcccccgcttccccctcgctgtctccctcggcctgtgccgccgccgacgccgcttgtgggcccgactccgctctgtctgcttcgccaccttctccccgagcactgcccggccggccgccatggctaacgtggctgacacgaagctgtacgacatcctgggcgtcccgcccggcgccagcgagaacgagctgaagaaggcatacagaaagttagccaaggaatatcatcctgataagaatccaaatgcaggagacaaatttaaagaaataagttttgcatatgaagtactatcaaatcctgagaagcgtgagttatatgacagatacggagagcaaggtcttcgggaaggcagcggcggaggtggtggcatggatgatattttctctcacatttttggtgggggattgttcggcttcatgggcaatcagagtagaagtcgaaatggcagaagaagaggagaggacatgatgcatccactcaaagtatctttagaagatctgtataatggcaagacaaccaaactacaacttagcaagaatgtgctctgtagtgcatgcagtggccaaggcggaaagtctggagctgtccaaaagtgtagtgcttgtcgaggtcgaggtgtgcgcatcatgatcagacagctggctccagggatggtacaacagatgcagtctgtgtgctctgattgtaatggagaaggagaggtaattaatgaaaaagaccgctgtaaaaaatgtgaagggaagaaggtgattaaagaagtcaagattcttgaagtccacgtagacaaaggcatgaaacatggacagagaattacattcactggggaagcagaccaggccccaggagtggaacccggagacattgttcttttgctacaggagaaagaacatgaggtatttcagagagatgggaatgatttgcacatgacatataaaataggacttgttgaagctctatgtggatttcagttcacatttaagcaccttgatggacgtcagattgtggtgaaatacccccctggcaaagtaattgaaccagggtgtgttcgtgtagttcgaggtgaagggatgccgcagtatcgtaatccctttgaaaaaggtgatctttacataaagtttgatgtgcagtttcctgaaaacaactggatcaacccagacaagctttctgaactagaagatcttctgccatctagaccggaagttcctaacataattggagaaacagaggaggtagagcttcaggaatttgatagcactcgaggctcaggaggtggtcagaggcgtgaagcctataatgatagctctgatgaagaaagcagcagccatcatggacctggagtgcagtgtgcccatcagtaaactctgcaaacaaattgcacaggtggattttctttccacatttgcctgatttgttctcagcaatccagctggagtgtcttatcaatccagatgaactgagggacatctgttggtctatgtataacttttaaaattggtatagtatctacagagtgtataatttaaactaaccacaaagctttacatcttcattttgactgttccatagcagaataaagcacttgaaaggaaacaagactccctttcacacatggattattataagtttcaatcctggtatctgtgcttgatttttatcagttttgtgtagatttttatgtttcatattttaaatttaaatcccacattgtaaagtttgtacaatttgtcctgaagctttgtgtttggctgcacctgcataagctgctacaaatagaataaagaatttcatagcctgtatctatcatttagatgcatggaaaaaaatgggctttgcacacaatgggtttggagctgactgggaacaatggaaaaaattacattagctgtggttgtaaagtttttttgtttttggttttgttttttttttcttttttcttttttttttttttaccatcttgtgaaaggtttctgaaactcgataataaaaagcggttggtgtaaa

SEQ ID NO: 312815 - DNA, 1661 bp, Homo sapiens
ctcgggcgctcgggggcgggctctgcacagcgacgtcacgggcaccgtgcgctgcggaaagttcagccccgcccccgcttccccctcgctgtctccctcggcctgtgccgccgccgacgccgcttgtgggcccgactccgctctgtctgcttcgccaccttctccccgagcactgcccggccggccgccatggctaacgtggctgacacgaagctgtacgacatcctgggcgtcccgcccggcgccagcgagaacgagctgaagaaggcatacagaaagttagccaaggaatatcatcctgataagaatccaaatgcaggagacaaatttaaagaaataagttttgcatatgaagtactatcaaatcctgagaagcgtgagttatatgacagatacggagagcaaggtcttcgggaaggcagcggcggaggtggtggcatggatgatattttctctcacatttttggtgggggattgttcggcttcatgggcaatcagagtagaagtcgaaatggcagaagaagaggagaggacatgatgcatccactcaaagtatctttagaagatctgtataatggcaagacaaccaaactacaacttagcaagaatgtgctctgtagtgcatgcagtggccaaggcggaaagtctggagctgtccaaaagtgtagtgcttgtcgaggtcgaggtgtgcgcatcatgatcagacagctggctccagggatggtacaacagatgcagtctgtgtgctctgattgtaatggagaaggagaggtaattaatgaaaaagaccgctgtaaaaaatgtgaagggaagaaggtgattaaagaagtcaagattcttgaagtccacgtagacaaaggcatgaaacatggacagagaattacattcactggggaagcagaccaggccccaggagtggaacccggagacattgttcttttgctacaggagaaagaacatgaggtatttcagagagatgggaatgatttgcacatgacatataaaataggacttgttgaagctctatgtggatttcagttcacatttaagcaccttgatggacgtcagattgtggtgaaatacccccctggcaaagtaattgaaccagggtgtgttcgtgtagttcgaggtgaagggatgccgcagtatcgtaatccctttgaaaaaggtgatctttacataaagtttgatgtgcagtttcctgaaaacaactggatcaacccagacaagctttctgaactagaagatcttctgccatctagaccggaagttcctaacataattggagaaacagaggaggtagagcttcaggaatttgatagcactcgaggctcaggaggtggtcagaggcgtgaagcctataatgatagctctgatgaagaaagcagcagccatcatggacctggagtgcagtgtgcccatcagtaaactctgcaaacaaattgcacaggtggattttctttccacatttgcctgatttgttctcagcaatccagctggagtgtcttatcaatccagatgaactgagggacatctgttggtctatgtataacttttaaaattggtatagtatctacagagtgtataatttaaactaaccacaaagctttacatcttcattttgactgttccatagcagaataaagcacttgaaaggaaac

SEQ ID NO: 312816 - DNA, 339 bp, Homo sapiens
  misc_feature (8)..(8): n is a, c, g, or t
gcggccgnctactactactaaattcgcggccgcgtcgatttttatgtttcatattttaaatttaaatcccacattgtaaagtttgtacaatttgtcctgaagctttgtgtttggctgcacctgcataagctgctacaaatagaataaagaatttcatagcctgtatctatcatttagatgcatggaaaaaaatgggctttgcacacaatgggtttggagctgactgggaacaatggaaaaaattacattagctgtggttgtaaagtttttttgtttttgtttttttaccatcttgtgaaaggtttctgaaactcgataataaaaagcggttggtgtaaa

SEQ ID NO: 312817 - DNA, 432 bp, Homo sapiens
ctcgggcgctcgggggcgggctctgcacagcgacgtcacgggcaccgtgcgctgcggaaagttcagccccgcccccgcttccccctcgctgtctccctcggcctgtgccgccgccgcagatgcagcaaataaaactcactcctgcgcaaacacgatgggagcccttccttcctccctccttgaacgagcgccgggggctggtatcccccgggaggcagcagctcgcccggtccttcgcgtcgaggtcaccaccccggaaaaacaggttggaccgaggtgctcagcgcatcccggccccgagagagaagctgtccgccccgcggccgtcggccccgggtctggtgctccgcggggaggaacggcggggaggtcgaggccgcccccacagagcgcctcgggcggatggggttgtttcctgggttccgcggccgc

SEQ ID NO: 312818 - DNA, 3106 bp, Homo sapiens
ctcgggcgctcgggggcgggctctgcacagcgacgtcacgggcaccgtgcgctgcggaaagttcagccccgcccccgcttccccctcgctgtctccctcggcctgtgccgccgccgacgccgcttgtgggcccgactccgctctgtctgcttcgccaccttctccccgagcactgcccggccggccgccatggctaacgtggctgacacgaagctgtacgacatcctgggcgtcccgcccggcgccagcgagaacgagctgaagaaggcatacagaaagttagccaaggaatatcatcctgataagaatccaaatgcaggagacaaatttaaagaaataagttttgcatatgaagtactatcaaatcctgagaagcgtgagttatatgacagatacggagagcaaggtcttcgggaaggcagcggcggaggtggtggcatggatgatattttctctcacatttttggtgggggattgttcggcttcatgggcaatcagagtagaagtcgaaatggcagaagaagaggagaggacatgatgcatccactcaaagtatctttagaagatctgtataatggcaagacaaccaaactacaacttagcaagaatgtgctctgtagtgcatgcagtggccaaggcggaaagtctggagctgtccaaaagtgtagtgcttgtcgaggtcgaggtgtgcgcatcatgatcagacagctggctccagggatggtacaacagatgcagtctgtgtgctctgattgtaatggagaaggagaggtaattaatgaaaaagaccgctgtaaaaaatgtgaagggaagaaggtgattaaagaagtcaagattcttgaagtccacgtagacaaaggcatgaaacatggacagagaattacattcactggggaagcagaccaggccccaggagtggaacccggagacattgttcttttgctacaggagaaagaacatgaggtatttcagagagatgggaatgatttgcacatgacatataaaataggacttgttgaagctctatgtggatttcagttcacatttaagcaccttgatggacgtcagattgtggtgaaatacccccctggcaaagtaattgaaccagggtgtgttcgtgtagttcgaggtgaagggatgccgcagtatcgtaatccctttgaaaaaggtgatctttacataaagtttgatgtgcagtttcctgaaaacaactggatcaacccagacaagctttctgaactagaagatcttctgccatctagaccggaagttcctaacataattggagaaacagaggaggtagagcttcaggaatttgatagcactcgaggctcaggaggtggtcagaggcgtgaagcctataatgatagctctgatgaagaaagcagcagccatcatggacctggagtgcagtgtgcccatcagtaaactctgcaaacaaattgcacaggtggattttctttccacatttgcctgatttgttctcagcaatccagctggagtgtcttatcaatccagatgaactgagggacatctgttggtctatgtataacttttaaaattggtatagtatctacagagtgtataatttaaactaaccacaaagctttacatcttcattttgactgttccatagcagaataaagcacttgaaaggaaacaagactccctttcacacatggattattataagtttcaatcctggtatctgtgcttgatttttatcagttttgtgtagatttttatgtttcatattttaaatttaaatcccacattgtaaagtttgtacaatttgtcctgaagctttgtgtttggctgcacctgcataagctgctacaaatagaataaagaatttcatagcctgtatctatcatttagatgcatggaaaaaaatgggctttgcacacaatgggtttggagctgactgggaacaatggaaaaaattacattagctgtggttgtaaagtttttttgtttttggttttgttttttttttcttttttcttttttttttttttaccatcttgtgaaaggtttctgaaactcgataataaaaagcggttggtgtaaattattcttttgtgtcacatttttagaaggaaaaacataaaagaatgtatccttagtactggttcttaaacagcccataaaaacccattggcctgaagcttatatctcaggcctatgcccatcttatagtcttggaagacaaaaggctggtagagacagtcttcagtggcttcagtgatgctctgtagaggccagggtgtcttgagtgctgtaactcccaagcactgggctagcctgacttctgtatctccctaccaccacccccttaaaaaaataaggtaacagcaaatctatagtaaaaccatgtctgcatagaacgtgttcaaatcctctgttttcattaaatgtaaaagatgctgtctccattaagttgaatatttggaattggagaagccattgattattattttgagtttctgtaatgttttatagaaaagtaagatgcttattcagaatttaagaatgaaggcaactgaaatatgcattgttgtagttatttatatttcaaactaaaaataagcaaaaaaaaaaggctggtttgagaaaaatcaggtaaaattgatgaaacggatgttgtgtttctctttccatcatctggtttttaccatttcactcagtaggtatttttagaacacacttatttgaggaaagagacatcagatgcacaattttacatttataaaggaacaaatggggaaaactgaaaactaaaaattttaaatgtattaaatgccatccctgagcctaaatctagtatttgtagtttatttctaggtctgctagaacctgaaaacctgaatgaaaaaaggtgtgctgacactaatcaagtcctgtgaggtttaaattattgacctatccactctacctccattgtacaaaaaatattttacaacaagcctgggtaagattcaacagcatagtagttttgtatccaaggttacttccccacaaccactttaaacataagaaatgtggtggcaatataaagtttgtagcctttccaataaaggtttataaaacagttaaaaagtgtagt

SEQ ID NO: 312819 - DNA, 2087 bp, Homo sapiens
  misc_feature (2069)..(2069): n is a, c, g, or t
ctcgggcgctcgggggcgggctctgcacagcgacgtcacgggcaccgtgcgctgcggaaagttcagccccgcccccgcttccccctcgctgtctccctcggcctgtgccgccgccgacgccgcttgtgggcccgactccgctctgtctgcttcgccaccttctccccgagcactgcccggccggccgccatggctaacgtggctgacacgaagctgtacgacatcctgggcgtcccgcccggcgccagcgagaacgagctgaagaaggcatacagaaagttagccaaggaatatcatcctgataagaatccaaatgcaggagacaaatttaaagaaataagttttgcatatgaagtactatcaaatcctgagaagcgtgagttatatgacagatacggagagcaaggtcttcgggaaggcagcggcggaggtggtggcatggatgatattttctctcacatttttggtgggggattgttcggcttcatgggcaatcagagtagaagtcgaaatggcagaagaagaggagaggacatgatgcatccactcaaagtatctttagaagatctgtataatggcaagacaaccaaactacaacttagcaagaatgtgctctgtagtgcatgcagtggccaaggcggaaagtctggagctgtccaaaagtgtagtgcttgtcgaggtcgaggtgtgcgcatcatgatcagacagctggctccagggatggtacaacagatgcagtctgtgtgctctgattgtaatggagaaggagaggtaattaatgaaaaagaccgctgtaaaaaatgtgaagggaagaaggtgattaaagaagtcaagattcttgaagtccacgtagacaaaggcatgaaacatggacagagaattacattcactggggaagcagaccaggccccaggagtggaacccggagacattgttcttttgctacaggagaaagaacatgaggtatttcagagagatgggaatgatttgcacatgacatataaaataggacttgttgaagctctatgtggatttcagttcacatttaagcaccttgatggacgtcagattgtggtgaaatacccccctggcaaagtaattgaaccagggtgtgttcgtgtagttcgaggtgaagggatgccgcagtatcgtaatccctttgaaaaaggtgatctttacataaagtttgatgtgcagtttcctgaaaacaactggatcaacccagacaagctttctgaactagaagatcttctgccatctagaccggaagttcctaacataattggagaaacagaggaggtagagcttcaggaatttgatagcactcgaggctcaggaggtggtcagaggcgtgaagcctataatgatagctctgatgaagaaagcagcagccatcatggacctggagtgcagtgtgcccatcagtaaactctgcaaacaaattgcacaggtggattttctttccacatttgcctgatttgttctcagcaatccagctggagtgtcttatcaatccagatgaactgagggacatctgttggtctatgtataacttttaaaattggtatagtatctacagagtgtataatttaaactaaccacaaagctttacatcttcattttgactgttccatagcagaataaagcacttgaaaggaaacaagactccctttcacacatggattattataagtttcaatcctggtatctgtgcttgatttttatcagttttgtgtagatttttatgtttcatattttaaatttaaatcccacattgtaaagtttgtacaatttgtcctgaagctttgtgtttggctgcacctgcataagctgctacaaatagaataaagaatttcatagcctgtatctatcatttagatgcatggaaaaaaatgggctttgcacacaatgggtttggagctgactgggaacaatggaaaaaattacattagctgtggttgtaaagtttttttgtttttggttttgttttttttttcttttttcttttttttttttttaccatcttgtgaaagggaagtcccggggaaccgagctcgaatccgaaatcngggccatagctgatcccg

SEQ ID NO: 312820 - DNA, 4149 bp, Homo sapiens
ctctgcgtccctcgcccattgacccggaggtagctgggtctgtgtttggatgcattgttctttgggcaggtaatgctaatgtcctgtacctgcttaggaataagccgtggtcccagccaaacgcctgagtgtacagtaaacataaatagaaggccttattattgctatttgcaatgctgcgatatctttcatctcaggatttcaaagcacacgaggcatttaagccccacagcatcctcaccaggctaagagcatccagatttgtaagccgagaaaaatgagaatgctccttaggcagtgagaagagtacagtggacttcctgttaccttaccggaaatgctagtctgtattatataattcacgagcctccgtgaatgaagatttaagtgctttaggacccaaacacctcgttgagagtgtgtgcaacttctctaccaccgaagttgccaccacgaccccagttaaccaccacgtgcaaataaaacaccaaaagacgctaactaggaccacctttactttttcatgatgttacagttagaaggaaggcgtgagccatcgggagcaggaattgtgactttagcttgatttatagtaatgttttgcagtccgcaaagcttaacagtcatttatctcgaatttattagggtcgtcttggtctggttacttggccatcaaagacacttgacaatagggaaaatatggataatgtttgaacgttttgtttttccctgtggcattgcttcattgttttatctggttttcacgtcactgtaacctgttttcaagtatagctgctgtctacttggttatattacattagtaaacagtatcgcgagaaagtgccgaagaatccctacgaatagaaaatatttttgaaaggttataactctagaacattacttctcagaaaagtggatattaagttattacaaaacttttaactggtgtttagttataaccttttttgtttttatccattttcaaaggcatacagaaagttagccaaggaatatcatcctgataagaatccaaatgcaggagacaaagtaagttatttgcaccttttttattccgggggttttagctttaacttaaattgccctccttgaaaaagaggaatgttgcaggaaaaaaatccaactatgcccacacagccacattttcataatgtcaagagtattttagttttagaataagagtactaccattctgaggagcggtgggtggtaaatagaaccagaatcaagtcaaaggtaacttgtccctttttttttttttttagaattaaatggattctggattcctgtagcttctccccactcttctacttgaaaatgcaattatttttatttttaccttttctttatagtttaaagaaataagttttgcatatgaagtactatcaaatcctgagaagcgtgagttatatgacagatacggagagcaaggtcttcgggaaggcagcggcggaggtggtggcatggatgatattttctctcacatttttggtgggggattgttcggcttcatgggcaatcagagtagaagtcgaaatggcagaagaagaggagaggacatgatgcatccactcaaagtatctttagaagatctgtataatggcaagacaaccaaactacaacttagcaagaatgtgctctgtagtgcatgcagtggccaaggcggaaagtctggagctgtccaaaagtgtagtgcttgtcgaggtcgaggtgtgcgcatcatgatcagacagctggctccagggatggtacaacagatgcagtctgtgtgctctgattgtaatggagaaggagaggtaattaatgaaaaagaccgctgtaaaaaatgtgaagggaagaaggtgattaaagaagtcaagattcttgaagtccacgtagacaaaggcatgaaacatggacagagaattacattcactggggaagcagaccaggccccaggagtggaacccggagacattgttcttttgctacaggagaaagaacatgaggtatttcagagagatgggaatgatttgcacatgacatataaaataggacttgttgaagctctatgtggatttcagttcacatttaagcaccttgatggacgtcagattgtggtgaaatacccccctggcaaagtaattgaaccagggtgtgttcgtgtagttcgaggtgaagggatgccgcagtatcgtaatccctttgaaaaaggtgatctttacataaagtttgatgtgcagtttcctgaaaacaactggatcaacccagacaagctttctgaactagaagatcttctgccatctagaccggaagttcctaacataattggagaaacagaggaggtagagcttcaggaatttgatagcactcgaggctcaggaggtggtcagaggcgtgaagcctataatgatagctctgatgaagaaagcagcagccatcatggacctggagtgcagtgtgcccatcagtaaactctgcaaacaaattgcacaggtggattttctttccacatttgcctgatttgttctcagcaatccagctggagtgtcttatcaatccagatgaactgagggacatctgttggtctatgtataacttttaaaattggtatagtatctacagagtgtataatttaaactaaccacaaagctttacatcttcattttgactgttccatagcagaataaagcacttgaaaggaaacaagactccctttcacacatggattattataagtttcaatcctggtatctgtgcttgatttttatcagttttgtgtagatttttatgtttcatattttaaatttaaatcccacattgtaaagtttgtacaatttgtcctgaagctttgtgtttggctgcacctgcataagctgctacaaatagaataaagaatttcatagcctgtatctatcatttagatgcatggaaaaaaatgggctttgcacacaatgggtttggagctgactgggaacaatggaaaaaattacattagctgtggttgtaaagtttttttgtttttggttttgttttttttttcttttttcttttttttttttttaccatcttgtgaaaggtttctgaaactcgataataaaaagcggttggtgtaaattattcttttgtgtcacatttttagaaggaaaaacataaaagaatgtatccttagtactggttcttaaacagcccataaaaacccattggcctgaagcttatatctcaggcctatgcccatcttatagtcttggaagacaaaaggctggtagagacagtcttcagtggcttcagtgatgctctgtagaggccagggtgtcttgagtgctgtaactcccaagcactgggctagcctgacttctgtatctccctaccaccacccccttaaaaaaataaggtaacagcaaatctatagtaaaaccatgtctgcatagaacgtgttcaaatcctctgttttcattaaatgtaaaagatgctgtctccattaagttgaatatttggaattggagaagccattgattattattttgagtttctgtaatgttttatagaaaagtaagatgcttattcagaatttaagaatgaaggcaactgaaatatgcattgttgtagttatttatatttcaaactaaaaataagcaaaaaaaaaaggctggtttgagaaaaatcaggtaaaattgatgaaacggatgttgtgtttctctttccatcatctggtttttaccatttcactcagtaggtatttttagaacacacttatttgaggaaagagacatcagatgcacaattttacatttataaaggaacaaatggggaaaactgaaaactaaaaattttaaatgtattaaatgccatccctgagcctaaatctagtatttgtagtttatttctaggtctgctagaacctgaaaacctgaatgaaaaaaggtgtgctgacactaatcaagtcctgtgaggtttaaattattgacctatccactctacctccattgtacaaaaaatattttacaacaagcctgggtaagattcaacagcatagtagttttgtatccaaggttacttccccacaaccactttaaacataagaaatgtggtggcaatataaagtttgtagcctttccaataaaggtttataaaacagttaaaaagtgtagt

SEQ ID NO: 312821 - DNA, 1910 bp, Homo sapiens
ctcgggcgctcgggggcgggctctgcacagcgacgtcacgggcaccgtgcgctgcggaaagttcagccccgcccccgcttccccctcgctgtctccctcggcctgtgccgccgccgacgccgcttgtgggcccgactccgctctgtctgcttcgccaccttctccccgagcactgcccggccggccgccatggctaacgtggctgacacgaagctgtacgacatcctgggcgtcccgcccggcgccagcgagaacgagctgaagaaggcatacagaaagttagccaaggaatatcatcctgataagaatccaaatgcaggagacaaatttaaagaaataagttttgcatatgaagtactatcaaatcctgagaagcgtgagttatatgacagatacggagagcaaggtcttcgggaaggcagcggcggaggtggtggcatggatgatattttctctcacatttttggtgggggattgttcggcttcatgggcaatcagagtagaagtcgaaatggcagaagaagaggagaggacatgatgcatccactcaaagtatctttagaagatctgtataatggcaagacaaccaaactacaacttagcaagaatgtgctctgtagtgcatgcagtggccaaggcggaaagtctggagctgtccaaaagtgtagtgcttgtcgaggtcgaggtgtgcgcatcatgatcagacagctggctccagggatggtacaacagatgcagtctgtgtgctctgattgtaatggagaaggagaggtaattaatgaaaaagaccgctgtaaaaaatgtgaagggaagaaggtgattaaagaagtcaagattcttgaagtccacgtagacaaaggcatgaaacatggacagagaattacattcactggggaagcagaccaggccccaggagtggaacccggagacattgttcttttgctacaggagaaagaacatgaggtatttcagagagatgggaatgatttgcacatgacatataaaataggacttgttgaagctctatgtggatttcagttcacatttaagcaccttgatggacgtcagattgtggtgaaatacccccctggcaaagtaattgaaccagggtgtgttcgtgtagttcgaggtgaagggatgccgcagtatcgtaatccctttgaaaaaggtgatctttacataaagtttgatgtgcagtttcctgaaaacaactggatcaacccagacaagctttctgaactagaagatcttctgccatctagaccggaagttcctaacataattggagaaacagaggaggtagagcttcaggaatttgatagcactcgaggctcaggaggtggtcagaggcgtgaagcctataatgatagctctgatgaagaaagcagcagccatcatggacctggagtgcagtgtgcccatcagtaaactctgcaaacaaattgcacaggtggattttctttccacatttgcctgatttgttctcagcaatccagctggagtgtcttatcaatccagatgaactgagggacatctgttggtctatgtataacttttaaaattggtatagtatctacagagtgtataatttaaactaaccacaaagctttacatcttcattttgactgttccatagcagaataaagcacttgaaaggaaacaagactccctttcacacatggattattataagtttcaatcctggtatctgtgcttgatttttatcagttttgtgtagatttttatgtttcatattttaaatttaaatcccacattgtaaagtttgtacaatttgtcctgaagctttgtgtttggctgcacctgcataagctgctacagatttaaagaaataagttttgcatatgaagtactatcaatcctgagaagcgtgagttatatgccactacagc

SEQ ID NO: 312822 - DNA, 3131 bp, Homo sapiens
acacaaaacacaaatagtcaagtcgagccgatgttaatcggcacagggcgcgcgacgccgcttgtgggcccgactccgctctgtctgcttcgccaccttctccccgagcactgcccggccggccgccatggctaacgtggctgacacgaagctgtacgacatcctgggcgtcccgcccggcgccagcgagaacgagctgaagaaggcatacagaaagttagccaaggaatatcatcctgataagaatccaaatgcaggagacaaaaattaaatggattctggattcctgtagcttctccccactcttctacttgaaaatgcaattatttttatttttaccttttctttatagtttaaagaaataagttttgcatatgaagtactatcaaatcctgagaagcgtgagttatatgacagatacggagagcaaggtcttcgggaaggcagcggcggaggtggtggcatggatgatattttctctcacatttttggtgggggattgttcggcttcatgggcaatcagagtagaagtcgaaatggcagaagaagaggagaggacatgatgcatccactcaaagtatctttagaagatctgtataatggcaagacaaccaaactacaacttagcaagaatgtgctctgtagtgcatgcagtggccaaggcggaaagtctggagctgtccaaaagtgtagtgcttgtcgaggtcgaggtgtgcgcatcatgatcagacagctggctccagggatggtacaacagatgcagtctgtgtgctctgattgtaatggagaaggagaggtaattaatgaaaaagaccgctgtaaaaaatgtgaagggaagaaggtgattaaagaagtcaagattcttgaagtccacgtagacaaaggcatgaaacatggacagagaattacattcactggggaagcagaccaggccccaggagtggaacccggagacattgttcttttgctacaggagaaagaacatgaggtatttcagagagatgggaatgatttgcacatgacatataaaataggacttgttgaagctctatgtggatttcagttcacatttaagcaccttgatggacgtcagattgtggtgaaatacccccctggcaaagtaattgaaccagggtgtgttcgtgtagttcgaggtgaagggatgccgcagtatcgtaatccctttgaaaaaggtgatctttacataaagtttgatgtgcagtttcctgaaaacaactggatcaacccagacaagctttctgaactagaagatcttctgccatctagaccggaagttcctaacataattggagaaacagaggaggtagagcttcaggaatttgatagcactcgaggctcaggaggtggtcagaggcgtgaagcctataatgatagctctgatgaagaaagcagcagccatcatggacctggagtgcagtgtgcccatcagtaaactctgcaaacaaattgcacaggtggattttctttccacatttgcctgatttgttctcagcaatccagctggagtgtcttatcaatccagatgaactgagggacatctgttggtctatgtataacttttaaaattggtatagtatctacagagtgtataatttaaactaaccacaaagctttacatcttcattttgactgttccatagcagaataaagcacttgaaaggaaacaagactccctttcacacatggattattataagtttcaatcctggtatctgtgcttgatttttatcagttttgtgtagatttttatgtttcatattttaaatttaaatcccacattgtaaagtttgtacaatttgtcctgaagctttgtgtttggctgcacctgcataagctgctacaaatagaataaagaatttcatagcctgtatctatcatttagatgcatggaaaaaaatgggctttgcacacaatgggtttggagctgactgggaacaatggaaaaaattacattagctgtggttgtaaagtttttttgtttttggttttgttttttttttcttttttcttttttttttttttaccatcttgtgaaaggtttctgaaactcgataataaaaagcggttggtgtaaattattcttttgtgtcacatttttagaaggaaaaacataaaagaatgtatccttagtactggttcttaaacagcccataaaaacccattggcctgaagcttatatctcaggcctatgcccatcttatagtcttggaagacaaaaggctggtagagacagtcttcagtggcttcagtgatgctctgtagaggccagggtgtcttgagtgctgtaactcccaagcactgggctagcctgacttctgtatctccctaccaccacccccttaaaaaaataaggtaacagcaaatctatagtaaaaccatgtctgcatagaacgtgttcaaatcctctgttttcattaaatgtaaaagatgctgtctccattaagttgaatatttggaattggagaagccattgattattattttgagtttctgtaatgttttatagaaaagtaagatgcttattcagaatttaagaatgaaggcaactgaaatatgcattgttgtagttatttatatttcaaactaaaaataagcaaaaaaaaaaggctggtttgagaaaaatcaggtaaaattgatgaaacggatgttgtgtttctctttccatcatctggtttttaccatttcactcagtaggtatttttagaacacacttatttgaggaaagagacatcagatgcacaattttacatttataaaggaacaaatggggaaaactgaaaactaaaaattttaaatgtattaaatgccatccctgagcctaaatctagtatttgtagtttatttctaggtctgctagaacctgaaaacctgaatgaaaaaaggtgtgctgacactaatcaagtcctgtgaggtttaaattattgacctatccactctacctccattgtacaaaaaatattttacaacaagcctgggtaagattcaacagcatagtagttttgtatccaaggttacttccccacaaccactttaaacataagaaatgtggtggcaatataaagtttgtagcctttccaataaaggtttataaaacagttaaaaagtgtagt

SEQ ID NO: 312823 - DNA, 1723 bp, Homo sapiens
ctcgggcgctcgggggcgggctctgcacagcgacgtcacgggcaccgtgcgctgcggaaagttcagccccgcccccgcttccccctcgctgtctccctcggcctgtgccgccgccgacgccgcttgtgggcccgactccgctctgtctgcttcgccaccttctccccgagcactgcccggccggccgccatggctaacgtggctgacacgaagctgtacgacatcctgggcgtcccgcccggcgccagcgagaacgagctgaagaaggcatacagaaagttagccaaggaatatcatcctgataagaatccaaatgcaggagacaaatttaaagaaataagttttgcatatgaagtactatcaaatcctgagaagcgtgagttatatgacagatacggagagcaaggtcttcgggaaggcagcggcggaggtggtggcatggatgatattttctctcacatttttggtgggggattgttcggcttcatgggcaatcagagtagaagtcgaaatggcagaagaagaggagaggacatgatgcatccactcaaagtatctttagaagatctgtataatggcaagacaaccaaactacaacttagcaagaatgtgctctgtagtgcatgcagtggccaaggcggaaagtctggagctgtccaaaagtgtagtgcttgtcgaggtcgaggtgtgcgcatcatgatcagacagctggctccagggatggtacaacagatgcagtctgtgtgctctgattgtaatggagaaggagaggtaattaatgaaaaagaccgctgtaaaaaatgtgaagggaagaaggtgattaaagaagtcaagattcttgaagtccacgtagacaaaggcatgaaacatggacagagaattacattcactggggaagcagaccaggccccaggagtggaacccggagacattgttcttttgctacaggagaaagaacatgaggtatttcagagagatgggaatgatttgcacatgacatataaaataggacttgttgaagctctatgtggatttcagttcacatttaagcaccttgatggacgtcagattgtggtgaaatacccccctggcaaagtaattgaaccagggtgtgttcgtgtagttcgaggtgaagggatgccgcagtatcgtaatccctttgaaaaaggtgatctttacataaagtttgatgtgcagtttcctgaaaacaactggatcaacccagacaagctttctgaactagaagatcttctgccatctagaccggaagttcctaacataattggagaaacagaggaggtagagcttcaggaatttgatagcactcgaggctcaggaggtggtcagaggcgtgaagcctataatgatagctctgatgaagaaagcagcagccatcatggacctggagtgcagtgtgcccatcagtaaactctgcaaacaaattgcacagtttatttctaggtctgctagaacctgaaaacctgaatgaaaaaaggtgtgctgacactaatcaagtcctgtgaggtttaaattattgacctatccactctacctccattgtacaaaaaatattttacaacaagcctgggtaagattcaacagcatagtagttttgtatccaaggttacttccccacaaccactttaaacataagaaatgtggtggcaatataaagtttgtagcctttccaataaaggtttataaaacagttaaaaagtgtagt

SEQ ID NO: 312824 - DNA, 1396 bp, Homo sapiens
ctcgggcgctcgggggcgggctctgcacagcgacgtcacgggcaccgtgcgctgcggaaagttcagccccgcccccgcttccccctcgctgtctccctcggcctgtgccgccgccgacgccgcttgtgggcccgactccgctctgtctgcttcgccaccttctccccgagcactgcccggccggccgccatggctaacgtggctgacacgaagctgtacgacatcctgggcgtcccgcccggcgccagcgagaacgagctgaagaaggcatacagaaagttagccaaggaatatcatcctgataagaatccaaatgcaggagacaaatttaaagaaataagttttgcatatgaagtactatcaaatcctgagaagcgtgagttatatgacagatacggagagcaaggtcttcgggaaggcagcggcggaggtggtggcatggatgatattttctctcacatttttggtgggggattgttcggcttcatgggcaatcagagtagaagtcgaaatggcagaagaagaggagaggacatgatgcatccactcaaagtatctttagaagatctgtataatggcaagacaaccaaactacaacttagcaagaatgtgctctgtagtgcatgcagtggccaaggcggaaagtctggagctgtccaaaagtgtagtgcttgtcgaggtcgaggtgtgcgcatcatgatcagacagctggctccagggatggtacaacagatgcagtctgtgtgctctgattgtaatggagaaggagaggtaattaatgaaaaagaccgctgtaaaaaatgtgaagggaagaaggtgattaaagaagtcaagattcttgaagtccacgtagacaaaggcatgaaacatggacagagaattacattcactggggaagcagaccaggccccaggagtggaacccggagacattgttcttttgctacaggagaaagaacatgaggtatttcagagagatgggaatgatttgcacatgacatataaaataggacttgttgaagctctatgtggatttcagttcacatttaagcaccttgatggacgtcagattgtggtgaaatacccccctggcaaagtaattgaaccagggtgtgttcgtgtagttcgaggtgaagggatgccgcagtatcgtaatccctttgaaaaaggtgatctttacataaagtttgatgtgcagtttcctgaaaacaactggatcaacccagacaagctttctgaattagaagatttctgcatctaggcggaaggtcctactattgggcaacaggggggtaagtccggattgtgcctcgggccggggggcaagggagcaaagatgcgagaaaaaggaggcccaggcggggggcctgacgccaagtcgggtttcctggtgtccc

SEQ ID NO: 312825 - DNA, 1148 bp, Homo sapiens
ctcgggcgctcgggggcgggctctgcacagcgacgtcacgggcaccgtgcgctgcggaaagttcagccccgcccccgcttccccctcgctgtctccctcggcctgtgccgccgccgacgccgcttgtgggcccgactccgctctgtctgcttcgccaccttctccccgagcactgcccggccggccgccatggctaacgtggctgacacgaagctgtacgacatcctgggcgtcccgcccggcgccagcgagaacgagctgaagaaggcatacagaaagttagccaaggaatatcatcctgataagaatccaaatgcaggagacaaatttaaagaaataagttttgcatatgaagtactatcaaatcctgagaagcgtgagttatatgacagatacggagagcaaggtcttcgggaaggcagcggcggaggtggtggcatggatgatattttctctcacatttttggtgggggattgttcggcttcatgggcaatcagagtagaagtcgaaatggcagaagaagaggagaggacatgatgcatccactcaaagtatctttagaagatctgtataatggcaagacaaccaaactacaacttagcaagaatgtgctctgtagtgcatgcagtggccaaggcggaaagtctggagctgtccaaaagtgtagtgcttgtcgaggtcgaggtgtgcgcatcatgatcagacagctggctccagggatggtacaacagatgcagtctgtgtgctctgattgtaatggagaaggtatgtgtgccagtacttctctgcttttatgttggaatggattgggaatgcagatattggagaggtttacaattttttatttcaaagggtatttgtatacatcttattaaagaaaaaggaggccgggtgcgttagctcattcctataattccagcactttgggagacagaggtggattgctcgagcccaggagtttgaggccagcttgggcaatatagggagacctcattactataggaaaaaaaagtgtggaaaaatatgtaatgaggggctcaggtaattctcctgccccagcctcccaaagggctgggattacaggtgttagccaccactcttggcctgcttttattttattataattgctaactcccactatcaagaa

SEQ ID NO: 312826 - DNA, 896 bp, Homo sapiens
caaatgaaccaactgattctcacaaccgaagggagaattgacacctcccattgagggtgtcttgagtgctgtaactcccaagcactgggctagcctgacttctgtatctccctaccaccacccccttaaaaaaataaggtaacagcaaatctatagtaaaaccatgtctgcatagaacgtgttcaaatcctctgttttcattaaatgtaaaagatgctgtctccattaagttgaatatttggaattggagaagccattgattattattttgagtttctgtaatgttttatagaaaagtaagatgcttattcagaatttaagaatgaaggcaactgaaatatgcattgttgtagttatttatatttcaaactaaaaataagcaaaaaaaaaaggctggtttgagaaaaatcaggtaaaattgatgaaacggatgttgtgtttctctttccatcatctggtttttaccatttcactcagtaggtatttttagaacacacttatttgaggaaagagacatcagatgcacaattttacatttataaaggaacaaatggggaaaactgaaaactaaaaattttaaatgtattaaatgccatccctgagcctaaatctagtatttgtagtttatttctaggtctgctagaacctgaaaacctgaatgaaaaaaggtgtgctgacactaatcaagtcctgtgaggtttaaattattgacctatccactctacctccattgtacaaaaaatattttacaacaagcctgggtaagattcaacagcatagtagttttgtatccaaggttacttccccacaaccactttaaacataagaaatgtggtggcaatataaagtttgtagcctttccaataaaggtttataaaacagttaaaaagtgtagt

SEQ ID NO: 312827 - DNA, 573 bp, Homo sapiens
ctcgggcgctcgggggcgggctctgcacagcgacgtcacgggcaccgtgcgctgcggaaagttcagccccgcccccgcttccccctcgctgtctccctcggcctgtgccgccgccgacgccgcttgtgggcccgactccgctctgtctgcttcgccaccttctccccgagcactgcccggccggccgccatggctaacgtggctgacacgaagctgtacgacatcctgggcgtcccgcccggcgccagcgagaacgagctgaagaaggcatacagaaagttagccaaggaatatcatcctgataagaatccaaatgcaggagacaaatttaaagaaataagttttgcatatgaagtactatcaaatcctgagaagcgtgagttatatgacagatacggagagcaaggtcttcgggaaggcagcggcggaggtggtggcatggatgatattttctctcacatttttggtgggggattgttcggcttcatgggcaatcagagtagaagtcgatggcacacagagcactcgcgcatgccgcactcactcgcccccaccagccgtccgcccacgccc

SEQ ID NO: 312828 - DNA, 482 bp, Homo sapiens
cagggatgtcttcttcagccaggccgcgctactgggctgcccgcgagccggcgcccggccgtgactggcccgggctgggagtcggcggcggcggcgggaccggcctcgccgcgagccgcgcactccggcctcggctgaccttggggccgccggccccgcccgcccgcagatgcagcaaataaaactcactcctgcgcaaacacgatgggagcccttccttcctccctccttgaacgagcgccgggggctggtatcccccgggaggcagcagctcgcccggtccttcgcgtcgaggtcaccaccccggaaaaacaggttggaccgaggtgctcagcgcatcccggccccgagagagaagctgtccgccccgcggccgtcggccccgggtctggtgctccgcggggaggaacggcggggaggtcgaggccgcccccacagagcgcctcgggcggatggggttgtttcctgggttccgcggccgc

SEQ ID NO: 312829 - DNA, 2009 bp, Homo sapiens
acacaaaacacaaatagtcaagtcgagccgatgttaatcggcacagggcgcgcgacgccgcttgtgggcccgactccgctctgtctgcttcgccaccttctccccgagcactgcccggccggccgccatggctaacgtggctgacacgaagctgtacgacatcctgggcgtcccgcccggcgccagcgagaacgagctgaagaaggcatacagaaagttagccaaggaatatcatcctgataagaatccaaatgcaggagacaaatttaaagaaataagttttgcatatgaagtactatcaaatcctgagaagcgtgagttatatgacagatacggagagcaaggtcttcgggaaggcagcggcggaggtggtggcatggatgatattttctctcacatttttggtgggggattgttcggcttcatgggcaatcagagtagaagtcgaaatggcagaagaagaggagaggacatgatgcatccactcaaagtatctttagaagatctgtataatggcaagacaaccaaactacaacttagcaagaatgtgctctgtagtgcatgcagtggccaaggcggaaagtctggagctgtccaaaagtgtagtgcttgtcgaggtcgaggtgtgcgcatcatgatcagacagctggctccagggatggtacaacagatgcagtctgtgtgctctgattgtaatggagaaggagaggtaattaatgaaaaagaccgctgtaaaaaatgtgaagggaagaaggtgattaaagaagtcaagattcttgaagtccacgtagacaaaggcatgaaacatggacagagaattacattcactggggaagcagaccaggccccaggagtggaacccggagacattgttcttttgctacaggagaaagaacatgaggtatttcagagagatgggaatgatttgcacatgacatataaaataggacttgttgaagctctatgtggatttcagttcacatttaagcaccttgatggacgtcagattgtggtgaaatacccccctggcaaagtaattgaaccagggtgtgttcgtgtagttcgaggtgaagggatgccgcagtatcgtaatccctttgaaaaaggtgatctttacataaagtttgatgtgcagtttcctgaaaacaactggatcaacccagacaagctttctgaactagaagatcttctgccatctagaccggaagttcctaacataattggagaaacagaggaggtagagcttcaggaatttgatagcactcgaggctcaggaggtggtcagaggcgtgaagcctataatgatagctctgatgaagaaagcagcagccatcatggacctggagtgcagtgtgcccatcagtaaactctgcaaacaaattgcacaggtggattttctttccacatttgcctgatttgttctcagcaatccagctggagtgtcttatcaatccagatgaactgagggacatctgttggtctatgtataacttttaaaattggtatagtatctacagagtgtataatttaaactaaccacaaagctttacatcttcattttgactgttccatagcagaataaagcacttgaaaggaaacaagactccctttcacacatggattattataagtttcaatcctggtatctgtgcttgatttttatcagttttgtgtagatttttatgtttcatattttaaatttaaatcccacattgtaaagtttgtacaatttgtcctgaagctttgtgtttggctgcacctgcataagctgctacaaatagaataaagaatttcatagcctgtatctatcatttagatgcatggaaaaaaatgggctttgcacacaatgggtttggagctgactgggaacaatggaaaaaattacattagctgtggttgtaaagtttttttgtttttggttttgttttttttttcttttttcttttttttttttttaccatcttgtgaaaggtttctgaaactcgataataaaaagcggttggtgtaaa

SEQ ID NO: 312830 - DNA, 1866 bp, Homo sapiens
ctcgggcgctcgggggcgggctctgcacagcgacgtcacgggcaccgtgcgctgcggaaagttcagccccgcccccgcttccccctcgctgtctccctcggcctgtgccgccgccgacgccgcttgtgggcccgactccgctctgtctgcttcgccaccttctccccgagcactgcccggccggccgccatggctaacgtggctgacacgaagctgtacgacatcctgggcgtcccgcccggcgccagcgagaacgagctgaagaaggcatacagaaagttagccaaggaatatcatcctgataagaatccaaatgcaggagacaaatttaaagaaataagttttgcatatgaagtactatcaaatcctgagaagcgtgagttatatgacagatacggagagcaaggtcttcgggaaggcagcggcggaggtggtggcatggatgatattttctctcacatttttggtgggggattgttcggcttcatgggcaatcagagtagaagtcgaaatggcagaagaagaggagaggacatgatgcatccactcaaagtatctttagaagatctgtataatggcaagacaaccaaactacaacttagcaagaatgtgctctgtagtgcatgcagtggccaaggcggaaagtctggagctgtccaaaagtgtagtgcttgtcgaggtcgaggtgtgcgcatcatgatcagacagctggctccagggatggtacaacagatgcagtctgtgtgctctgattgtaatggagaaggagaggtaattaatgaaaaagaccgctgtaaaaaatgtgaagggaagaaggtgattaaagaagtcaagattcttgaagtccacgtagacaaaggcatgaaacatggacagagaattacattcactggggaagcagaccaggccccaggagtggaacccggagacattgttcttttgctacaggagaaagaacatgaggtatttcagagagatgggaatgatttgcacatgacatataaaataggacttgttgaagctctatgtggatttcagttcacatttaagcaccttgatggacgtcagattgtggtgaaatacccccctggcaaagtaattgaaccagggtgtgttcgtgtagttcgaggtgaagggatgccgcagtatcgtaatccctttgaaaaaggtgatctttacataaagtttgatgtgcagtttcctgaaaacaactggatcaacccagacaagctttctgaactagaagatcttctgccatctagaccggaagttcctaacataattggagaaacagaggaggtagagcttcaggaatttgatagcactcgaggctcaggaggtggtcagaggcgtgaagcctataatgatagctctgatgaagaaagcagcagccatcatggacctggagtgcagtgtgcccatcagtaaactctgcaaacaaattgcacaggtggattttctttccacatttgcctgatttgttctcagcaatccagctggagtgtcttatcaatccagatgaactgagggacatctgttggtctatgtataacttttaaaattggtatagtatctacagagtgtataatttaaactaaccacaaagctttacatcttcattttgactgttccatagcagaataaagcacttgaaaggaaacaagactccctttcacacatggattattataagtttcaatcctggtatctgtgcttgatttttatcagttttgtgtagatttttatgtttcatattttaaatttaaatcccacattgtaaagtttgtacaatttgtcctgaagctttgtgtttggctgcacctgcataagctgctacaaatagaataaagaatttcatagcctgta

SEQ ID NO: 312831 - DNA, 4091 bp, Homo sapiens
ggcaggtaatggtaaagtcctggaactgcatcggagaaagacggaggtcacagccaaagagaaatgtgtaggatagtaggaagacatgaaggaggtctaataatactaattggcaaagagagcaaatgtttcatctcaggatttcaaagcacacgaggcatttaagccccacagcatcctcaccaggctaagagcatccagatttgtaagccgagaaaaatgagaatgctccttaggcagtgagaagagtacagtggacttcctgttaccttaccggaaatgctagtctgtattatataattcacgagcctccgtgaatgaagatttaagtgctttaggacccaaacacctcgttgagagtgtgtgcaacttctctaccaccgaagttgccaccacgaccccagttaaccaccacgtgcaaataaaacaccaaaagacgctaactaggaccacctttactttttcatgatgttacagttagaaggaaggcgtgagccatcgggagcaggaattgtgactttagcttgatttatagtaatgttttgcagtccgcaaagcttaacagtcatttatctcgaatttattagggtcgtcttggtctggttacttggccatcaaagacacttgacaatagggaaaatatggataatgtttgaacgttttgtttttccctgtggcattgcttcattgttttatctggttttcacgtcactgtaacctgttttcaagtatagctgctgtctacttggttatattacattagtaaacagtatcgcgagaaagtgccgaagaatccctacgaatagaaaatatttttgaaaggttataactctagaacattacttctcagaaaagtggatattaagttattacaaaacttttaactggtgtttagttataaccttttttgtttttatccattttcaaaggcatacagaaagttagccaaggaatatcatcctgataagaatccaaatgcaggagacaaagtaagttatttgcaccttttttattccgggggttttagctttaacttaaattgccctccttgaaaaagaggaatgttgcaggaaaaaaatccaactatgcccacacagccacattttcataatgtcaagagtattttagttttagaataagagtactaccattctgaggagcggtgggtggtaaatagaaccagaatcaagtcaaaggtaacttgtccctttttttttttttttagaattaaatggattctggattcctgtagcttctccccactcttctacttgaaaatgcaattatttttatttttaccttttctttatagtttaaagaaataagttttgcatatgaagtactatcaaatcctgagaagcgtgagttatatgacagatacggagagcaaggtcttcgggaaggcagcggcggaggtggtggcatggatgatattttctctcacatttttggtgggggattgttcggcttcatgggcaatcagagtagaagtcgaaatggcagaagaagaggagaggacatgatgcatccactcaaagtatctttagaagatctgtataatggcaagacaaccaaactacaacttagcaagaatgtgctctgtagtgcatgcagtggccaaggcggaaagtctggagctgtccaaaagtgtagtgcttgtcgaggtcgaggtgtgcgcatcatgatcagacagctggctccagggatggtacaacagatgcagtctgtgtgctctgattgtaatggagaaggagaggtaattaatgaaaaagaccgctgtaaaaaatgtgaagggaagaaggtgattaaagaagtcaagattcttgaagtccacgtagacaaaggcatgaaacatggacagagaattacattcactggggaagcagaccaggccccaggagtggaacccggagacattgttcttttgctacaggagaaagaacatgaggtatttcagagagatgggaatgatttgcacatgacatataaaataggacttgttgaagctctatgtggatttcagttcacatttaagcaccttgatggacgtcagattgtggtgaaatacccccctggcaaagtaattgaaccagggtgtgttcgtgtagttcgaggtgaagggatgccgcagtatcgtaatccctttgaaaaaggtgatctttacataaagtttgatgtgcagtttcctgaaaacaactggatcaacccagacaagctttctgaactagaagatcttctgccatctagaccggaagttcctaacataattggagaaacagaggaggtagagcttcaggaatttgatagcactcgaggctcaggaggtggtcagaggcgtgaagcctataatgatagctctgatgaagaaagcagcagccatcatggacctggagtgcagtgtgcccatcagtaaactctgcaaacaaattgcacaggtggattttctttccacatttgcctgatttgttctcagcaatccagctggagtgtcttatcaatccagatgaactgagggacatctgttggtctatgtataacttttaaaattggtatagtatctacagagtgtataatttaaactaaccacaaagctttacatcttcattttgactgttccatagcagaataaagcacttgaaaggaaacaagactccctttcacacatggattattataagtttcaatcctggtatctgtgcttgatttttatcagttttgtgtagatttttatgtttcatattttaaatttaaatcccacattgtaaagtttgtacaatttgtcctgaagctttgtgtttggctgcacctgcataagctgctacaaatagaataaagaatttcatagcctgtatctatcatttagatgcatggaaaaaaatgggctttgcacacaatgggtttggagctgactgggaacaatggaaaaaattacattagctgtggttgtaaagtttttttgtttttggttttgttttttttttcttttttcttttttttttttttaccatcttgtgaaaggtttctgaaactcgataataaaaagcggttggtgtaaattattcttttgtgtcacatttttagaaggaaaaacataaaagaatgtatccttagtactggttcttaaacagcccataaaaacccattggcctgaagcttatatctcaggcctatgcccatcttatagtcttggaagacaaaaggctggtagagacagtcttcagtggcttcagtgatgctctgtagaggccagggtgtcttgagtgctgtaactcccaagcactgggctagcctgacttctgtatctccctaccaccacccccttaaaaaaataaggtaacagcaaatctatagtaaaaccatgtctgcatagaacgtgttcaaatcctctgttttcattaaatgtaaaagatgctgtctccattaagttgaatatttggaattggagaagccattgattattattttgagtttctgtaatgttttatagaaaagtaagatgcttattcagaatttaagaatgaaggcaactgaaatatgcattgttgtagttatttatatttcaaactaaaaataagcaaaaaaaaaaggctggtttgagaaaaatcaggtaaaattgatgaaacggatgttgtgtttctctttccatcatctggtttttaccatttcactcagtaggtatttttagaacacacttatttgaggaaagagacatcagatgcacaattttacatttataaaggaacaaatggggaaaactgaaaactaaaaattttaaatgtattaaatgccatccctgagcctaaatctagtatttgtagtttatttctaggtctgctagaacctgaaaacctgaatgaaaaaaggtgtgctgacactaatcaagtcctgtgaggtttaaattattgacctatccactctacctccattgtacaaaaaatattttacaacaagcctgggtaagattcaacagcatagtagttttgtatccaaggttacttccccacaaccactttaaacataagaaatgtggtggcaatataaagtttgtagcctttccaataaaggtttataaaacagttaaaaagtgtagt

SEQ ID NO: 312832 - DNA, 2437 bp, Homo sapiens
ggcacgagctccttctccattacaatcagagcacacagactgcatctgttgtaccatccctggagccagctgtctgatcatgattgtaatggagaaggagaggtaattaatgaaaaagaccgctgtaaaaaatgtgaagggaagaaggtgattaaagaagtcaagattcttgaagtccacgtagacaaaggcatgaaacatggacagagaattacattcactggggaagcagaccaggccccaggagtggaacccggagacattgttcttttgctacaggagaaagaacatgaggtatttcagagagatgggaatgatttgcacatgacatataaaataggacttgttgaagctctatgtggatttcagttcacatttaagcaccttgatggacgtcagattgtggtgaaatacccccctggcaaagtaattgaaccagggtgtgttcgtgtagttcgaggtgaagggatgccgcagtatcgtaatccctttgaaaaaggtgatctttacataaagtttgatgtgcagtttcctgaaaacaactggatcaacccagacaagctttctgaactagaagatcttctgccatctagaccggaagttcctaacataattggagaaacagaggaggtagagcttcaggaatttgatagcactcgaggctcaggaggtggtcagaggcgtgaagcctataatgatagctctgatgaagaaagcagcagccatcatggacctggagtgcagtgtgcccatcagtaaactctgcaaacaaattgcacaggtggattttctttccacatttgcctgatttgttctcagcaatccagctggagtgtcttatcaatccagatgaactgagggacatctgttggtctatgtataacttttaaaattggtatagtatctacagagtgtataatttaaactaaccacaaagctttacatcttcattttgactgttccatagcagaataaagcacttgaaaggaaacaagactccctttcacacatggattattataagtttcaatcctggtatctgtgcttgatttttatcagttttgtgtagatttttatgtttcatattttaaatttaaatcccacattgtaaagtttgtacaatttgtcctgaagctttgtgtttggctgcacctgcataagctgctacaaatagaataaagaatttcatagcctgtatctatcatttagatgcatggaaaaaaatgggctttgcacacaatgggtttggagctgactgggaacaatggaaaaaattacattagctgtggttgtaaagtttttttgtttttggttttgttttttttttcttttttcttttttttttttttaccatcttgtgaaaggtttctgaaactcgataataaaaagcggttggtgtaaattattcttttgtgtcacatttttagaaggaaaaacataaaagaatgtatccttagtactggttcttaaacagcccataaaaacccattggcctgaagcttatatctcaggcctatgcccatcttatagtcttggaagacaaaaggctggtagagacagtcttcagtggcttcagtgatgctctgtagaggccagggtgtcttgagtgctgtaactcccaagcactgggctagcctgacttctgtatctccctaccaccacccccttaaaaaaataaggtaacagcaaatctatagtaaaaccatgtctgcatagaacgtgttcaaatcctctgttttcattaaatgtaaaagatgctgtctccattaagttgaatatttggaattggagaagccattgattattattttgagtttctgtaatgttttatagaaaagtaagatgcttattcagaatttaagaatgaaggcaactgaaatatgcattgttgtagttatttatatttcaaactaaaaataagcaaaaaaaaaaggctggtttgagaaaaatcaggtaaaattgatgaaacggatgttgtgtttctctttccatcatctggtttttaccatttcactcagtaggtatttttagaacacacttatttgaggaaagagacatcagatgcacaattttacatttataaaggaacaaatggggaaaactgaaaactaaaaattttaaatgtattaaatgccatccctgagcctaaatctagtatttgtagtttatttctaggtctgctagaacctgaaaacctgaatgaaaaaaggtgtgctgacactaatcaagtcctgtgaggtttaaattattgacctatccactctacctccattgtacaaaaaatattttacaacaagcctgggtaagattcaacagcatagtagttttgtatccaaggttacttccccacaaccactttaaacataagaaatgtggtggcaatataaagtttgtagcctttccaataaaggtttataaaacagttaaaaagtgtagt

SEQ ID NO: 312833 - DNA, 1384 bp, Homo sapiens
ctcgggcgctcgggggcgggctctgcacagcgacgtcacgggcaccgtgcgctgcggaaagttcagccccgcccccgcttccccctcgctgtctccctcggcctgtgccgccgccgacgccgcttgtgggcccgactccgctctgtctgcttcgccaccttctccccgagcactgcccggccggccgccatggctaacgtggctgacacgaagctgtacgacatcctgggcgtcccgcccggcgccagcgagaacgagctgaagaaggcatacagaaagttagccaaggaatatcatcctgataagaatccaaatgcaggagacaaatttaaagaaataagttttgcatatgaagtactatcaaatcctgagaagcgtgagttatatgacagatacggagagcaaggtcttcgggaaggcagcggcggaggtggtggcatggatgatattttctctcacatttttggtgggggattgttcggcttcatgggcaatcagagtagaagtcgaaatggcagaagaagaggagaggacatgatgcatccactcaaagtatctttagaagatctgtataatggcaagacaaccaaactacaacttagcaagaatgtgctctgtagtgcatgcagtggccaaggcggaaagtctggagctgtccaaaagtgtagtgcttgtcgaggtcgaggtgtgcgcatcatgatcagacagctggctccagggatggtacaacagatgcagtctgtgtgctctgattgtaatggagaaggagaggtaattaatgaaaaagaccgctgtaaaaaatgtgaagggaagaaggtgattaaagaagtcaagattcttgaagtccacgtagacaaaggcatgaaacatggacagagaattacattcactggggaagcagaccaggccccaggagtggaacccggagacattgttcttttgctacaggagaaagaacatgaggtatttcagagagatgggaatgatttgcacatgacatataaaataggacttgttgaagctctatgtggatttcagttcacatttaagcaccttgatggacgtcagattgtggtgaaatacccccctggcaaagtaattgaaccagggtgtgttcgtgtagttcgaggtgaagggatgccgcagtatcgtaatccctttgaaaaaggtgatctttacataaagtttgatgtgcagtttcctgaaaacaactggatcaacccagacaagctttctgaactagaagatcttctgccatctagaccggaagttcctaacataattggagaaacagaggaggtagagcttcaggaatttgatggctgctgctttcttcatcagagctatcattgatagcttcacgcctctgaccacctcctgtcga

SEQ ID NO: 312834 - DNA, 1306 bp, Homo sapiens
ctcgggcgctcgggggcgggctctgcacagcgacgtcacgggcaccgtgcgctgcggaaagttcagccccgcccccgcttccccctcgctgtctccctcggcctgtgccgccgccgacgccgcttgtgggcccgactccgctctgtctgcttcgccaccttctccccgagcactgcccggccggccgccatggctaacgtggctgacacgaagctgtacgacatcctgggcgtcccgcccggcgccagcgagaacgagctgaagaaggcatacagaaagttagccaaggaatatcatcctgataagaatccaaatgcaggagacaaatttaaagaaataagttttgcatatgaagtactatcaaatcctgagaagcgtgagttatatgacagatacggagagcaaggtcttcgggaaggcagcggcggaggtggtggcatggatgatattttctctcacatttttggtgggggattgttcggcttcatgggcaatcagagtagaagtcgaaatggcagaagaagaggagaggacatgatgcatccactcaaagtatctttagaagatctgtataatggcaagacaaccaaactacaacttagcaagaatgtgctctgtagtgcatgcagtggccaaggcggaaagtctggagctgtccaaaagtgtagtgcttgtcgaggtcgaggtgtgcgcatcatgatcagacagctggctccagggatggtacaacagatgcagtctgtgtgctctgattgtaatggagaaggagaggtaattaatgaaaaagaccgctgtaaaaaatgtgaagggaagaaggtgattaaagaagtcaagattcttgaagtccacgtagacaaaggcatgaaacatggacagagaattacattcactggggaagcagaccaggccccaggagtggaacccggagacattgttcttttgctacaggagaaagaacatgaggtatttcagagagatgggaatgatttgcacatgacatataaaataggacttgttgaagctctatgtggatttcagttcacatttaagcaccttgatggacgtcagattgtggtgaaatacccccctggcaaagtaattgaaccagggtgtgttcgtgtagttcgaggtgaagggatgccgcagtatcgtaatccctttgaaaaaggtgatctttacataaagtttgatgtgcagtttcctgaaaacaactggatcaacccagacaagctttctgaaccagaagaagaggagaggacatgatgcatccactcaaagtatctttagaagatctgtataatggcaa

SEQ ID NO: 312835 - DNA, 676 bp, Homo sapiens
  misc_feature (29)..(29): n is a, c, g, or t
tgcactgtagatcgctcccgtgaagaaanttctaacagagcatctgtccctctgcaccaggagggaaggaggaagagaggtctggggaaagctggggtagggagtggctcttagcatgagtctgatgatatctcgcaggcggcaactggtgtgtttaaagggtgtatgcaaagatcactgaaatcggatttgtcattaaagcccagttttacgaaaatgcaaattgtattacctagaaaaattaacatgtgttcaaaggtttactgatggcatttctctgccctcatttcttacagaaatgaaccggagaagaatcccaattgggaattgcggaaaacaggactctagggtagagaaaggttgtagaaccaatagggtttgaggtaatactgtgaaaattcttagagcaatcatttggtgtttgagccctcaagacagaagttttgtgagcgcttattactctgcatatgtcacgagtagtagattaaaagccagtgttttaaaggcaaacttctcagtaatatatattcaaaggaaaaaagaaaaacccaaatctcctgacttttatatggttgcagtgtgatcttttaacatgtacaatagtatatacagtggcatgcagtttgttccatgggtgtgtgggtagagagggaacatattagaacttctatttaga

SEQ ID NO: 312836 - DNA, 441 bp, Homo sapiens
gactcatgtccctcttccttagtgcaagatgcaagactaatttactttaatttttaaggtaaaaatggatggacatagtacctaaagtttaattagccttgttagatttattttgttgagtttaatatatatggaacttgatttacctcattgttactataaatatttgttcagacctgatggccaaaagaaaggaagaaaatttttcctctcctaaaaatgccaaaaggccaagacaagaagaattggaggattttgataaagatggtgacgaagacgaatgtaaaggtactactttggtaagcgaaaaattacaaaattatgctttttgatatgtttttcttgtaacattcatcatatcacattctgtgataacttaaaatcaagaaaaagtaatatgattttttaaaagttgaggtaaaatctgttctgggtaatttt

SEQ ID NO: 312837 - DNA, 444 bp, Homo sapiens
atttctctatatttgtgtagtcttgaacctttaattcctttgctcttcatctgaagagtatttggccatttttatagtgcagaaattcacaaaattattggacttactaaaagtataccaaagaatcaagaataattttaaaaaatagaagttatttttaaacgaatatttatgtagtacttgtttaggcattgtttttaaaagaaatagatttgcaaaaatgtgttttttcaacattaataaaaaatacgtccgttctgttttctttttttaagcggcttactgaactaaagcgccagtgtgtagagaaagagaagcccctatgaatgtaatgaatgtggcaaagcttctcagtgagacagtcagtcctaagataacactcagcgaactcactcacggggtgaaccatataatgtaaccagttggaggggatactctagatcg

SEQ ID NO: 312838 - DNA, 4990 bp, Homo sapiens
agccaaggaagttaagacttcattacttctgacgtttatttagggggtttacactctaggttaccgtgggggaaagactgattgtaaataactacaataccttaaagtaataactataacagaactatatccgaaatacaaggttaacacggaaaagggaacacccaactgtgcctatggggaccagggagggctctcccgggatggctttgagcgaggcgtgggaattatccccatcgcatgcccgggggaagcacagcgggacccagcagcttcggccaagcgcaagcggccggagaacgcgcagctttcccgaggcggggtgacgcagggccctcgcgagtggaaaacaggggccaagtcgcggcctggcggctcggttcggacttcctactttattcaaagggagtcattgaaggcgttttcggaggagcagcgaacaaagagctcgtccgtaagccagatggtcaaaggaatcagtgggaggacccgggcggcgccgtctctccacgtcccgcgggacttacccggacaacccttcctccttggctctggaagaagccccttcgtcatttaccagtttggcctgaatcctaactactgtgcctccaaatttctgaattttctcaaaaggaaaaaaaaaaaaggaaagtcctctttctttacccaagcaaagactagctccccgggctcaaccgccaggcccaggagcaccaggaagcgtttcgaatccagcgccgggcccgcgcgccccgcctcttccgggaagtgactgacccctttcccccaatggggcccgctcggctttccctcgtctgctcccagccggcctagcggacgcatgcgtagaccagctgccgggggcgctcaattatctttcccttttacttaggcaaatcactcacctcccccgagtccggtcactgcggagccgcccgtgcctaccagcttcccccacccgctaaggggcacttccggcctctcagactccggcggcgcgaaaccccgcaaactgcgcaggcgcgggcggagcccgaagggagggagggcggggcgcaggcgcggttagtaccgcggtgggcgccggggctcccgggaatctaccttctcctgcggccggcacgcggttcccagggggccagcggcggtcagccgaggtcgagacgcccgcagggtggccttagcggccggtcgtaccacggcagccccgccgatcaggttcctttgggagacttcgacttgttggcgaaatgaaccggagaagaatcccaattgggaattgcggaaaacaggactctagggtagagaaaggttgtagaaccaatagggtttgagacctgatggccaaaagaaaggaagaaaatttttcctctcctaaaaatgccaaaaggccaagacaagaagaattggaggattttgataaagatggtgacgaagacgaatgtaaaggtactactttgactgcagcagaagttggaataattgagagtattcacctaaaaaacttcatgtgtcattcaatgcttggaccttttaagtttggttctaatgtcaactttgttgttggcaacaatggaagtgggaagagtgcagtactcacagctctcatagtcggtcttggtggaagagcagttgctactaatagaggatcctctttaaaaggttttgtgaaagatggacagaactctgcagatatctcaataacattgaggaacagaggagatgatgcctttaaagccagtgtgtatggtaactctatacttatacagcaacacatcagcatagatggaagtcgatcttataaacttaaaagtgcaacaggctccgtggtttccacgaggaaagaagagctgattgcaattcttgatcattttaacatccaggtggataatccagtttctgttttaacacaagaaatgagcaagcagttcttacagtctaaaaatgaaggagacaaatacaaattcttcatgaaagcaacgcaacttgaacagatgaaggaagattattcatacattatggaaacgaaagaaagaacaaaggagcagatacatcaaggagaagagcggcttactgaactaaagcgccagtgtgtagagaaagaggaacgttttcaaagtattgctggtttaagtacaatgaagactaatttagagtccttgaaacatgaaatggcttgggcagtggtcaatgaaattgaaaaacaattgaatgccatcagagataatatcaaaattggagaagatcgtgctgctagacttgacaggaaaatggaagaacagcaggtcagacttaatgaggcagaacaaaagtacaaggatattcaagacaaactagaaaagattagtgaagagacaaatgcacgagcaccagaatgtatggcattgaaagcagatgttgttgctaagaaaagggcctataatgaagctgaggttttatataaccgatccttaaacgaatataaagcattaaagaaagatgatgagcagctttgtaaacgaattgaagagctgaaaaaaagtactgaccaatctttggaacctgaacggttggaaagacaaaaaaaaatatcttggttaaaagagagagtaaaggcctttcaaaatcaagaaaattcagtcaatcaagagatcgaacagtttcagcaagccatagaaaaggacaaagaagaacatggcaaaattaagagagaagaattagatgtgaagcatgcactgagctacaatcagaggcaactgaaagaattgaaagatagtaaaactgatcgactcaaaagatttggccctaatgttccagctcttcttgaagccatagatgatgcttatagacaaggacattttacctataaacctgtaggccctttaggagcttgcattcatcttcgggacccagaacttgctttggctattgaatcttgcttaaaagggcttctgcaggcctattgttgccataatcatgctgatgaaagggtccttcaggcactcatgaaaaggttttatttaccagggacctcacggccaccgataatagtttctgagtttcggaatgagatatatgatgtaagacacagagctgcttatcatccagactttccaacagttctgacagctttagaaatagataatgcggttgtggcaaatagcctaattgacatgagaggcatagagacagtgctactaatcaaaaataattctgtagctcgtgcagtaatgcagtcccaaaagccacccaaaaattgtagagaagcttttactgctgatggtgatcaagtttttgcaggacgttattattcatctgaaaatacaagacctaagttcctaagcagagatgtggattctgaaataagtgacttggagaatgaggttgaaaataagacggcccagatattaaatcttcagcaacatttatctgcccttgaaaaagatattaaacacaatgaggaacttcttaaaaggtgccaactacattataaagaactaaagatgaaaataagaaaaaatatttctgaaattcgggaacttgagaacatagaagaacaccagtctgtagatattgcaactttggaagatgaagctcaggaaaataaaagcaaaatgaaaatggttgaggaacatatggagcaacaaaaagaaaatatggagcatcttaaaagtctgaaaatagaagcagaaaataagtatgatgcaattaaattcaaaattaatcaactatcggagctagcagacccacttaaggatgaattaaaccttgctgattctgaagtggataaccaaaaacgagggaaacgacattatgaagaaaaacaaaaagaacacttggataccttaaataaaaagaaacgagaactggatatgaaagagaaagaactagaggagaaaatgtcacaagcaagacaaatctgcccagagcgtatagaagtagaaaaatctgcatcaattctggacaaagaaattaatcgattaaggcagaagatacaggcagaacatgctagtcatggagatcgagaggaaataatgaggcagtaccaagaagcaagagagacctatcttgatctggatagtaaagtgaggactttaaaaaagtttattaaattactgggagaaatcatggagcacagattcaagacatatcaacaatttagaaggtgtttgactttacgatgcaaattatactttgacaacttactatctcagcgggcctattgtggaaaaatgaattttgaccacaagaatgaaactctaagtatatcagttcagcctggagaaggaaataaagctgctttcaatgacatgagagccttgtctggaggtgaacgttctttctccacagtgtgttttattctttccctgtggtccatcgcagaatctcctttcagatgcctggatgaatttgatgtctacatggatatggttaataggagaattgccatggacttgatactgaagatggcagattcccagcgttttagacagtttatcttgctcacacctcaaagcatgagttcacttccatccagtaaactgataagaattctccgaatgtctgatcctgaaagaggacaaactacattgcctttcagacctgtgactcaagaagaagatgatgaccaaaggtgatttgtaacttaacatgccttgtcctgatgttgaaggatttgtgaagggaaaaaaaattctggactctttgatataataaaatgagactggaggcattctgaaatgaaagaaactcctttatatatccaaccacaatcaaacatataaataagcctggaaaaccaactacaaccagcaatttaagattactattactttaagaaaatcaatttcatagtattggttttaaatctttttaagtttttttaatacgatctatttttataggttctttttcagaagtaaaattttgtacatatatacatgtacatatctgtttagtttgggttcatttctataacattttgtaagaaaataaaagtttgagcacctga

SEQ ID NO: 312839 - DNA, 4873 bp, Homo sapiens
agccaaggaagttaagacttcattacttctgacgtttatttagggggtttacactctaggttaccgtgggggaaagactgattgtaaataactacaataccttaaagtaataactataacagaactatatccgaaatacaaggttaacacggaaaagggaacacccaactgtgcctatggggaccagggagggctctcccgggatggctttgagcgaggcgtgggaattatccccatcgcatgcccgggggaagcacagcgggacccagcagcttcggccaagcgcaagcggccggagaacgcgcagctttcccgaggcggggtgacgcagggccctcgcgagtggaaaacaggggccaagtcgcggcctggcggctcggttcggacttcctactttattcaaagggagtcattgaaggcgttttcggaggagcagcgaacaaagagctcgtccgtaagccagatggtcaaaggaatcagtgggaggacccgggcggcgccgtctctccacgtcccgcgggacttacccggacaacccttcctccttggctctggaagaagccccttcgtcatttaccagtttggcctgaatcctaactactgtgcctccaaatttctgaattttctcaaaaggaaaaaaaaaaaaggaaagtcctctttctttacccaagcaaagactagctccccgggctcaaccgccaggcccaggagcaccaggaagcgtttcgaatccagcgccgggcccgcgcgccccgcctcttccgggaagtgactgacccctttcccccaatggggcccgctcggctttccctcgtctgctcccagccggcctagcggacgcatgcgtagaccagctgccgggggcgctcaattatctttcccttttacttaggcaaatcactcacctcccccgagtccggtcactgcggagccgcccgtgcctaccagcttcccccacccgctaaggggcacttccggcctctcagactccggcggcgcgaaaccccgcaaactgcgcaggcgcgggcggagcccgaagggagggagggcggggcgcaggcgcggttagtaccgcggtgggcgccggggctcccgggaatctaccttctcctgcggccggcacgcggttcccagggggccagcggcggtcagccgaggtcgagacgcccgcagggtggccttagcggccggtcgtaccacggcagccccgccgatcagacctgatggccaaaagaaaggaagaaaatttttcctctcctaaaaatgccaaaaggccaagacaagaagaattggaggattttgataaagatggtgacgaagacgaatgtaaaggtactactttgactgcagcagaagttggaataattgagagtattcacctaaaaaacttcatgtgtcattcaatgcttggaccttttaagtttggttctaatgtcaactttgttgttggcaacaatggaagtgggaagagtgcagtactcacagctctcatagtcggtcttggtggaagagcagttgctactaatagaggatcctctttaaaaggttttgtgaaagatggacagaactctgcagatatctcaataacattgaggaacagaggagatgatgcctttaaagccagtgtgtatggtaactctatacttatacagcaacacatcagcatagatggaagtcgatcttataaacttaaaagtgcaacaggctccgtggtttccacgaggaaagaagagctgattgcaattcttgatcattttaacatccaggtggataatccagtttctgttttaacacaagaaatgagcaagcagttcttacagtctaaaaatgaaggagacaaatacaaattcttcatgaaagcaacgcaacttgaacagatgaaggaagattattcatacattatggaaacgaaagaaagaacaaaggagcagatacatcaaggagaagagcggcttactgaactaaagcgccagtgtgtagagaaagaggaacgttttcaaagtattgctggtttaagtacaatgaagactaatttagagtccttgaaacatgaaatggcttgggcagtggtcaatgaaattgaaaaacaattgaatgccatcagagataatatcaaaattggagaagatcgtgctgctagacttgacaggaaaatggaagaacagcaggtcagacttaatgaggcagaacaaaagtacaaggatattcaagacaaactagaaaagattagtgaagagacaaatgcacgagcaccagaatgtatggcattgaaagcagatgttgttgctaagaaaagggcctataatgaagctgaggttttatataaccgatccttaaacgaatataaagcattaaagaaagatgatgagcagctttgtaaacgaattgaagagctgaaaaaaagtactgaccaatctttggaacctgaacggttggaaagacaaaaaaaaatatcttggttaaaagagagagtaaaggcctttcaaaatcaagaaaattcagtcaatcaagagatcgaacagtttcagcaagccatagaaaaggacaaagaagaacatggcaaaattaagagagaagaattagatgtgaagcatgcactgagctacaatcagaggcaactgaaagaattgaaagatagtaaaactgatcgactcaaaagatttggccctaatgttccagctcttcttgaagccatagatgatgcttatagacaaggacattttacctataaacctgtaggccctttaggagcttgcattcatcttcgggacccagaacttgctttggctattgaatcttgcttaaaagggcttctgcaggcctattgttgccataatcatgctgatgaaagggtccttcaggcactcatgaaaaggttttatttaccagggacctcacggccaccgataatagtttctgagtttcggaatgagatatatgatgtaagacacagagctgcttatcatccagactttccaacagttctgacagctttagaaatagataatgcggttgtggcaaatagcctaattgacatgagaggcatagagacagtgctactaatcaaaaataattctgtagctcgtgcagtaatgcagtcccaaaagccacccaaaaattgtagagaagcttttactgctgatggtgatcaagtttttgcaggacgttattattcatctgaaaatacaagacctaagttcctaagcagagatgtggattctgaaataagtgacttggagaatgaggttgaaaataagacggcccagatattaaatcttcagcaacatttatctgcccttgaaaaagatattaaacacaatgaggaacttcttaaaaggtgccaactacattataaagaactaaagatgaaaataagaaaaaatatttctgaaattcgggaacttgagaacatagaagaacaccagtctgtagatattgcaactttggaagatgaagctcaggaaaataaaagcaaaatgaaaatggttgaggaacatatggagcaacaaaaagaaaatatggagcatcttaaaagtctgaaaatagaagcagaaaataagtatgatgcaattaaattcaaaattaatcaactatcggagctagcagacccacttaaggatgaattaaaccttgctgattctgaagtggataaccaaaaacgagggaaacgacattatgaagaaaaacaaaaagaacacttggataccttaaataaaaagaaacgagaactggatatgaaagagaaagaactagaggagaaaatgtcacaagcaagacaaatctgcccagagcgtatagaagtagaaaaatctgcatcaattctggacaaagaaattaatcgattaaggcagaagatacaggcagaacatgctagtcatggagatcgagaggaaataatgaggcagtaccaagaagcaagagagacctatcttgatctggatagtaaagtgaggactttaaaaaagtttattaaattactgggagaaatcatggagcacagattcaagacatatcaacaatttagaaggtgtttgactttacgatgcaaattatactttgacaacttactatctcagcgggcctattgtggaaaaatgaattttgaccacaagaatgaaactctaagtatatcagttcagcctggagaaggaaataaagctgctttcaatgacatgagagccttgtctggaggtgaacgttctttctccacagtgtgttttattctttccctgtggtccatcgcagaatctcctttcagatgcctggatgaatttgatgtctacatggatatggttaataggagaattgccatggacttgatactgaagatggcagattcccagcgttttagacagtttatcttgctcacacctcaaagcatgagttcacttccatccagtaaactgataagaattctccgaatgtctgatcctgaaagaggacaaactacattgcctttcagacctgtgactcaagaagaagatgatgaccaaaggtgatttgtaacttaacatgccttgtcctgatgttgaaggatttgtgaagggaaaaaaaattctggactctttgatataataaaatgagactggaggcattctgaaatgaaagaaactcctttatatatccaaccacaatcaaacatataaataagcctggaaaaccaactacaaccagcaatttaagattactattactttaagaaaatcaatttcatagtattggttttaaatctttttaagtttttttaatacgatctatttttataggttctttttcagaagtaaaattttgtacatatatacatgtacatatctgtttagtttgggttcatttctataacattttgtaagaaaataaaagtttgagcacctga

SEQ ID NO: 312840 - DNA, 6304 bp, Homo sapiens
agccaaggaagttaagacttcattacttctgacgtttatttagggggtttacactctaggttaccgtgggggaaagactgattgtaaataactacaataccttaaagtaataactataacagaactatatccgaaatacaaggttaacacggaaaagggaacacccaactgtgcctatggggaccagggagggctctcccgggatggctttgagcgaggcgtgggaattatccccatcgcatgcccgggggaagcacagcgggacccagcagcttcggccaagcgcaagcggccggagaacgcgcagctttcccgaggcggggtgacgcagggccctcgcgagtggaaaacaggggccaagtcgcggcctggcggctcggttcggacttcctactttattcaaagggagtcattgaaggcgttttcggaggagcagcgaacaaagagctcgtccgtaagccagatggtcaaaggaatcagtgggaggacccgggcggcgccgtctctccacgtcccgcgggacttacccggacaacccttcctccttggctctggaagaagccccttcgtcatttaccagtttggcctgaatcctaactactgtgcctccaaatttctgaattttctcaaaaggaaaaaaaaaaaaggaaagtcctctttctttacccaagcaaagactagctccccgggctcaaccgccaggcccaggagcaccaggaagcgtttcgaatccagcgccgggcccgcgcgccccgcctcttccgggaagtgactgacccctttcccccaatggggcccgctcggctttccctcgtctgctcccagccggcctagcggacgcatgcgtagaccagctgccgggggcgctcaattatctttcccttttacttaggcaaatcactcacctcccccgagtccggtcactgcggagccgcccgtgcctaccagcttcccccacccgctaaggggcacttccggcctctcagactccggcggcgcgaaaccccgcaaactgcgcaggcgcgggcggagcccgaagggagggagggcggggcgcaggcgcggttagtaccgcggtgggcgccggggctcccgggaatctaccttctcctgcggccggcacgcggttcccagggggccagcggcggtcagccgaggtcgagacgcccgcagggtggccttagcggccggtcgtaccacggcagccccgccgatcaggttcctttgggagacttcgacttgttggcgaaatgaaccggagaagaatcccaattgggaattgcggaaaacaggactctagggtagagaaaggttgtagaaccaatagggtttgagacctgatggccaaaagaaaggaagaaaatttttcctctcctaaaaatgccaaaaggccaagacaagaagaattggaggattttgataaagatggtgacgaagacgaatgtaaaggtactactttgactgcagcagaagttggaataattgagagtattcacctaaaaaacttcatgtgtcattcaatgcttggaccttttaagtttggttctaatgtcaactttgttgttggcaacaatggaagtgggaagagtgcagtactcacagctctcatagtcggtcttggtggaagagcagttgctactaatagaggatcctctttaaaaggttttgtgaaagatggacagaactctgcagatatctcaataacattgaggaacagaggagatgatgcctttaaagccagtgtgtatggtaactctatacttatacagcaacacatcagcatagatggaagtcgatcttataaacttaaaagtgcaacaggctccgtggtttccacgaggaaagaagagctgattgcaattcttgatcattttaacatccaggtggataatccagtttctgttttaacacaagaaatgagcaagcagttcttacagtctaaaaatgaaggagacaaatacaaattcttcatgaaagcaacgcaacttgaacagatgaaggaagattattcatacattatggaaacgaaagaaagaacaaaggagcagatacatcaaggagaagagcggcttactgaactaaagcgccagtgtgtagagaaagaggaacgttttcaaagtattgctggtttaagtacaatgaagactaatttagagtccttgaaacatgaaatggcttgggcagtggtcaatgaaattgaaaaacaattgaatgccatcagagataatatcaaaattggagaagatcgtgctgctagacttgacaggaaaatggaagaacagcaggtcagacttaatgaggcagaacaaaagtacaaggatattcaagacaaactagaaaagattagtgaagagacaaatgcacgagcaccagaatgtatggcattgaaagcagatgttgttgctaagaaaagggcctataatgaagctgaggttttatataaccgatccttaaacgaatataaagcattaaagaaagatgatgagcagctttgtaaacgaattgaagagctgaaaaaaagtactgaccaatctttggaacctgaacggttggaaagacaaaaaaaaatatcttggttaaaagagagagtaaaggcctttcaaaatcaagaaaattcagtcaatcaagagatcgaacagtttcagcaagccatagaaaaggacaaagaagaacatggcaaaattaagagagaagaattagatgtgaagcatgcactgagctacaatcagaggcaactgaaagaattgaaagatagtaaaactgatcgactcaaaagatttggccctaatgttccagctcttcttgaagccatagatgatgcttatagacaaggacattttacctataaacctgtaggccctttaggagcttgcattcatcttcgggacccagaacttgctttggctattgaatcttgcttaaaagggcttctgcaggcctattgttgccataatcatgctgatgaaagggtccttcaggcactcatgaaaaggttttatttaccagggacctcacggccaccgataatagtttctgagtttcggaatgagatatatgatgtaagacacagagctgcttatcatccagactttccaacagttctgacagctttagaaatagataatgcggttgtggcaaatagcctaattgacatgagaggcatagagacagtgctactaatcaaaaataattctgtagctcgtgcagtaatgcagtcccaaaagccacccaaaaattgtagagaagcttttactgctgatggtgatcaagtttttgcaggacgttattattcatctgaaaatacaagacctaagttcctaagcagagatgtggattctgaaataagtgacttggagaatgaggttgaaaataagacggcccagatattaaatcttcagcaacatttatctgcccttgaaaaagatattaaacacaatgaggaacttcttaaaaggtgccaactacattataaagaactaaagatgaaaataagaaaaaatatttctgaaattcgggaacttgagaacatagaagaacaccagtctgtagatattgcaactttggaagatgaagctcaggaaaataaaagcaaaatgaaaatggttgaggaacatatggagcaacaaaaagaaaatatggagcatcttaaaagtctgaaaatagaagcagaaaataagtatgatgcaattaaattcaaaattaatcaactatcggagctagcagacccacttaaggatgaattaaaccttgctgattctgaagtggataaccaaaaacgagggaaacgacattatgaagaaaaacaaaaagaacacttggataccttaaataaaaagaaacgagaactggatatgaaagagaaagaactagaggagaaaatgtcacaagcaagacaaatctgcccagagcgtatagaagtagaaaaatctgcatcaattctggacaaagaaattaatcgattaaggcagaagatacaggcagaacatgctagtcatggagatcgagaggaaataatgaggcagtaccaagaagcaagagagacctatcttgatctggatagtaaagtgaggactttaaaaaagtttattaaattactgggagaaatcatggagcacagattcaagacatatcaacaatttagaaggtgtttgactttacgatgcaaattatactttgacaacttactatctcagcgggcctattgtggaaaaatgaattttgaccacaagaatgaaactctaagtatatcagttcagcctggagaaggaaataaagctgctttcaatgacatgagagccttgtctggaggtgaacgttctttctccacagtgtgttttattctttccctgtggtccatcgcagaatctcctttcagatgcctggatgaatttgatgtctacatggatatggttaataggagaattgccatggacttgatactgaagatggcagattcccagcgttttagacagtttatcttgctcacacctcaaagcatgagttcacttccatccagtaaactgataagaattctccgaatgtctgatcctgaaagaggacaaactacattgcctttcagacctgtgactcaagaagaagatgatgaccaaaggtgatttgtaacttaacatgccttgtcctgatgttgaaggatttgtgaagggaaaaaaaattctggactctttgatataataaaatgagactggaggcattctgaaatgaaagaaactcctttatatatccaaccacaatcaaacatataaataagcctggaaaaccaactacaaccagcaatttaagattactattactttaagaaaatcaatttcatagtattggttttaaatctttttaagtttttttaatacgatctatttttataggttctttttcagaagtaaaattttgtacatatatacatgtacatatctgtttagtttgggttcatttctataacattttgtaagaaaataaaagtttgagcacctgattatatttagttttgcttttccagatattacattctatagttaccaaaaatggttgaagggagggatttctcattgcagagggtggggtgcaagggaataagacacttgtacggaacactgaagctttgccaacttctacacatgccttttttgcagtcctttaactgtccaccctaccaagagcttataaccagtatcagaactggataatgacgcagtttttcactccgacctccatcatgcttgcctgatttaaaagccctcagtttgcagtccagggactgttcaggcttgtcctcagctgagaggacacaggctagagggactgtgcagaaccaggctgggagaagggctgggaaaactgggagtggagggtggatcctcatggagcaggagagtagctcatggctccaggagcctgaggccatgcagttgatggtgagctgacatcaattctaagactcatcctaattgaggggtgttaaaaagtgtgctgcttagaatgaccaaatatagttattgtaaaaaatgatatttatgaactttttattttagaaaacatgaattttattgctccctgtattatttgtttgatactaggattcatgctaaactttttaagaatgtatgggatatcaagaagcattccttacattagtagcaataaatattagaataaatatgaaattgaactattttcagaaaaagggcagtatattaagagcagggactgttctctagttattgaggaaaactggactttgtttgtgtttttggtggaggaagaagtttaagatactttagtcttaaattgaggtttgccaaatgagaagttcaaaaacttgggctttctaatcagaatttccaggaggaggaaagtgtgtgctgaatattttaaacatttcccactgatcatacaaagtctgatttttaaatttacacttataatgcctttgtattaaaattatttttaacatgtgcttttccaaattaaaaatgaagtagagtataccaaatgcataaactttcattagctaaggaactcatgtctgaattttgttgtagttttgaatgttgtgctctttcatacagaacgggaaacataatcctcaggtatcccagcatctcttgttgaattgaagattattcattgctttggcctcacaaagttttgatttcaactatcataagtgaaaatatcttcctttaatgttctaagtagtgataatattactagaatgaaagaataaaaagaaattgttcttttaaaatatgtgtaacttctaaaaataaaacttaaaatttatatgtaa

SEQ ID NO: 312841 - DNA, 1515 bp, Homo sapiens
  misc_feature (79)..(79): n is a, c, g, or t
gtgactgcgcgatgcgatgcagagtgagggcggaggagaggagaggggcttagctggaaccactctcttaattctccancgctacagcgaagatgaagctcaggaaaataaaagcaaaatgaaaatggttgaggaacatatggagcaacaaaaagaaaatatggagcatcttaaaagtctgaaaatagaagcagaaaataagtatgatgcaattaaattcaaaattaatcaactatcggagctagcagacccacttaaggatgaattaaaccttgctgattctgaagtggataaccaaaaacgagggaaacgacattatgaagaaaaacaaaaagaacacttggataccttaaataaaaagaaacgagaactggatatgaaagagaaagaactagaggagaaaatgtcacaagcaagacaaatctgcccagagcgtatagaagtagaaaaatctgcatcaattctggacaaagaaattaatcgattaaggcagaagatacaggcagaacatgctagtcatggagatcgagaggaaataatgaggcagtaccaagaagcaagagagacctatcttgatctggatagtaaagtgaggactttaaaaaagtttattaaattactgggagaaatcatggagcacagattcaagacatatcaacaatttagaaggtgtttgactttacgatgcaaattatactttgacaacttactatctcagcgggcctattgtggaaaaatgaattttgaccacaagaatgaaactctaagtatatcagttcagcctggagaaggaaataaagctgctttcaatgacatgagagccttgtctggaggtgaacgttctttctccacagtgtgttttattctttccctgtggtccatcgcagaatctcctttcagatgcctggatgaatttgatgtctacatggatatggttaataggagaattgccatggacttgatactgaagatggcagattcccagcgttttagacagtttatcttgctcacacctcaaagcatgagttcacttccatccagtaaactgataagaattctccgaatgtctgatcctgaaagaggacaaactacattgcctttcagacctgtgactcaagaagaagatgatgaccaaaggtgatttgtaacttaacatgccttgtcctgatgttgaaggatttgtgaagggaaaaaaaattctggactctttgatataataaaatgagactggaggcattctgaaatgaaagaaactcctttatatatccaaccacaatcaaacatataaataagcctggaaaaccaactacaaccagcaatttaagattactattactttaagaaaatcaatttcatagtattggttttaaatctttttaagtttttttaatacgatctatttttataggttctttttcagaagtaaaattttgtacatatatacatgtacatatctgtttagtttgggttcatttctataacattttgtaagaaaataaaagtttgagcacctga

SEQ ID NO: 312842 - DNA, 1027 bp, Homo sapiens
agaggatccctcataggttcgcaggactacctggagatcgagaggaaataatgaggcagtaccaagaagcaagagagacctatcttgatctggatagtaaagtgaggactttaaaaaagtttattaaattactgggagaaatcatggagcacagattcaagacatatcaacaatttagaaggtgtttgactttacgatgcaaattatactttgacaacttactatctcagcgggcctattgtggaaaaatgaattttgaccacaagaatgaaactctaagtatatcagttcagcctggagaaggaaataaagctgctttcaatgacatgagagccttgtctggaggtgaacgttctttctccacagtgtgttttattctttccctgtggtccatcgcagaatctcctttcagatgcctggatgaatttgatgtctacatggatatggttaataggagaattgccatggacttgatactgaagatggcagattcccagcgttttagacagtttatcttgctcacacctcaaagcatgagttcacttccatccagtaaactgataagaattctccgaatgtctgatcctgaaagaggacaaactacattgcctttcagacctgtgactcaagaagaagatgatgaccaaaggtgatttgtaacttaacatgccttgtcctgatgttgaaggatttgtgaagggaaaaaaaattctggactctttgatataataaaatgagactggaggcattctgaaatgaaagaaactcctttatatatccaaccacaatcaaacatataaataagcctggaaaaccaactacaaccagcaatttaagattactattactttaagaaaatcaatttcatagtattggttttaaatctttttaagtttttttaatacgatctatttttataggttctttttcagaagtaaaattttgtacatatatacatgtacatatctgtttagtttgggttcatttctataacattttgtaagaaaataaaagtttgagcacctga

SEQ ID NO: 312843 - DNA, 1474 bp, Homo sapiens
tattataacgaagcattattctttgtctataccctgatgtgctatttaacttatttaaagatataattgagaaattggtctgtaagttcaaattggtttatattgtacaaatggtagaggtaatggggagaggcagactttttaaaacttaacctttatcattgagggaaaatttgagagacttaatgaatttgagactagccacttttgttaccattaccctgactcattaaccattactgtacaaattagatttattctctaacatttagttgtgtcaggagaatattttctgattatttcaattgctacacgtatttgagggagggggctgtgtatacaaatattttgactatagaaattacctgaaagacatatttattcagttattgtccccgaagagtttctcttttttcccttagagatgggctttcactctgtcattcaggctagagtacaatggtgcgatcatagcttactgtacccttgagttcctgggctcaagtgatcctcctgcctcggcctcccgagtagctaggatgacaggcatgcaccaccatgcccaactttttttttttttttggtagagacagggtctcgctattatacacaggctggtctcgaactcctgacctcaattgatcctgtgacctccacctctcaaagcattgggattacaaacatgagccactgcacccagccaattttctcctaatagtttctggtatttcttttccagtataatagatttcttgggacatcatagataatgtaatgactgatcccgtggatgaaaatccaggagcttgtatcagcccacagaatgctgcttttacagaaatgtgacttacacaatagcaatcctaacttttgcctttgtttttcaggatatggttaataggagaattgccatggacttgatactgaagatggcagattcccagcgttttagacagtttatcttgctcacacctcaaagcatgagttcacttccatccagtaaactgataagaattctccgaatgtctgatcctgaaagaggacaaactacattgcctttcagacctgtgactcaagaagaagatgatgaccaaaggtgatttgtaacttaacatgccttgtcctgatgttgaaggatttgtgaagggaaaaaaaattctggactctttgatataataaaatgagactggaggcattctgaaatgaaagaaactcctttatatatccaaccacaatcaaacatataaataagcctggaaaaccaactacaaccagcaatttaagattactattactttaagaaaatcaatttcatagtattggttttaaatctttttaagtttttttaatacgatctatttttataggttctttttcagaagtaaaattttgtacatatatacatgtacatatctgtttagtttgggttcatttctataacattttgtaagaaaataaaagtttgagcacctga

SEQ ID NO: 312844 - DNA, 192 bp, Homo sapiens
actgcagcagaagttggaataattgagagtattcacctaaaaaacttcatgtgtcattcaatgcttggaccttttaagtttggttctaatgtcaactttgttgttggcaacaatggaagtaagtgttttttcccttctcgtttgactttgagcagtactttgagattagagtacgttaactttttgaaatag

SEQ ID NO: 312845 - DNA, 420 bp, Homo sapiens
ggcacgcggttcccagggggccagcggcggtcagccgaggtcgagacgcccgcagggtggccttagcggccggtcgtaccacggcagccccgccgatcaggttcctttgggagacttcgacttgttggcggtagggtgaaggcgcgcgctgtcgctttcccttgctccggggttcatcctccgcccgctgcccccttggctggcgacccccagccacccgggagaggcagggtcagctgagctgcggcggtgttcatggtcgtccttgcgggcccgggcgggagatgtccgttcctcgggcgggtcgggcggccggcggcaccttcgcgcgctctccgaggcggcaccggtctcctgagccgcgggaaacctggcgtctgctccgggccgtcccctcccaggcggccgtcccctcccagg

SEQ ID NO: 312846 - DNA, 262 bp, Homo sapiens
cagaaactaaatttttctttttctttttaacagttctatggaagtttacaaactcctaattgcgtttttttttgttattgataatagttcttcatgaaagcaacgcaacttgaacagatgaaggaagattattcatacattatggaaacgaaagaaagaacaaaggagcagatacatcaaggagaagaggtttgtaaacagttaatgtaaatctttttgagatcagccaaattcttatagtacttacagtaaatgatattgt

SEQ ID NO: 312847 - DNA, 4716 bp, Homo sapiens
agccaaggaagttaagacttcattacttctgacgtttatttagggggtttacactctaggttaccgtgggggaaagactgattgtaaataactacaataccttaaagtaataactataacagaactatatccgaaatacaaggttaacacggaaaagggaacacccaactgtgcctatggggaccagggagggctctcccgggatggctttgagcgaggcgtgggaattatccccatcgcatgcccgggggaagcacagcgggacccagcagcttcggccaagcgcaagcggccggagaacgcgcagctttcccgaggcggggtgacgcagggccctcgcgagtggaaaacaggggccaagtcgcggcctggcggctcggttcggacttcctactttattcaaagggagtcattgaaggcgttttcggaggagcagcgaacaaagagctcgtccgtaagccagatggtcaaaggaatcagtgggaggacccgggcggcgccgtctctccacgtcccgcgggacttacccggacaacccttcctccttggctctggaagaagccccttcgtcatttaccagtttggcctgaatcctaactactgtgcctccaaatttctgaattttctcaaaaggaaaaaaaaaaaaggaaagtcctctttctttacccaagcaaagactagctccccgggctcaaccgccaggcccaggagcaccaggaagcgtttcgaatccagcgccgggcccgcgcgccccgcctcttccgggaagtgactgacccctttcccccaatggggcccgctcggctttccctcgtctgctcccagccggcctagcggacgcatgcgtagaccagctgccgggggcgctcaattatctttcccttttacttaggcaaatcactcacctcccccgagtccggtcactgcggagccgcccgtgcctaccagcttcccccacccgctaaggggcacttccggcctctcagactccggcggcgcgaaaccccgcaaactgcgcaggcgcgggcggagcccgaagggagggagggcggggcgcaggcgcggttagtaccgcggtgggcgccggggctcccgggaatctaccttctcctgcggccggcacgcggttcccagggggccagcggcggtcagccgaggtcgagacgcccgcagggtggccttagcggccggtcgtaccacggcagccccgccgatcaggttcctttgggagacttcgacttgttggcgaaatgaaccggagaagaatcccaattgggaattgcggaaaacaggactctagggtagagaaaggttgtagaaccaatagggtttgagacctgatggccaaaagaaaggaagaaaatttttcctctcctaaaaatgccaaaaggccaagacaagaagaattggaggattttgataaagatggtgacgaagacgaatgtaaaggtactactttgactgcagcagaagttggaataattgagagtattcacctaaaaaacttcatgtgtcattcaatgcttggaccttttaagtttggttctaatgtcaactttgttgttggcaacaatggaagtgggaagagtgcagtactcacagctctcatagtcggtcttggtggaagagcagttgctactaatagaggatcctctttaaaaggttttgtgaaagatggacagaactctgcagatatctcaataacattgaggaacagaggagatgatgcctttaaagccagtgtgtatggtaactctatacttatacagcaacacatcagcatagatggaagtcgatcttataaacttaaaagtgcaacaggctccgtggtttccacgaggaaagaagagctgattgcaattcttgatcattttaacatccaggtggataatccagtttctgttttaacacaagaaatgagcaagcagttcttacagtctaaaaatgaaggagacaaatacaaattcttcatgaaagcaacgcaacttgaacagatgaaggaagattattcatacattatggaaacgaaagaaagaacaaaggagcagatacatcaaggagaagagcggcttactgaactaaagcgccagtgtgtagagaaagaggaacgttttcaaagtattgctggtttaagtacaatgaagactaatttagagtccttgaaacatgaaatggcttgggcagtggtcaatgaaattgaaaaacaattgaatgccatcagagataatatcaaaattggagaagatcgtgctgctagacttgacaggaaaatggaagaacagcaggtcagacttaatgaggcagaacaaaagtacaaggatattcaagacaaactagaaaagattagtgaagagacaaatgcacgagcaccagaatgtatggcattgaaagcagatgttgttgctaagaaaagggcctataatgaagctgaggttttatataaccgatccttaaacgaatataaagcattaaagaaagatgatgagcagctttgtaaacgaattgaagagctgaaaaaaagtactgaccaatctttggaacctgaacggttggaaagacaaaaaaaaatatcttggttaaaagagagagtaaaggcctttcaaaatcaagaaaattcagtcaatcaagagatcgaacagtttcagcaagccatagaaaaggacaaagaagaacatggcaaaattaagagagaagaattagatgtgaagcatgcactgagctacaatcagaggcaactgaaagaattgaaagatagtaaaactgatcgactcaaaagatttggccctaatgttccagctcttcttgaagccatagatgatgcttatagacaaggacattttacctataaacctgtaggccctttaggagcttgcattcatcttcgggacccagaacttgctttggctattgaatcttgcttaaaagggcttctgcaggcctattgttgccataatcatgctgatgaaagggtccttcaggcactcatgaaaaggttttatttaccagggacctcacggccaccgataatagtttctgagtttcggaatgagatatatgatgtaagacacagagctgcttatcatccagactttccaacagttctgacagctttagaaatagataatgcggttgtggcaaatagcctaattgacatgagaggcatagagacagtgctactaatcaaaaataattctgtagctcgtgcagtaatgcagtcccaaaagccacccaaaaattgtagagaagcttttactgctgatggtgatcaagtttttgcaggacgttattattcatctgaaaatacaagacctaagttcctaagcagagatgtggattctgaaataagtgacttggagaatgaggttgaaaataagacggcccagatattaaatcttcagcaacatttatctgcccttgaaaaagatattaaacacaatgaggaacttcttaaaaggtgccaactacattataaagaactaaagatgaaaataagaaaaaatatttctgaaattcgggaacttgagaacatagaagaacaccagtctgtagatattgcaactttggaagatgaagctcaggaaaataaaagcaaaatgaaaatggttgaggaacatatggagcaacaaaaagaaaatatggagcatcttaaaagtctgaaaatagaagcagaaaataagtatgatgcaattaaattcaaaattaatcaactatcggagctagcagacccacttaaggatgaattaaaccttgctgattctgaagtggataaccaaaaacgagggaaacgacattatgaagaaaaacaaaaagaacacttggataccttaaataaaaagaaacgagaactggatatgaaagagaaagaactagaggagaaaatgtcacaagcaagacaaatctgcccagagcgtatagaagtagaaaaatctgcatcaattctggacaaagaaattaatcgattaaggcagaagatacaggcagaacatgctagtcatggagatcgagaggaaataatgaggcagtaccaagaagcaagagagacctatcttgatctggatagtaaagtgaggactttaaaaaagtttattaaattactgggagaaatcatggagcacagattcaagacatatcaacaatttagaaggtgtttgactttacgatgcaaattatactttgacaacttactatctcagcgggcctattgtggaaaaatgaattttgaccacaagaatgaaactctaagtatatcagttcagcctggagaaggaaataaagctgctttcaatgacatgagagccttgtctggaggtgaacgttctttctccacagtgtgttttattctttccctgtggtccatcgcagaatctcctttcagatgcctggatgaatttgatgtctacatggatatggttaataggagaattgccatggacttgatactgaagatggcagattcccagcgttttagacagtttatcttgctcacacctcaaagcatgagttcacttccatccagtaaactgataagaattctccgaatgtctgatcctgaaagaggacaaactacattgcctttcagacctgtgactcaagaagaagatgatgaccaaaggtgatttgtaacttaacatgccttgtcctgatgttgaaggatttgtgaagggaaaaaaaattctggactctttgatataataaaatgagactggaggcattctg

SEQ ID NO: 312848 - DNA, 4903 bp, Homo sapiens
agccaaggaagttaagacttcattacttctgacgtttatttagggggtttacactctaggttaccgtgggggaaagactgattgtaaataactacaataccttaaagtaataactataacagaactatatccgaaatacaaggttaacacggaaaagggaacacccaactgtgcctatggggaccagggagggctctcccgggatggctttgagcgaggcgtgggaattatccccatcgcatgcccgggggaagcacagcgggacccagcagcttcggccaagcgcaagcggccggagaacgcgcagctttcccgaggcggggtgacgcagggccctcgcgagtggaaaacaggggccaagtcgcggcctggcggctcggttcggacttcctactttattcaaagggagtcattgaaggcgttttcggaggagcagcgaacaaagagctcgtccgtaagccagatggtcaaaggaatcagtgggaggacccgggcggcgccgtctctccacgtcccgcgggacttacccggacaacccttcctccttggctctggaagaagccccttcgtcatttaccagtttggcctgaatcctaactactgtgcctccaaatttctgaattttctcaaaaggaaaaaaaaaaaaggaaagtcctctttctttacccaagcaaagactagctccccgggctcaaccgccaggcccaggagcaccaggaagcgtttcgaatccagcgccgggcccgcgcgccccgcctcttccgggaagtgactgacccctttcccccaatggggcccgctcggctttccctcgtctgctcccagccggcctagcggacgcatgcgtagaccagctgccgggggcgctcaattatctttcccttttacttaggcaaatcactcacctcccccgagtccggtcactgcggagccgcccgtgcctaccagcttcccccacccgctaaggggcacttccggcctctcagactccggcggcgcgaaaccccgcaaactgcgcaggcgcgggcggagcccgaagggagggagggcggggcgcaggcgcggttagtaccgcggtgggcgccggggctcccgggaatctaccttctcctgcggccggcacgcggttcccagggggccagcggcggtcagccgaggtcgagacgcccgcagggtggccttagcggccggtcgtaccacggcagccccgccgatcaggttcctttgggagacttcgacttgttggcgacctgatggccaaaagaaaggaagaaaatttttcctctcctaaaaatgccaaaaggccaagacaagaagaattggaggattttgataaagatggtgacgaagacgaatgtaaaggtactactttgactgcagcagaagttggaataattgagagtattcacctaaaaaacttcatgtgtcattcaatgcttggaccttttaagtttggttctaatgtcaactttgttgttggcaacaatggaagtgggaagagtgcagtactcacagctctcatagtcggtcttggtggaagagcagttgctactaatagaggatcctctttaaaaggttttgtgaaagatggacagaactctgcagatatctcaataacattgaggaacagaggagatgatgcctttaaagccagtgtgtatggtaactctatacttatacagcaacacatcagcatagatggaagtcgatcttataaacttaaaagtgcaacaggctccgtggtttccacgaggaaagaagagctgattgcaattcttgatcattttaacatccaggtggataatccagtttctgttttaacacaagaaatgagcaagcagttcttacagtctaaaaatgaaggagacaaatacaaattcttcatgaaagcaacgcaacttgaacagatgaaggaagattattcatacattatggaaacgaaagaaagaacaaaggagcagatacatcaaggagaagagcggcttactgaactaaagcgccagtgtgtagagaaagaggaacgttttcaaagtattgctggtttaagtacaatgaagactaatttagagtccttgaaacatgaaatggcttgggcagtggtcaatgaaattgaaaaacaattgaatgccatcagagataatatcaaaattggagaagatcgtgctgctagacttgacaggaaaatggaagaacagcaggtcagacttaatgaggcagaacaaaagtacaaggatattcaagacaaactagaaaagattagtgaagagacaaatgcacgagcaccagaatgtatggcattgaaagcagatgttgttgctaagaaaagggcctataatgaagctgaggttttatataaccgatccttaaacgaatataaagcattaaagaaagatgatgagcagctttgtaaacgaattgaagagctgaaaaaaagtactgaccaatctttggaacctgaacggttggaaagacaaaaaaaaatatcttggttaaaagagagagtaaaggcctttcaaaatcaagaaaattcagtcaatcaagagatcgaacagtttcagcaagccatagaaaaggacaaagaagaacatggcaaaattaagagagaagaattagatgtgaagcatgcactgagctacaatcagaggcaactgaaagaattgaaagatagtaaaactgatcgactcaaaagatttggccctaatgttccagctcttcttgaagccatagatgatgcttatagacaaggacattttacctataaacctgtaggccctttaggagcttgcattcatcttcgggacccagaacttgctttggctattgaatcttgcttaaaagggcttctgcaggcctattgttgccataatcatgctgatgaaagggtccttcaggcactcatgaaaaggttttatttaccagggacctcacggccaccgataatagtttctgagtttcggaatgagatatatgatgtaagacacagagctgcttatcatccagactttccaacagttctgacagctttagaaatagataatgcggttgtggcaaatagcctaattgacatgagaggcatagagacagtgctactaatcaaaaataattctgtagctcgtgcagtaatgcagtcccaaaagccacccaaaaattgtagagaagcttttactgctgatggtgatcaagtttttgcaggacgttattattcatctgaaaatacaagacctaagttcctaagcagagatgtggattctgaaataagtgacttggagaatgaggttgaaaataagacggcccagatattaaatcttcagcaacatttatctgcccttgaaaaagatattaaacacaatgaggaacttcttaaaaggtgccaactacattataaagaactaaagatgaaaataagaaaaaatatttctgaaattcgggaacttgagaacatagaagaacaccagtctgtagatattgcaactttggaagatgaagctcaggaaaataaaagcaaaatgaaaatggttgaggaacatatggagcaacaaaaagaaaatatggagcatcttaaaagtctgaaaatagaagcagaaaataagtatgatgcaattaaattcaaaattaatcaactatcggagctagcagacccacttaaggatgaattaaaccttgctgattctgaagtggataaccaaaaacgagggaaacgacattatgaagaaaaacaaaaagaacacttggataccttaaataaaaagaaacgagaactggatatgaaagagaaagaactagaggagaaaatgtcacaagcaagacaaatctgcccagagcgtatagaagtagaaaaatctgcatcaattctggacaaagaaattaatcgattaaggcagaagatacaggcagaacatgctagtcatggagatcgagaggaaataatgaggcagtaccaagaagcaagagagacctatcttgatctggatagtaaagtgaggactttaaaaaagtttattaaattactgggagaaatcatggagcacagattcaagacatatcaacaatttagaaggtgtttgactttacgatgcaaattatactttgacaacttactatctcagcgggcctattgtggaaaaatgaattttgaccacaagaatgaaactctaagtatatcagttcagcctggagaaggaaataaagctgctttcaatgacatgagagccttgtctggaggtgaacgttctttctccacagtgtgttttattctttccctgtggtccatcgcagaatctcctttcagatgcctggatgaatttgatgtctacatggatatggttaataggagaattgccatggacttgatactgaagatggcagattcccagcgttttagacagtttatcttgctcacacctcaaagcatgagttcacttccatccagtaaactgataagaattctccgaatgtctgatcctgaaagaggacaaactacattgcctttcagacctgtgactcaagaagaagatgatgaccaaaggtgatttgtaacttaacatgccttgtcctgatgttgaaggatttgtgaagggaaaaaaaattctggactctttgatataataaaatgagactggaggcattctgaaatgaaagaaactcctttatatatccaaccacaatcaaacatataaataagcctggaaaaccaactacaaccagcaatttaagattactattactttaagaaaatcaatttcatagtattggttttaaatctttttaagtttttttaatacgatctatttttataggttctttttcagaagtaaaattttgtacatatatacatgtacatatctgtttagtttgggttcatttctataacattttgtaagaaaataaaagtttgagcacctga

SEQ ID NO: 312849 - DNA, 3482 bp, Homo sapiens
agccaaggaagttaagacttcattacttctgacgtttatttagggggtttacactctaggttaccgtgggggaaagactgattgtaaataactacaataccttaaagtaataactataacagaactatatccgaaatacaaggttaacacggaaaagggaacacccaactgtgcctatggggaccagggagggctctcccgggatggctttgagcgaggcgtgggaattatccccatcgcatgcccgggggaagcacagcgggacccagcagcttcggccaagcgcaagcggccggagaacgcgcagctttcccgaggcggggtgacgcagggccctcgcgagtggaaaacaggggccaagtcgcggcctggcggctcggttcggacttcctactttattcaaagggagtcattgaaggcgttttcggaggagcagcgaacaaagagctcgtccgtaagccagatggtcaaaggaatcagtgggaggacccgggcggcgccgtctctccacgtcccgcgggacttacccggacaacccttcctccttggctctggaagaagccccttcgtcatttaccagtttggcctgaatcctaactactgtgcctccaaatttctgaattttctcaaaaggaaaaaaaaaaaaggaaagtcctctttctttacccaagcaaagactagctccccgggctcaaccgccaggcccaggagcaccaggaagcgtttcgaatccagcgccgggcccgcgcgccccgcctcttccgggaagtgactgacccctttcccccaatggggcccgctcggctttccctcgtctgctcccagccggcctagcggacgcatgcgtagaccagctgccgggggcgctcaattatctttcccttttacttaggcaaatcactcacctcccccgagtccggtcactgcggagccgcccgtgcctaccagcttcccccacccgctaaggggcacttccggcctctcagactccggcggcgcgaaaccccgcaaactgcgcaggcgcgggcggagcccgaagggagggagggcggggcgcaggcgcggttagtaccgcggtgggcgccggggctcccgggaatctaccttctcctgcggccggcacgcggttcccagggggccagcggcggtcagccgaggtcgagacgcccgcagggtggccttagcggccggtcgtaccacggcagccccgccgatcaggttcctttgggagacttcgacttgttggcgaaatgaaccggagaagaatcccaattgggaattgcggaaaacaggactctagggtagagaaaggttgtagaaccaatagggtttgagacctgatggccaaaagaaaggaagaaaatttttcctctcctaaaaatgccaaaaggccaagacaagaagaattggaggattttgataaagatggtgacgaagacgaatgtaaaggtactactttgactgcagcagaagttggaataattgagagtattcacctaaaaaacttcatgtgtcattcaatgcttggaccttttaagtttggttctaatgtcaactttgttgttggcaacaatggaagtgggaagagtgcagtactcacagctctcatagtcggtcttggtggaagagcagttgctactaatagaggatcctctttaaaaggttttgtgaaagatggacagaactctgcagatatctcaataacattgaggaacagaggagatgatgcctttaaagccagtgtgtatggtaactctatacttatacagcaacacatcagcatagatggaagtcgatcttataaacttaaaagtgcaacaggctccgtggtttccacgaggaaagaagagctgattgcaattcttgatcattttaacatccaggtggataatccagtttctgttttaacacaagaaatgagcaagcagttcttacagtctaaaaatgaaggagacaaatacaaattcttcatgaaagcaacgcaacttgaacagatgaaggaagattattcatacattatggaaacgaaagaaagaacaaaggagcagatacatcaaggagaagagcggcttactgaactaaagcgccagtgtgtagagaaagaggaacgttttcaaagtattgctggtttaagtacaatgaagactaatttagagtccttgaaacatgaaatggcttgggcagtggtcaatgaaattgaaaaacaattgaatgccatcagagataatatcaaaattggagaagatcgtgctgctagacttgacaggaaaatggaagaacagcaggtcagacttaatgaggcagaacaaaagtacaaggatattcaagacaaactagaaaagattagtgaagagacaaatgcacgagcaccagaatgtatggcattgaaagcagatgttgttgctaagaaaagggcctataatgaagctgaggttttatataaccgatccttaaacgaatataaagcattaaagaaagatgatgagcagctttgtaaacgaattgaagagctgaaaaaaagtactgaccaatctttggaacctgaacggttggaaagacaaaaaaaaatatcttggttaaaagagagagtaaaggcctttcaaaatcaagaaaattcagtcaatcaagagatcgaacagtttcagcaagccatagaaaaggacaaagaagaacatggcaaaattaagagagaagaattagatgtgaagcatgcactgagctacaatcagaggcaactgaaagaattgaaagatagtaaaactgatcgactcaaaagatttggccctaatgttccagctcttcttgaagccatagatgatgcttatagacaaggacattttacctataaacctgtaggccctttaggagcttgcattcatcttcgggacccagaacttgctttggctattgaatcttgcttaaaagggcttctgcaggcctattgttgccataatcatgctgatgaaagggtccttcaggcactcatgaaaaggttttatttaccagggacctcacggccaccgataatagtttctgagtttcggaatgagatatatgatgtaagacacagagctgcttatcatccagactttccaacagttctgacagctttagaaatagataatgcggttgtggcaaatagcctaattgacatgagaggcatagagacagtgctactaatcaaaaataattctgtagctcgtgcagtaatgcagtcccaaaagccacccaaaaattgtagagaagcttttactgctgatggtgatcaagtttttgcaggacgttattattcatctgaaaatacaagacctaagttcctaagcagagatgtggattctgaaataagtgacttggagaatgaggttgaaaataagacggcccagatattaaatcttcagcaacatttatctgcccttgaaaaagatattaaacacaatgaggaacttcttaaaaggtgccaactacattataaagaactaaag

SEQ ID NO: 312850 - DNA, 2559 bp, Homo sapiens
agccaaggaagttaagacttcattacttctgacgtttatttagggggtttacactctaggttaccgtgggggaaagactgattgtaaataactacaataccttaaagtaataactataacagaactatatccgaaatacaaggttaacacggaaaagggaacacccaactgtgcctatggggaccagggagggctctcccgggatggctttgagcgaggcgtgggaattatccccatcgcatgcccgggggaagcacagcgggacccagcagcttcggccaagcgcaagcggccggagaacgcgcagctttcccgaggcggggtgacgcagggccctcgcgagtggaaaacaggggccaagtcgcggcctggcggctcggttcggacttcctactttattcaaagggagtcattgaaggcgttttcggaggagcagcgaacaaagagctcgtccgtaagccagatggtcaaaggaatcagtgggaggacccgggcggcgccgtctctccacgtcccgcgggacttacccggacaacccttcctccttggctctggaagaagccccttcgtcatttaccagtttggcctgaatcctaactactgtgcctccaaatttctgaattttctcaaaaggaaaaaaaaaaaaggaaagtcctctttctttacccaagcaaagactagctccccgggctcaaccgccaggcccaggagcaccaggaagcgtttcgaatccagcgccgggcccgcgcgccccgcctcttccgggaagtgactgacccctttcccccaatggggcccgctcggctttccctcgtctgctcccagccggcctagcggacgcatgcgtagaccagctgccgggggcgctcaattatctttcccttttacttaggcaaatcactcacctcccccgagtccggtcactgcggagccgcccgtgcctaccagcttcccccacccgctaaggggcacttccggcctctcagactccggcggcgcgaaaccccgcaaactgcgcaggcgcgggcggagcccgaagggagggagggcggggcgcaggcgcggttagtaccgcggtgggcgccggggctcccgggaatctaccttctcctgcggccggcacgcggttcccagggggccagcggcggtcagccgaggtcgagacgcccgcagggtggccttagcggccggtcgtaccacggcagccccgccgatcaggttcctttgggagacttcgacttgttggcgaaatgaaccggagaagaatcccaattgggaattgcggaaaacaggactctagggtagagaaaggttgtagaaccaatagggtttgagacctgatggccaaaagaaaggaagaaaatttttcctctcctaaaaatgccaaaaggccaagacaagaagaattggaggattttgataaagatggtgacgaagacgaatgtaaaggtactactttgactgcagcagaagttggaataattgagagtattcacctaaaaaacttcatgtgtcattcaatgcttggaccttttaagtttggttctaatgtcaactttgttgttggcaacaatggaagtgggaagagtgcagtactcacagctctcatagtcggtcttggtggaagagcagttgctactaatagaggatcctctttaaaaggttttgtgaaagatggacagaactctgcagatatctcaataacattgaggaacagaggagatgatgcctttaaagccagtgtgtatggtaactctatacttatacagcaacacatcagcatagatggaagtcgatcttataaacttaaaagtgcaacaggctccgtggtttccacgaggaaagaagagctgattgcaattcttgatcattttaacatccaggtggataatccagtttctgttttaacacaagaaatgagcaagcagttcttacagtctaaaaatgaaggagacaaatacaaattcttcatgaaagcaacgcaacttgaacagatgaaggaagattattcatacattatggaaacgaaagaaagaacaaaggagcagatacatcaaggagaagagcggcttactgaactaaagcgccagtgtgtagagaaagaggaacgttttcaaagtattgctggtttaagtacaatgaagactaatttagagtccttgaaacatgaaatggcttgggcagtggtcaatgaaattgaaaaacaattgaatgccatcagagataatatcaaaattggagaagatcgtgctgctagacttgacaggaaaatggaagaacagcaggtcagacttaatgaggcagaacaaaagtacaaggatattcaagacaaactagaaaagattagtgaagagacaaatgcacgagcaccagaatgtatggcattgaaagcagatgttgttgctaagaaaagggcctataatgaagctgaggttttatataaccgatccttaaacgaatataaagcattaaagaaagatgatgagcagctttgtaaacgaattgaagagctgaaaaaaaggtaggggtagaaaacaaaacacacacaaaacacaaaat

SEQ ID NO: 312851 - DNA, 2707 bp, Homo sapiens
gggagaaacgttctcactcgctctctgctcgctgcgggcgctccccgccctctgctgccagaaccttggggatgtgcctagacccggcgcagcacacgtccgggccaaccgcgagcagaacaaacctttggcgggcggccaggaggctccctcccagccaccgcccccctccagcgcctttttttccccccatacaatacaagatcttccttcctcagttcccttaaagcacagcccagggaaacctcctcacagttttcatccagccacgggccagcatgtctgggggcaaatacgtagactcggagggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaagattgactttgaagatgtgattgcagaaccagaagggacacacagttttgacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaatgtccgcatcaacttgcagaaagaaatataaatgacatttcaaggatagaagtatacctgattttttttccttttaattttcctggtgccaatttcaagttccaagttgctaatacagcaacaatttatgaattgaattatcttggttgaaaataaaaagatcactttctcagttttcataagtattatgtctcttctgagctatttcatctatttttggcagtctgaatttttaaaacccatttaaatttttttccttacctttttatttgcatgtggatcaaccatcgctttattggctgagatatgaacatattgttgaaaggtaatttgagagaaatatgaagaactgaggaggaaaaaaaaaaaaagaaaagaaccaacaacctcaactgcctactccaaaatgttggtcattttatgttaagggaagaattccagggtatggccatggagtgtacaagtatgtgggcagattttcagcaaactcttttcccactgtttaaggagttagtggattactgccattcacttcataatccagtaggatccagtgatccttacaagttagaaaacataatcttctgccttctcatgatccaactaatgccttactcttcttgaaattttaacctatgatattttctgtgcctgaatatttgttatgtagataacaagacctcagtgccttcctgtttttcacattttccttttcaaatagggtctaactcagcaactcgctttaggtcagcagcctccctgaagaccaaaattagaatatccatgacctagttttccatgcgtgtttctgactctgagctacagagtctggtgaagctcacttctgggcttcatctggcaacatctttatccgtagtgggtatggttgacactagcccaatgaaatgaattaaagtggaccaatagggctgagctctctgtgggctggcagtcctggaagccagctttccctgcctctcatcaactgaatgaggtcagcatgtctattcagcttcgtttattttcaagaataatcacgctttcctgaatccaaactaatccatcaccggggtggtttagtggctcaacattgtgttcccatttcagctgatcagtgggcctccaaggaggggctgtaaaatggaggccattgtgtgagcctatcagagttgctgcaaacctgacccctgctcagtaaagcacttgcaaccgtctgttatgctgtgacacatggcccctccccctgccaggagctttggacctaatccaagcatccctttgcccagaaagaagatgggggaggaggcagtaataaaaagattgaagtattttgctggaataagttcaaattcttctgaactcaaactgaggaatttcacctgtaaacctgagtcgtacagaaagctgcctggtatatccaaaagctttttattcctcctgctcatattgtgattctgcctttggggacttttcttaaaccttcagttatgatttttttttcatacacttattggaactctgcttgatttttgcctcttccagtcttcctgacactttaattaccaacctgttacctactttgactttttgcatttaaaacagacactggcatggatatagttttacttttaaactgtgtacataactgaaaatgtgctatactgcatactttttaaatgtaaagatatttttatctttatatgaagaaaatcacttaggaaatggctttgtgattcaatctgtaaactgtgtattccaagacatgtctgttctacatagatgcttagtccctcatgcaaatcaattactggtccaaaagattgctgaaattttatatgcttactgatatattttacaattttttatcatgcatgtcctgtaaaggttacaagcctgcacaataaaaatgtttaacgggttaaa

SEQ ID NO: 312852 - DNA, 598 bp, Homo sapiens
ctctgcgagatcctcttaaaaagctggctacgcgcaggcggtttctgtgcacggagccgtagctgtcggagcggttagttcgatttcgagctcgaggtttcccccgccgccaggctgacttctcatcgcttgtttttctttttgcatttttcctcccaccgccgttgccgccctccccgtcctggccgtccgccctccgccctctgcagggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaagattgactttgaagatgtgattgcagaaccagaagggacacacagttttgacggcatttggaaggccagcttcaccaccttcacgtgttggaccgaaaatttactgtgggagttttataccccggctttggctggtctggccctcttgtggcatcccgatgggcacttcattcctgggggggccattttaacgttccgacccatttcttcttcttttcctgggca

SEQ ID NO: 312853 - DNA, 2608 bp, Homo sapiens
ctctgcgagatcctcttaaaaagctggctacgcgcaggcggtttctgtgcacggagccgtagctgtcggagcggttagttcgatttcgagctcgaggtttcccccgccgccaggctgacttctcatcgcttgtttttctttttgcatttttcctcccaccgccgttgccgccctccccgtcctggccgtccgccctccgccctctgcagggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaagattgactttgaagatgtgattgcagaaccagaagggacacacagttttgacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaatgtccgcatcaacttgcagaaagaaatataaatgacatttcaaggatagaagtatacctgattttttttccttttaattttcctggtgccaatttcaagttccaagttgctaatacagcaacaatttatgaattgaattatcttggttgaaaataaaaagatcactttctcagttttcataagtattatgtctcttctgagctatttcatctatttttggcagtctgaatttttaaaacccatttaaatttttttccttacctttttatttgcatgtggatcaaccatcgctttattggctgagatatgaacatattgttgaaaggtaatttgagagaaatatgaagaactgaggaggaaaaaaaaaaaaagaaaagaaccaacaacctcaactgcctactccaaaatgttggtcattttatgttaagggaagaattccagggtatggccatggagtgtacaagtatgtgggcagattttcagcaaactcttttcccactgtttaaggagttagtggattactgccattcacttcataatccagtaggatccagtgatccttacaagttagaaaacataatcttctgccttctcatgatccaactaatgccttactcttcttgaaattttaacctatgatattttctgtgcctgaatatttgttatgtagataacaagacctcagtgccttcctgtttttcacattttccttttcaaatagggtctaactcagcaactcgctttaggtcagcagcctccctgaagaccaaaattagaatatccatgacctagttttccatgcgtgtttctgactctgagctacagagtctggtgaagctcacttctgggcttcatctggcaacatctttatccgtagtgggtatggttgacactagcccaatgaaatgaattaaagtggaccaatagggctgagctctctgtgggctggcagtcctggaagccagctttccctgcctctcatcaactgaatgaggtcagcatgtctattcagcttcgtttattttcaagaataatcacgctttcctgaatccaaactaatccatcaccggggtggtttagtggctcaacattgtgttcccatttcagctgatcagtgggcctccaaggaggggctgtaaaatggaggccattgtgtgagcctatcagagttgctgcaaacctgacccctgctcagtaaagcacttgcaaccgtctgttatgctgtgacacatggcccctccccctgccaggagctttggacctaatccaagcatccctttgcccagaaagaagatgggggaggaggcagtaataaaaagattgaagtattttgctggaataagttcaaattcttctgaactcaaactgaggaatttcacctgtaaacctgagtcgtacagaaagctgcctggtatatccaaaagctttttattcctcctgctcatattgtgattctgcctttggggacttttcttaaaccttcagttatgatttttttttcatacacttattggaactctgcttgatttttgcctcttccagtcttcctgacactttaattaccaacctgttacctactttgactttttgcatttaaaacagacactggcatggatatagttttacttttaaactgtgtacataactgaaaatgtgctatactgcatactttttaaatgtaaagatatttttatctttatatgaagaaaatcacttaggaaatggctttgtgattcaatctgtaaactgtgtattccaagacatgtctgttctacatagatgcttagtccctcatgcaaatcaattactggtccaaaagattgctgaaattttatatgcttactgatatattttacaattttttatcatgcatgtcctgtaaaggttacaagcctgcacaataaaaatgtttaacgggttaaa

SEQ ID NO: 312854 - DNA, 3232 bp, Homo sapiens
  misc_feature (3232)..(3232): n is a, c, g, or t
gggagaaacgttctcactcgctctctgctcgctgcgggcgctccccgccctctgctgccagaaccttggggatgtgcctagacccggcgcagcacacgtccgggccaaccgcgagcagaacaaacctttggcgggcggccaggaggctccctcccagccaccgcccccctccagcgcctttttttccccccatacaatacaagatcttccttcctcagttcccttaaagcacagcccagggaaacctcctcacagttttcatccagccacgggccagcatgtctgggggcaaatacgtagactcggagggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaagattgactttgaagatgtgattgcagaaccagaagggacacacagttttgacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaatgtccgcatcaacttgcagaaagaaatataaatgacatttcaaggatagaagtatacctgattttttttccttttaattttcctggtgccaatttcaagttccaagttgctaatacagcaacaatttatgaattgaattatcttggttgaaaataaaaagatcactttctcagttttcataagtattatgtctcttctgagctatttcatctatttttggcagtctgaatttttaaaacccatttaaatttttttccttacctttttatttgcatgtggatcaaccatcgctttattggctgagatatgaacatattgttgaaaggtaatttgagagaaatatgaagaactgaggaggaaaaaaaaaaaaagaaaagaaccaacaacctcaactgcctactccaaaatgttggtcattttatgttaagggaagaattccagggtatggccatggagtgtacaagtatgtgggcagattttcagcaaactcttttcccactgtttaaggagttagtggattactgccattcacttcataatccagtaggatccagtgatccttacaagttagaaaacataatcttctgccttctcatgatccaactaatgccttactcttcttgaaattttaacctatgatattttctgtgcctgaatatttgttatgtagataacaagacctcagtgccttcctgtttttcacattttccttttcaaatagggtctaactcagcaactcgctttaggtcagcagcctccctgaagaccaaaattagaatatccatgacctagttttccatgcgtgtttctgactctgagctacagagtctggtgaagctcacttctgggcttcatctggcaacatctttatccgtagtgggtatggttgacactagcccaatgaaatgaattaaagtggaccaatagggctgagctctctgtgggctggcagtcctggaagccagctttccctgcctctcatcaactgaatgaggtcagcatgtctattcagcttcgtttattttcaagaataatcacgctttcctgaatccaaactaatccatcaccggggtggtttagtggctcaacattgtgttcccatttcagctgatcagtgggcctccaaggaggggctgtaaaatggaggccattgtgtgagcctatcagagttgctgcaaacctgacccctgctcagtaaagcacttgcaaccgtctgttatgctgtgacacatggcccctccccctgccaggagctttggacctaatccaagcatccctttgcccagaaagaagatgggggaggaggcagtaataaaaagattgaagtattttgctggaataagttcaaattcttctgaactcaaactgaggaatttcacctgtaaacctgagtcgtacagaaagctgcctggtatatccaaaagctttttattcctcctgctcatattgtgattctgcctttggggacttttcttaaaccttcagttatgatttttttttcatacacttattggaactctgcttgatttttgcctcttccagtcttcctgacactttaattaccaacctgttacctactttgactttttgcatttaaaacagacactggcatggatatagttttacttttaaactgtgtacataactgaaaatgtgctatactgcatactttttaaatgtaaagatatttttatctttatatgaagaaaatcacttaggaaatggctttgtgattcaatctgtaaactgtgtattccaagacatgtctgttctacatagatgcttagtccctcatgcaaatcaattactggtccaaaagattgctgaaattttatatgcttactgatatattttacaattttttatcatgcatgtcctgtaaaggttacaagcctgcacaataaaaatgtttaacgggttaaaaaaaaaaaaaaaaaaaaaaaaaaaaaaaaaaaaaaaaaaaaaaaaaaaaaaaaaaaaaaaaaaaaaaaaaaaaaaagggggggggcgccgaaaaaaataattccccggggggggccccaactttagcgctacgcaccccagtttttgttggacaaaaagagcggcccccaatatatggaaggctgattatataaagaaagccaaggcagcggcgcgttgttaaaccaaaagcgctcgagagggggaaaaaaacggcgatcgggtgacgacatctccttggtggaagaggcaccccccccttactggggggggaggagaaacatatggtggggcaaacacacctccactaccgagagaagattaattagcagcgcccagggaggggacataatactacaacctgtggacgagcgagtctaataggtgggtctaacaccccaccaccgcaacataattcgtcgccgcagtaaaaaaatgttgctcacacgaaacaaatagcttcaggaaacattttttacgcaggcn

SEQ ID NO: 312855 - DNA, 1882 bp, Homo sapiens
tggggccccccccccaaaaaatttttttctttaacaaaaaaagggtgtttcccccaaaaaaggtgttgctaatacagcaacaatttatgaattgaattatcttggttgaaaataaaaagatcactttctcagttttcataagtattatgtctcttctgagctatttcatctatttttggcagtctgaatttttaaaacccatttaaatttttttccttacctttttatttgcatgtggatcaaccatcgctttattggctgagatatgaacatattgttgaaaggtaatttgagagaaatatgaagaactgaggaggaaaaaaaaaaaaagaaaagaaccaacaacctcaactgcctactccaaaatgttggtcattttatgttaagggaagaattccagggtatggccatggagtgtacaagtatgtgggcagattttcagcaaactcttttcccactgtttaaggagttagtggattactgccattcacttcataatccagtaggatccagtgatccttacaagttagaaaacataatcttctgccttctcatgatccaactaatgccttactcttcttgaaattttaacctatgatattttctgtgcctgaatatttgttatgtagataacaagacctcagtgccttcctgtttttcacattttccttttcaaatagggtctaactcagcaactcgctttaggtcagcagcctccctgaagaccaaaattagaatatccatgacctagttttccatgcgtgtttctgactctgagctacagagtctggtgaagctcacttctgggcttcatctggcaacatctttatccgtagtgggtatggttgacactagcccaatgaaatgaattaaagtggaccaatagggctgagctctctgtgggctggcagtcctggaagccagctttccctgcctctcatcaactgaatgaggtcagcatgtctattcagcttcgtttattttcaagaataatcacgctttcctgaatccaaactaatccatcaccggggtggtttagtggctcaacattgtgttcccatttcagctgatcagtgggcctccaaggaggggctgtaaaatggaggccattgtgtgagcctatcagagttgctgcaaacctgacccctgctcagtaaagcacttgcaaccgtctgttatgctgtgacacatggcccctccccctgccaggagctttggacctaatccaagcatccctttgcccagaaagaagatgggggaggaggcagtaataaaaagattgaagtattttgctggaataagttcaaattcttctgaactcaaactgaggaatttcacctgtaaacctgagtcgtacagaaagctgcctggtatatccaaaagctttttattcctcctgctcatattgtgattctgcctttggggacttttcttaaaccttcagttatgatttttttttcatacacttattggaactctgcttgatttttgcctcttccagtcttcctgacactttaattaccaacctgttacctactttgactttttgcatttaaaacagacactggcatggatatagttttacttttaaactgtgtacataactgaaaatgtgctatactgcatactttttaaatgtaaagatatttttatctttatatgaagaaaatcacttaggaaatggctttgtgattcaatctgtaaactgtgtattccaagacatgtctgttctacatagatgcttagtccctcatgcaaatcaattactggtccaaaagattgctgaaattttatatgcttactgatatattttacaattttttatcatgcatgtcctgtaaaggttacaagcctgcacaataaaaatgtttaacgggttaaa

SEQ ID NO: 312856 - DNA, 2389 bp, Homo sapiens
gggagaaacgttctcactcgctctctgctcgctgcgggcgctccccgccctctgctgccagaaccttggggatgtgcctagacccggcgcagcacacgtccgggccaaccgcgagcagaacaaacctttggcgggcggccaggaggctccctcccagccaccgcccccctccagcgcctttttttccccccatacaatacaagatcttccttcctcagttcccttaaagcacagcccagggaaacctcctcacagttttcatccagccacgggccagcatgtctgggggcaaatacgtagactcggagggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaagattgactttgaagatgtgattgcagaaccagaagggacacacagttttgacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaatgtccgcatcaacttgcagaaagaaatataaatgacatttcaaggatagaagtatacctgattttttttccttttaattttcctggtgccaatttcaagttccaagttgctaatacagcaacaatttatgaattgaattatcttggttgaaaataaaaagatcactttctcagttttcataagtattatgtctcttctgagctatttcatctatttttggcagtctgaatttttaaaacccatttaaatttttttccttacctttttatttgcatgtggatcaaccatcgctttattggctgagatatgaacatattgttgaaaggtaatttgagagaaatatgaagaactgaggaggaaaaaaaaaaaaagaaaagaaccaacaacctcaactgcctactccaaaatgttggtcattttatgttaagggaagaattccagggtatggccatggagtgtacaagtatgtgggcagattttcagcaaactcttttcccactgtttaaggagttagtggattactgccattcacttcataatccagtaggatccagtgatccttacaagttagaaaacataatcttctgccttctcatgatccaactaatgccttactcttcttgaaattttaacctatgatattttctgtgcctgaatatttgttatgtagataacaagacctcagtgccttcctgtttttcacattttccttttcaaatagggtctaactcagcaactcgctttaggtcagcagcctccctgaagaccaaaattagaatatccatgacctagttttccatgcgtgtttctgactctgagctacagagtctggtgaagctcacttctgggcttcatctggcaacatctttatccgtagtgggtatggttgacactagcccaatgaaatgaattaaagtggaccaatagggctgagctctctgtgggctggcagtcctggaagccagctttccctgcctctcatcaactgaatgaggtcagcatgtctattcagcttcgtttattttcaagaataatcacgctttcctgaatccaaactaatccatcaccggggtggtttagtggctcaacattgtgttcccatttcagctgatcagtgggcctccaaggaggggctgtaaaatggaggccattgtgtgagcctatcagagttgctgcaaacctgacccctgctcagtaaagcacttgcaaccgtctgttatgctgtgacacatggcccctccccctgccaggagctttggacctaatccaagcatccctttgcccagaaagaagatgggggaggaggcagtaataaaaagattgaagtattttgctggaataagttcaaattcttctgaactcaaactgaggaatttcacctgtaaacctgagtcgtacagaaagctgcctggtatatccaaaagctttttattcctcctgctcatattgtgattctgcctttggggacttttcttaaaccttcagttatgatttttttttcatataaagataaaaactatctttacatctataaagtatgcagtatagcacagttttcgagtgatgtacacagtttaaaacgtaaaactatatccatgccagtgt

SEQ ID NO: 312857 - DNA, 2304 bp, Homo sapiens
  misc_feature (2284)..(2284): n is a, c, g, or t
gggagaaacgttctcactcgctctctgctcgctgcgggcgctccccgccctctgctgccagaaccttggggatgtgcctagacccggcgcagcacacgtccgggccaaccgcgagcagaacaaacctttggcgggcggccaggaggctccctcccagccaccgcccccctccagcgcctttttttccccccatacaatacaagatcttccttcctcagttcccttaaagcacagcccagggaaacctcctcacagttttcatccagccacgggccagcatgtctgggggcaaatacgtagactcggagggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaagattgactttgaagatgtgattgcagaaccagaagggacacacagttttgacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaatgtccgcatcaacttgcagaaagaaatataaatgacatttcaaggatagaagtatacctgattttttttccttttaattttcctggtgccaatttcaagttccaagttgctaatacagcaacaatttatgaattgaattatcttggttgaaaataaaaagatcactttctcagttttcataagtattatgtctcttctgagctatttcatctatttttggcagtctgaatttttaaaacccatttaaatttttttccttacctttttatttgcatgtggatcaaccatcgctttattggctgagatatgaacatattgttgaaaggtaatttgagagaaatatgaagaactgaggaggaaaaaaaaaaaaagaaaagaaccaacaacctcaactgcctactccaaaatgttggtcattttatgttaagggaagaattccagggtatggccatggagtgtacaagtatgtgggcagattttcagcaaactcttttcccactgtttaaggagttagtggattactgccattcacttcataatccagtaggatccagtgatccttacaagttagaaaacataatcttctgccttctcatgatccaactaatgccttactcttcttgaaattttaacctatgatattttctgtgcctgaatatttgttatgtagataacaagacctcagtgccttcctgtttttcacattttccttttcaaatagggtctaactcagcaactcgctttaggtcagcagcctccctgaagaccaaaattagaatatccatgacctagttttccatgcgtgtttctgactctgagctacagagtctggtgaagctcacttctgggcttcatctggcaacatctttatccgtagtgggtatggttgacactagcccaatgaaatgaattaaagtggaccaatagggctgagctctctgtgggctggcagtcctggaagccagctttccctgcctctcatcaactgaatgaggtcagcatgtctattcagcttcgtttattttcaagaataatcacgctttcctgaatccaaactaatccatcaccggggtggtttagtggctcaacattgtgttcccatttcagctgatcagtgggcctccaaggaggggctgtaaaatggaggccattgtgtgagcctatcagagttgctgcaaacctgacccctgctcagtaaagcacttgcaaccgtctgttatgctgtgacacatggcccctccccctgccaggagctttggacctaatccaagcatccctttgcccagaaagaagatgggggaggaggcagtaataaaaagattgaagtattttgctggaataagttcaaattcttctgaactcaaactgaggaatttcacctgtaaacctgagtcgtacagaaagctgcctggtatatccaaaagctttttattcctcctgctcatattgtgattctgcctttgggtcagcgggttgcattgggccaggcggtgccattgngccagcgggggggatcctct

SEQ ID NO: 312858 - DNA, 959 bp, Homo sapiens
gggagaaacgttctcactcgctctctgctcgctgcgggcgctccccgccctctgctgccagaaccttggggatgtgcctagacccggcgcagcacacgtccgggccaaccgcgagcagaacaaacctttggcgggcggccaggaggctccctcccagccaccgcccccctccagcgcctttttttccccccatacaatacaagatcttccttcctcagttcccttaaagcacagcccagggaaacctcctcacagttttcatccagccacgggccagcatgtctgggggcaaatacgtagactcggagggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaagattgactttgaagatgtgattgcagaaccagaagggacacacagttttgacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaatgtccgcatcaacttgcagaaagaaatataaatgacatttcaaggatagaagtatacctgattttttttccttttaattttcctggtgccaatttcaagttccaagttgctaatacagcaacaatttatgaattgaattatcttggttgaaaataaaaagatcactttctcagtt

SEQ ID NO: 312859 - DNA, 860 bp, Homo sapiens
ctctgcgagatcctcttaaaaagctggctacgcgcaggcggtttctgtgcacggagccgtagctgtcggagcggttagttcgatttcgagctcgaggtttcccccgccgccaggctgacttctcatcgcttgtttttctttttgcatttttcctcccaccgccgttgccgccctccccgtcctggccgtccgccctccgccctctgcagggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaagattgactttgaagatgtgattgcagaaccagaagggacacacagttttgacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaatgtccgcatcaacttgcagaaagaaatataaatgacatttcaaggatagaagtatacctgattttttttccttttaattttcctggtgccaatttcaagttccaagttgctaatacagcaacaatttatgaattgaattatcttggttgaaaataaaaagatcactttctcagtt

SEQ ID NO: 312860 - DNA, 3420 bp, Homo sapiens
gggagaaacgttctcactcgctctctgctcgctgcgggcgctccccgccctctgctgccagaaccttggggatgtgcctagacccggcgcagcacacgtccgggccaaccgcgagcagaacaaacctttggcgggcggccaggaggctccctcccagccaccgcccccctccagcgcctttttttccccccatacaatacaagatcttccttcctcagttcccttaaagcacagcccagggaaacctcctcacagttttcatccagccacgggccagcatgtctgggggcaaatacgtagactcggaggtaggcatccgtgggggggcgccggctcgggcgtgcggggagtgtccgcttctgctatctgcctctccaaatatcccgactgctgccctggccccagccctctctccacttcggagcactcctctggcgttggcaccgctgaggaatgggcctgggcggggaggtgaagagaagccaggaatgttttatgttttcctaatggagagggggcctcgggagcccctgagctaggaggacacggaaaaggggattggggtcctgagattgggtctgttgggcccaggacgcgttttctggatgggtctaggatgctcccctgtcgcgggacccccgcggtccggccctgcctgctgggggttcgaagaggtggagtgcagggtggaggtgttatttacccgagtcctggggacagtccccgggactctccgccaggcgcccagaccggcaggtcccgcaggcggcgcgcggtgtgtttgcactttccaaagttcttgaaccatctcaagaactccttctgcatcttggcgtctggcaggggtgttccgagagaggtagacctcccctccccaaactgccaccatcacttccaacgccctccacgcgctggagctctgcccgggtgtggaaacctcgtcttccaacacgtagctgcccttcagccacccgcccgcagcctgggagtgccctgagggtgggtcgggggagctgcgcagggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaagattgactttgaagatgtgattgcagaaccagaagggacacacagttttgacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaatgtccgcatcaacttgcagaaagaaatataaatgacatttcaaggatagaagtatacctgattttttttccttttaattttcctggtgccaatttcaagttccaagttgctaatacagcaacaatttatgaattgaattatcttggttgaaaataaaaagatcactttctcagttttcataagtattatgtctcttctgagctatttcatctatttttggcagtctgaatttttaaaacccatttaaatttttttccttacctttttatttgcatgtggatcaaccatcgctttattggctgagatatgaacatattgttgaaaggtaatttgagagaaatatgaagaactgaggaggaaaaaaaaaaaaagaaaagaaccaacaacctcaactgcctactccaaaatgttggtcattttatgttaagggaagaattccagggtatggccatggagtgtacaagtatgtgggcagattttcagcaaactcttttcccactgtttaaggagttagtggattactgccattcacttcataatccagtaggatccagtgatccttacaagttagaaaacataatcttctgccttctcatgatccaactaatgccttactcttcttgaaattttaacctatgatattttctgtgcctgaatatttgttatgtagataacaagacctcagtgccttcctgtttttcacattttccttttcaaatagggtctaactcagcaactcgctttaggtcagcagcctccctgaagaccaaaattagaatatccatgacctagttttccatgcgtgtttctgactctgagctacagagtctggtgaagctcacttctgggcttcatctggcaacatctttatccgtagtgggtatggttgacactagcccaatgaaatgaattaaagtggaccaatagggctgagctctctgtgggctggcagtcctggaagccagctttccctgcctctcatcaactgaatgaggtcagcatgtctattcagcttcgtttattttcaagaataatcacgctttcctgaatccaaactaatccatcaccggggtggtttagtggctcaacattgtgttcccatttcagctgatcagtgggcctccaaggaggggctgtaaaatggaggccattgtgtgagcctatcagagttgctgcaaacctgacccctgctcagtaaagcacttgcaaccgtctgttatgctgtgacacatggcccctccccctgccaggagctttggacctaatccaagcatccctttgcccagaaagaagatgggggaggaggcagtaataaaaagattgaagtattttgctggaataagttcaaattcttctgaactcaaactgaggaatttcacctgtaaacctgagtcgtacagaaagctgcctggtatatccaaaagctttttattcctcctgctcatattgtgattctgcctttggggacttttcttaaaccttcagttatgatttttttttcatacacttattggaactctgcttgatttttgcctcttccagtcttcctgacactttaattaccaacctgttacctactttgactttttgcatttaaaacagacactggcatggatatagttttacttttaaactgtgtacataactgaaaatgtgctatactgcatactttttaaatgtaaagatatttttatctttatatgaagaaaatcacttaggaaatggctttgtgattcaatctgtaaactgtgtattccaagacatgtctgttctacatagatgcttagtccctcatgcaaatcaattactggtccaaaagattgctgaaattttatatgcttactgatatattttacaattttttatcatgcatgtcctgtaaaggttacaagcctgcacaataaaaatgtttaacgggttaaa

SEQ ID NO: 312861 - DNA, 2875 bp, Homo sapiens
gggagaaacgttctcactcgctctctgctcgctgcgggcgctccccgccctctgctgccagaaccttggggatgtgcctagacccggcgcagcacacgtccgggccaaccgcgagcagaacaaacctttggcgggcggccaggaggctccctcccagccaccgcccccctccagcgcctttttttccccccatacaatacaagatcttccttcctcagttcccttaaagcacagcccagggaaacctcctcacagttttcatccagccacgggccagcatgtctgggggcaaatacgtagactcggagggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaagattgactttgaagatgtgattgcagaaccagaagggacacacagttttgacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaatgtccgcatcaacttgcagaaagaaatataaatgacatttcaaggatagaagtatacctgattttttttccttttaattttcctggtgccaatttcaagttccaagttgctaatacagcaacaatttatgaattgaattatcttggttgaaaataaaaagatcactttctcagttttcataagtattatgtctcttctgagctatttcatctatttttggcagtctgaatttttaaaacccatttaaatttttttccttacctttttatttgcatgtggatcaaccatcgctttattggctgagatatgaacatattgttgaaaggtaatttgagagaaatatgaagaactgaggaggaaaaaaaaaaaaagaaaagaaccaacaacctcaactgcctactccaaaatgttggtcattttatgttaagggaagaattccagggtatggccatggagtgtacaagtatgtgggcagattttcagcaaactcttttcccactgtttaaggagttagtggattactgccattcacttcataatccagtaggatccagtgatccttacaagttagaaaacataatcttctgccttctcatgatccaactaatgccttactcttcttgaaattttaacctatgatattttctgtgcctgaatatttgttatgtagataacaagacctcagtgccttcctgtttttcacattttccttttcaaatagggtctaactcagcaactcgctttaggtcagcagcctccctgaagaccaaaattagaatatccatgacctagttttccatgcgtgtttctgactctgagctacagagtctggtgaagctcacttctgggcttcatctggcaacatctttatccgtagtgggtatggttgacactagcccaatgaaatgaattaaagtggaccaatagggctgagctctctgtgggctggcagtcctggaagccagctttccctgcctctcatcaactgaatgaggtcagcatgtctattcagcttcgtttattttcaagaataatcacgctttcctgaatccaaactaatccatcaccggggtggtttagtggctcaacattgtgttcccatttcagctgatcagtgggcctccaaggaggggctgtaaaatggaggccattgtgtgagcctatcagagttgctgcaaacctgacccctgctcagtaaagcacttgcaaccgtctgttatgctgtgacacatggcccctccccctgccaggagctttggacctaatccaagcatccctttgcccagaaagaagatgggggaggaggcagtaataaaaagattgaagtattttgctggaataagttcaaattcttctgaactcaaactgaggaatttcacctgtaaacctgagtcgtacagaaagctgcctggtatatccaaaagctttttattcctcctgctcatattgtgattctgcctttggggacttttcttaaaccttcagttatgatttttttttcatacacttattggaactctgcttgatttttgcctcttccagtcttcctgacactttaattaccaacctgttacctactttgactttttgcatttaaaacagacactggcatggatatagttttacttttaaactgtgtacataactgaaaatgtgctatactgcatactttttaaatgtaaagatatttttatctttatatgaagaaaatcacttaggaaatggctttgtgattcaatctgtaaactgtgtattccaagacatgtctgttctacatagatgcttagtccctcatgcaaatcaattactggtccaaaagattgctgaaattttatatgcttactgatatattttacaattttttatcatgcatgtcctgtaaaggttacaagcctgcacaataaaaatgtttaacgggttaaaaaaaacacgcagagacgaagacaagacatgaagaggacacaggccaacgagaagcggaacacacaacaaaggagggggggcatataatatccggaggcgcaaaatgaaacccaataatagagagggcccacagaggggaataaacaagagggcgcgaaaaggtgggaa

SEQ ID NO: 312862 - DNA, 2689 bp, Homo sapiens
gggagaaacgttctcactcgctctctgctcgctgcgggcgctccccgccctctgctgccagaaccttggggatgtgcctagacccggcgcagcacacgtccgggccaaccgcgagcagaacaaacctttggcgggcggccaggaggctccctcccagccaccgcccccctccagcgcctttttttccccccatacaatacaagatcttccttcctcagttcccttaaagcacagcccagggaaacctcctcacagttttcatccagccacgggccagcatgtctgggggcaaatacgtagactcggagggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaagattgactttgaagatgtgattgcagaaccagaagggacacacagttttgacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaatgtccgcatcaacttgcagaaagaaatataaatgacatttcaaggatagaagtatacctgattttttttccttttaattttcctggtgccaatttcaagttccaagttgctaatacagcaacaatttatgaattgaattatcttggttgaaaataaaaagatcactttctcagttttcataagtattatgtctcttctgagctatttcatctatttttggcagtctgaatttttaaaacccatttaaatttttttccttacctttttatttgcatgtggatcaaccatcgctttattggctgagatatgaacatattgttgaaaggtaatttgagagaaatatgaagaactgaggaggaaaaaaaaaaaaagaaaagaaccaacaacctcaactgcctactccaaaatgttggtcattttatgttaagggaagaattccagggtatggccatggagtgtacaagtatgtgggcagattttcagcaaactcttttcccactgtttaaggagttagtggattactgccattcacttcataatccagtaggatccagtgatccttacaagttagaaaacataatcttctgccttctcatgatccaactaatgccttactcttcttgaaattttaacctatgatattttctgtgcctgaatatttgttatgtagataacaagacctcagtgccttcctgtttttcacattttccttttcaaatagggtctaactcagcaactcgctttaggtcagcagcctccctgaagaccaaaattagaatatccatgacctagttttccatgcgtgtttctgactctgagctacagagtctggtgaagctcacttctgggcttcatctggcaacatctttatccgtagtgggtatggttgacactagcccaatgaaatgaattaaagtggaccaatagggctgagctctctgtgggctggcagtcctggaagccagctttccctgcctctcatcaactgaatgaggtcagcatgtctattcagcttcgtttattttcaagaataatcacgctttcctgaatccaaactaatccatcaccggggtggtttagtggctcaacattgtgttcccatttcagctgatcagtgggcctccaaggaggggctgtaaaatggaggccattgtgtgagcctatcagagttgctgcaaacctgacccctgctcagtaaagcacttgcaaccgtctgttatgctgtgacacatggcccctccccctgccaggagctttggacctaatccaagcatccctttgcccagaaagaagatgggggaggaggcagtaataaaaagattgaagtattttgctggaataagttcaaattcttctgaactcaaactgaggaatttcacctgtaaacctgagtcgtacagaaagctgcctggtatatccaaaagctttttattcctcctgctcatattgtgattctgcctttggggacttttcttaaaccttcagttatgatttttttttcatacacttattggaactctgcttgatttttgcctcttccagtcttcctgacactttaattaccaacctgttacctactttgactttttgcatttaaaacagacactggcatggatatagttttacttttaaactgtgtacataactgaaaatgtgctatactgcatactttttaaatgtaaagatatttttatctttatatgaagaaaatcacttaggaaatggctttgtgattcaatctgtaaactgtgtattccaagacatgtctgttctacatagatgcttagtccctcatgcaaatcaattactggtccaaaagattgctgaaattttttttttaaccgttaaacatttttattgtgcaggcttgtaacctttacaggacatgcatgataaaaaatttta

SEQ ID NO: 312863 - DNA, 2152 bp, Homo sapiens
tactattatatataaaccccccctgataaaatattgtgtcctaatatataacttccccatgagccaaactgtttctcacggcgcccccgcacatattgcccgcttctggtatgataccaccactaataaaccctcctcgaaatgtttaatatatttatcctcttagtgagccttcttaatatattctctataggggaggtttgttcaccaacaatgtgccacccccaccgactgagtatagtggttccccttcaccaccaggtgtcccaccggttagacaccgttttcgcccgcctccagccgccttgttgttaccccccgcgcccccggtctcctctcgtctttattatattagaccgtccctcatctatgtgggcgcccccttttaccaccaaacggctgcggtcgccgcgcgttaacgtcggggccccctcaggggtgatttttgcgccccccccctttttttttttttttttttttttttttttttctttttatttgcatgtggatcaaccatcgctttattggctgagatatgaacatattgttgaaaggtaatttgagagaaatatgaagaactgaggaggaaaaaaaaaaaaagaaaagaaccaacaacctcaactgcctactccaaaatgttggtcattttatgttaagggaagaattccagggtatggccatggagtgtacaagtatgtgggcagattttcagcaaactcttttcccactgtttaaggagttagtggattactgccattcacttcataatccagtaggatccagtgatccttacaagttagaaaacataatcttctgccttctcatgatccaactaatgccttactcttcttgaaattttaacctatgatattttctgtgcctgaatatttgttatgtagataacaagacctcagtgccttcctgtttttcacattttccttttcaaatagggtctaactcagcaactcgctttaggtcagcagcctccctgaagaccaaaattagaatatccatgacctagttttccatgcgtgtttctgactctgagctacagagtctggtgaagctcacttctgggcttcatctggcaacatctttatccgtagtgggtatggttgacactagcccaatgaaatgaattaaagtggaccaatagggctgagctctctgtgggctggcagtcctggaagccagctttccctgcctctcatcaactgaatgaggtcagcatgtctattcagcttcgtttattttcaagaataatcacgctttcctgaatccaaactaatccatcaccggggtggtttagtggctcaacattgtgttcccatttcagctgatcagtgggcctccaaggaggggctgtaaaatggaggccattgtgtgagcctatcagagttgctgcaaacctgacccctgctcagtaaagcacttgcaaccgtctgttatgctgtgacacatggcccctccccctgccaggagctttggacctaatccaagcatccctttgcccagaaagaagatgggggaggaggcagtaataaaaagattgaagtattttgctggaataagttcaaattcttctgaactcaaactgaggaatttcacctgtaaacctgagtcgtacagaaagctgcctggtatatccaaaagctttttattcctcctgctcatattgtgattctgcctttggggacttttcttaaaccttcagttatgatttttttttcatacacttattggaactctgcttgatttttgcctcttccagtcttcctgacactttaattaccaacctgttacctactttgactttttgcatttaaaacagacactggcatggatatagttttacttttaaactgtgtacataactgaaaatgtgctatactgcatactttttaaatgtaaagatatttttatctttatatgaagaaaatcacttaggaaatggctttgtgattcaatctgtaaactgtgtattccaagacatgtctgttctacatagatgcttagtccctcatgcaaatcaattactggtccaaaagattgctgaaattttatatgcttactgatatattttacaattttttatcatgcatgtcctgtaaaggttacaagcctgcacaataaaaatgtttaacgggttaaa

SEQ ID NO: 312864 - DNA, 535 bp, Homo sapiens
  misc_feature (480)..(480): n is a, c, g, or t
  misc_feature (500)..(500): n is a, c, g, or t
gggagaaacgttctcactcgctctctgctcgctgcgggcgctccccgccctctgctgccagaaccttggggatgtgcctagacccggcgcagcacacgtccgggccaaccgcgagcagaacaaacctttggcgggcggccaggaggctccctcccagccaccgcccccctccagcgcctttttttccccccatacaatacaagatcttccttcctcagttcccttaaagcacagcccagggaaacctcctcacagttttcatccagccacgggccagcatgtctgggggcaaatacgtagactcggagggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaagaatttgncttttgaagatgttgatttncagaacccagaaggggggcaacaaaagttttttgt

SEQ ID NO: 312865 - DNA, 2045 bp, Homo sapiens
tgtgtgctaaagtcaacagtcgcttggtttgagctcaaataaatgcggggatgcctcggctcggagcagtcggcctcctccctccgcgagctggacgctccgcagcccgcccgccagccggcccgccggccgccgcaggaatccctggataaagaccagctcaaccatcgctgagaaaacagacctaggcttcccagggcggttaacccgccggcctctgggcagagactacaaaacaaaataaaacaacaacaaaaaactcccagtgtgtttcctactcttctttgtcttggaggaaagcaaagggagagaaatggacttcaccagtggtctttggcttcatcaattcacaggaaatggcatcaagatggttcaactaagacatgatcactaaaaacattataataatacctttttgaaaaactcagtttctcctgtttactaaatatttatttcatcaacatgggctgcgttccactgtgtcaggattctgcatgtgggtggagcactgttccagcctgagaagatggttctgaggccacttagcaagacattttccagcatgagcaggtttctctgtggaaatagtgacacctgttctggtgtgttgtctttcctcagggaacttaaggggtacaaagctcctgaaaatgttctttatgctggttgaagctcttatgtcgctgtactgattccctacgatgcagatttgaatcacagagtaattaaaatatggatcaaataaggctggggctcaccaaggctgaaagctgtagccattcaaggcatcatttctgtcatgaaaatataggaccttttcaaaacatgccttcaggaaggtgttctcttttcaaacaaaagtctaatgactgcataactcttcttgaccacatcttacactttctctagacttgcttatttacagctactggaacaaaaagatgaaatgaataaagcacactgattgtcctaagagtcttctgtgactaaaagcacatgagcttctccccaggctgagctttgaccctcccaagcatttccccaaaggccatgacactgcatcagattgctcctggacactttcctcagagttttcaacaaatataaactgaggagtggagcacagcaccagatttgctaatcaagaggcaatggtcccagtccaaatgggtgctgtgtgtgaatacagagcccaggagaagggaaggaggtctgtgaacatcaggaattgcaaaatcttgctgaaccaatagaccaacagccattaacatttgtcaatgcaaagatcctaaaatatacaagtgtggagttgtcctgccctaagagctgaagctgtgacaatcacgctgccatggtagatatttaagctcccctgaggttactgaatctaacaatgaataaacaatgaagagtagctaatttttggaaatctctttctatgaccggaaaatattcacaaactcagagtgattgtttggggtgaaagatggtcccatgccttgtgggcctctctttgctatctatacaacgttggaaatgaacccctcccttacaggaaagtgaacagcaaccaaggtgagcccaccctgggagggcagagtgggtgtactttcctcgaagagccctgaacacaacagggcacacaaacagccacagcaccctcaacaatgccccaccatctgcccaccagggcacacagattcacgcagattcagtgacacattccaaaaaaagggaattaaggaggacccatggcatggctaatggggagagagctttactacttttagcaccattgctaattattggagcaaagaaaggcatacaaggaatggaacccaacctgtttaaagtaataaatgtcaaccctaaagtgcatggaaccatctctccttcccttttgaggactgtgtgcttcacaagctgggcgtttgctgcatggggttttctaatgtaatgtgaattttcaatgtgctttgtctctgtagagtggctttaaaaagcccttgaagtcctcagctttaaatccatgctaataggggaag

SEQ ID NO: 312866 - DNA, 1990 bp, Homo sapiens
tgtgtgctaaagtcaacagtcgcttggtttgagctcaaataaatgcggggatgcctcggctcggagcagtcggcctcctccctccgcgagctggacgctccgcagcccgcccgccagccggcccgccggccgccgcaggaatccctggataaagaccagctcaaccatcgctgagaaaacagacctaggcttcccagggcggttaacccgccggcctctgggcagagactacaaaacaaaataaaacaacaacaaaaaactcccagtgtgtttcctactcttctttgtcttggaggaaagcaaagggagagaaatggacttcaccagtggtctttggcttcatcaattcacaggaaatggcatcaagatggttcaactaagacatgatcactaaaaacattataataatacctttttgaaaaactcagtttctcctgtttactaaatatttatttcatcaacatgggctgcgttccactgtgtcaggattctgcatgtgggtggagcactgttccagcctgagaagatggttctgaggccacttagcaagacattttccagcatgagcaggtttctctgtggaaatagtgacacctgttctggtgtgttgtctttcctcagggaacttaaggggtacaaagctcctgaaaatgttctttatgctggttgaagctcttatgtcgctgtactgattccctacgatgcagatttgaatcacagagtaattaaaatatggatcaaataaggctggggctcaccaaggctgaaagctgtagccattcaaggcatcatttctgtcatgaaaatataggaccttttcaaaacatgccttcaggaaggtgttctcttttcaaacaaaagtctaatgactgcataactcttcttgaccacatcttacactttctctagacttgcttatttacagctactggaacaaaaagatgaaatgaataaagcacactgattgtcctaagagtcttctgtgactaaaagccatgacactgcatcagattgctcctggacactttcctcagagttttcaacaaatataaactgaggagtggagcacagcaccagatttgctaatcaagaggcaatggtcccagtccaaatgggtgctgtgtgtgaatacagagcccaggagaagggaaggaggtctgtgaacatcaggaattgcaaaatcttgctgaaccaatagaccaacagccattaacatttgtcaatgcaaagatcctaaaatatacaagtgtggagttgtcctgccctaagagctgaagctgtgacaatcacgctgccatggtagatatttaagctcccctgaggttactgaatctaacaatgaataaacaatgaagagtagctaatttttggaaatctctttctatgaccggaaaatattcacaaactcagagtgattgtttggggtgaaagatggtcccatgccttgtgggcctctctttgctatctatacaacgttggaaatgaacccctcccttacaggaaagtgaacagcaaccaaggtgagcccaccctgggagggcagagtgggtgtactttcctcgaagagccctgaacacaacagggcacacaaacagccacagcaccctcaacaatgccccaccatctgcccaccagggcacacagattcacgcagattcagtgacacattccaaaaaaagggaattaaggaggacccatggcatggctaatggggagagagctttactacttttagcaccattgctaattattggagcaaagaaaggcatacaaggaatggaacccaacctgtttaaagtaataaatgtcaaccctaaagtgcatggaaccatctctccttcccttttgaggactgtgtgcttcacaagctgggcgtttgctgcatggggttttctaatgtaatgtgaattttcaatgtgctttgtctctgtagagtggctttaaaaagcccttgaagtcctcagctttaaatccatgctaataggggaag

SEQ ID NO: 312867 - DNA, 3428 bp, Homo sapiens
ggccggatcagctgactcgcctggctctgagccccgccgccgcgctcgggctccgtcagtttcctcggcagcggtaggcgagagcacgcggaggagcgtgcgcgggggccccgggagacggcggcggtggcggcgcgggcagagcaaggacgcggcggatcccactcgcacagcagcgcactcggtgccccgcgcagggtcgcgatgctgcccggtttggcactgctcctgctggccgcctggacggctcgggcgctggaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacattcttggaggagcaaaaaaaaaatggtgtg

SEQ ID NO: 312868 - DNA, 3653 bp, Homo sapiens
ggccggatcagctgactcgcctggctctgagccccgccgccgcgctcgggctccgtcagtttcctcggcagcggtaggcgagagcacgcggaggagcgtgcgcgggggccccgggagacggcggcggtggcggcgcgggcagagcaaggacgcggcggatcccactcgcacagcagcgcactcggtgccccgcgcagggtcgcgatgctgcccggtttggcactgctcctgctggccgcctggacggctcgggcgctggaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccatgtcccaaagtttactcaagactacccaggaacctcttgcccgagatcctgttaaacttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacattcttggaggagcaaaaaaaaaatggtgtg

SEQ ID NO: 312869 - DNA, 661 bp, Homo sapiens
ggccggatcagctgactcgcctggctctgagccccgccgccgcgctcgggctccgtcagtttcctcggcagcggtaggcgagagcacgcggaggagcgtgcgcgggggccccgggagacggcggcggtggcggcgcgggcagagcaaggacgcggcggatcccactcgcacagcagcgcactcggtgccccgcgcagggtcgcgatgctgcccggtttggcactgctcctgctggccgcctggacggctcgggcgctggaggtggcgtttcgctcttgttacctgggccggagtgcagtggtgcgatcttggctcaccgcaacctccgcctcctgggttcaagcgattctcctgcctcagcctcctgagtagctgggattacgggtggcctcttactatctttacatccatgtgaatgtgtgtgctttgatgtgtacatatgagagacaagaacaaaagtaaatgtcaaatatccgaattcctgtttcagtgagctttcacggagtaaattctttttgtctacttgcctgtgatctcttctaatatgacttgcgttaatgacctttaagaaatcttttaataaaataaaaaattttattaaaatcttttaataaaaaaattttattaaaatcttctaataaaaaattttattaaaatcttc

SEQ ID NO: 312870 - DNA, 3023 bp, Homo sapiens
tgagatgaagtataaagcgttgagctcaacgctttatacttcccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataac

SEQ ID NO: 312871 - DNA, 3080 bp, Homo sapiens
tgagatgaagtataaagcgttgagctcaacgctttatacttcccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccatgtcccaaagtttactcaagactacccaggaacctcttgcccgagatcctgttaaacttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataac

SEQ ID NO: 312872 - DNA, 2990 bp, Homo sapiens
acatgttcatagctgcttcttgagggtaaaacaacgtcaggcgagaccgaactgatttgcttccatgtttcctgagctgcaaaattgcgccaaggtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataac

SEQ ID NO: 312873 - DNA, 3294 bp, Homo sapiens
tgagatgaagtataaagcgttgagctcaacgctttatacttcccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacattcttggaggagcaaaaaaaaaatggtgtg

SEQ ID NO: 312874 - DNA, 2011 bp, Homo sapiens
ggatctagaggatcccttgcatatggcaagggccaagcacgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataac

SEQ ID NO: 312875 - DNA, 3264 bp, Homo sapiens
tgagatgaagtataaagcgttgagctcaacgctttatacttcccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaataca

SEQ ID NO: 312876 - DNA, 2969 bp, Homo sapiens
tgagatgaagtataaagcgttgagctcaacgctttatacttcccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataac

SEQ ID NO: 312877 - DNA, 1652 bp, Homo sapiens
tgtcgacacctaagcatcggcattcgcatgtggatccaaaatgcgctcagatcggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataac

SEQ ID NO: 312878 - DNA, 2973 bp, Homo sapiens
tgagatgaagtataaagcgttgagctcaacgctttatacttcccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattgcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataac

SEQ ID NO: 312879 - DNA, 2987 bp, Homo sapiens
tgagatgaagtataaagcgttgagctcaacgctttatacttcccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataac

SEQ ID NO: 312880 - DNA, 1868 bp, Homo sapiens
tgagatgaagtataaagcgttgagctcaacgctttatacttcccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataac

SEQ ID NO: 312881 - DNA, 2565 bp, Homo sapiens
tgagatgaagtataaagcgttgagctcaacgctttatacttcccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttagtctgatgacacggtacgagctcgattgtatcatgtt

SEQ ID NO: 312882 - DNA, 2477 bp, Homo sapiens
tgagatgaagtataaagcgttgagctcaacgctttatacttcccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtggcggggcttctagttctgcatctgctcaaagaacttgtaggttggattttcgta

SEQ ID NO: 312883 - DNA, 2364 bp, Homo sapiens
tgagatgaagtataaagcgttgagctcaacgctttatacttcccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcgccgagagacaaggtagagccgagagacaaggtagagacgagagacaaggt

SEQ ID NO: 312884 - DNA, 1028 bp, Homo sapiens
  misc_feature (54)..(54): n is a, c, g, or t
  misc_feature (56)..(56): n is a, c, g, or t
  misc_feature (58)..(58): n is a, c, g, or t
  misc_feature (60)..(60): n is a, c, g, or t
agagagagagagagagagagagagagagagagagagagagagagagagagaganantngnggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataac

SEQ ID NO: 312885 - DNA, 2477 bp, Homo sapiens
tgagatgaagtataaagcgttgagctcaacgctttatacttcccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggggcaaccgggacaatccga

SEQ ID NO: 312886 - DNA, 2498 bp, Homo sapiens
tgagatgaagtataaagcgttgagctcaacgctttatacttcccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttcggcatctttatcggccgatgaagatgccgttttcgctgggtcaacagtacttgccgcagtactcttaaaactaggcggctatggtataatacgcctcacactcattctcaaccccctgacaccacacatagcctaccccttccttgtactatccctatgaggcataattataacaagctccatctgcctacgacaaacagacctaaaatcgctcattgcatactcttcaatcagccacatagccctcgtagtaacagccattctcatccaaccccctgaagcttcaccggcgcagtcattctcataatcgcccacggacttacatcctcattactattctgcctacatactcaaactacga

SEQ ID NO: 312887 - DNA, 2299 bp, Homo sapiens
tgagatgaagtataaagcgttgagctcaacgctttatacttcccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttgagttcatttgaaaacgcatatgcccatgccatcaatgacgctggggacgttgtcggcagctacaaggatcagcttggcaacgcccatgcttacctgagcagcgcccaaggcaccatcatcgaaattggcccccaaccaggcgtcaccaactatcgtggtctg

SEQ ID NO: 312888 - DNA, 2085 bp, Homo sapiens
tgagatgaagtataaagcgttgagctcaacgctttatacttcccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacgtggctctgagccgggagaaacttggctcctgagccgcgagaaacctggctctgagccggg

SEQ ID NO: 312889 - DNA, 2158 bp, Homo sapiens
tgagatgaagtataaagcgttgagctcaacgctttatacttcccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggacttgtcacaccacctgagtcctgtaagtaggagagtgatatttgatcaggagaacgtggttactagcacagagagttctcccagtaggttaatagtggggggtaaggcgaggttagcgaggcttgctagaagtcatcaaaagctattagtgggagtagagtttgaagtctgagagaggattatgatcgacttggtcatcgg

SEQ ID NO: 312890 - DNA, 2008 bp, Homo sapiens
tgagatgaagtataaagcgttgagctcaacgctttatacttcccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattgttaaatttgctgtttgttacagaaatgcgggtctcaaacaagacgcaatcacttgactttgatggcgtgtttcatagctcgtctcctggtgttacctca

SEQ ID NO: 312891 - DNA, 1942 bp, Homo sapiens
tgagatgaagtataaagcgttgagctcaacgctttatacttcccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatgttttggggaaaaaaatttaaccaccagggaaaagaaatgactaagcaaaagaaggtgtgctctgcagcacacgatggtgagtat

SEQ ID NO: 312892 - DNA, 2091 bp, Homo sapiens
tgagatgaagtataaagcgttgagctcaacgctttatacttcccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccagtctgggttgtgattgcatttagactctaaacggaacctgaattaataggaaataaacacggtactatagttgtcctatggtgcccctatgggtgatgggttccaagaaccccctaggatactaaagtccatgatgttcaagtcccttatagaaaatggtgtagtatttgcatataacctgtgcacatcctaccatacactttaaatcatctctagattacctataatagctaatacaatgtaaatgctttgtaaatagttgttatactatattgtgtctaaat

SEQ ID NO: 312893 - DNA, 1984 bp, Homo sapiens
  misc_feature (1616)..(1616): n is a, c, g, or t
  misc_feature (1720)..(1720): n is a, c, g, or t
tgagatgaagtataaagcgttgagctcaacgctttatacttcccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttggtgcagtggctcatgcctgtaattccagcattttgggaggccaaggtgggcagatgacttgagcccagaagttcaagaccagantgggaaacatggcaagaccacatttctacaaaaaaattatccaggcatgataacatctatttgtagtcccagctactcaggaggctgtggtgggaggatctccngagcctggggtggctgaggctgcagtgagccttgatcacgccacctgggcaatagagcaagaccctgtctcaaaaaaaggaagaaaaagactattatttcccccattgaatggtcttggcactattacacaaaatcaattgtccatagataatatgggtttatttcttaattcttagttcttttctttgatctgtgtgcctgtgcttactgtagtaccacactgttttgattattgtagctttgtagtaaattttgaaatcagc

SEQ ID NO: 312894 - DNA, 1400 bp, Homo sapiens
tgagatgaagtataaagcgttgagctcaacgctttatacttcccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctgaagaagtatgtcatgtcataagaggtagacagtggagcgaccgaggctcagaaagaggctgtgtctttaccac

SEQ ID NO: 312895 - DNA, 1125 bp, Homo sapiens
tgagatgaagtataaagcgttgagctcaacgctttatacttcccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccagcatgagagaatgggaagaggcagaacgccggatgcaagcttggtctaaggtctgcc

SEQ ID NO: 312896 - DNA, 1165 bp, Homo sapiens
tgagatgaagtataaagcgttgagctcaacgctttatacttcccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccatgtcccaaagtttactcaagactacccaggaacctcttgcccgagatcctgttaaacgtacgttgtcattcacctgagggaagggaagaggggaggaggatgctgcttggttcacataactccagcatcatcaccttctttgcatggttttgtgtttcttgaacacctgtcttagtaaaatgtttcttcccattaccttgcttgtaattacatctgattttgccagacag

SEQ ID NO: 312897 - DNA, 826 bp, Homo sapiens
tgagatgaagtataaagcgttgagctcaacgctttatacttcccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgaggtggcaatgctggtggttctctctgtgcttcttcgtaggttcctcaacagatccgggcc

SEQ ID NO: 312898 - DNA, 731 bp, Homo sapiens
tgagatgaagtataaagcgttgagctcaacgctttatacttcccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaataca

SEQ ID NO: 312899 - DNA, 675 bp, Homo sapiens
tgagatgaagtataaagcgttgagctcaacgctttatacttcccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttaggtgagccggccggccgtggggctggtgttgattgggggcctggtcttgagggaagaaaaagaggatgctcctgttaggtcacatacacagacttgttcttcagcacattgccactctgtgttgtactgtgttttggactcttgcagttacattctgtgcactgaccctataggagcagtatttttgagttccctgcctcagaatgaatttacccagggtgtatattgaaattacaaattcctgggccagttccaggactcctgaatgaaaaatgcctatagtagcggatccgggaattcttattttaccgtatcgcatagatgattctcatgaacaggggccttgtgtgtttcttcacatagactttctagaagaaagaatctaatgtgaagctgcagcattttgttaatttctaaaa

SEQ ID NO: 312900 - DNA, 466 bp, Homo sapiens
tgagatgaagtataaagcgttgagctcaacgctttatacttcccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccctcaacgctttatacttcctcaacgctttatacttcctcaacgctttatactttctcaacgctttatacttcctcaacgctttatacttccgtattgaattcaagtttaatattaagtatgcatggacctctaagctatatgaagtataaag

SEQ ID NO: 312901 - DNA, 286 bp, Homo sapiens
gtgtataacaagtcttccccattcatccaactctcgaacattcagctaacgcctgtgcacaatgactgtttttctttacatctgaagatgcttagaagttgtttgcatgacagttgggccagaggaggctgtatttcacttcggacttcggttgggttcctgtttggcatcttaacatttgcaaccttccttacccgtttttcccctcttttcccccagcctcctagtaattttccaaaagaaaaaaagcaatttccgggcagatgttttcctgtaattccactga

SEQ ID NO: 312902 - DNA, 389 bp, Homo sapiens
ggtaaaggtctaagatcataaatctctgatgccctttccttaaaagtaaggaattcttgtcttggattcttatataatatacttatttataatctcacttgttctgattgcaggtggcctcttactatctttacatccatgtgaatgtgtgtgctttgatgtgtacatatgagagacaagaacaaaagtaaatgtcaaatatccgaattcctgtttcagtgagctttcacggagtaaattctttttgtctacttgcctgtgatctcttctaatatgacttgcgttaatgacctttaagaaatcttttaataaaataaaaaattttattaaaatcttttaataaaaaaattttattaaaatcttctaataaaaaattttattaaaatctt

SEQ ID NO: 312903 - DNA, 616 bp, Homo sapiens
tgagatgaagtataaagcgttgagctcaacgctttatacttcccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaagtagtagaagtataaagcgtgaggggatcctctaatctcacca

SEQ ID NO: 312904 - DNA, 1374 bp, Homo sapiens
ggccggatcagctgactcgcctggctctgagccccgccgccgcgctcgggctccgtcagtttcctcggcagcggtaggcgagagcacgcggaggagcgtgcgcgggggccccgggagacggcggcggtggcggcgcgggcagagcaaggacgcggcggatcccactcgcacagcagcgcactcggtgccccgcgcagggtcgcgatgctgcccggtttggcactgctcctgctggccgcctggacggctcgggcgctggaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagagaagtggtataaggaagtacattctggccaggcacgatggctcatgctgtaatcccagcactttgggaggccgaggtgggtgcatcacctgaggtcaggagtttgagaccagcctggccaacatggtgaaacccctcgctactaaaaatacaaaaattagccgggcgtggtggcacacacctgtggtcccagctactcgggaggctgaagcaggagaatcgcttgaacccgggagacggaggttgcagtaagccgagttcactccattgtactctagcctgggtgacagagcgagattcgtctc

SEQ ID NO: 312905 - DNA, 2855 bp, Homo sapiens
tgagatgaagtataaagcgttgagctcaacgctttatacttcccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataac

SEQ ID NO: 312906 - DNA, 2819 bp, Homo sapiens
tcatctagaggatcccgtgtcatcccccttcgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataac

SEQ ID NO: 312907 - DNA, 2268 bp, Homo sapiens
acagggcttggtaacccgagcctcccggcaacgtatacccgggcgcaagtggaagaaggaaccccacagtcattgccaccaccaccaccaccaccacagagtctgtggaagaggtggttcgagtgtcccaaagtttactcaagactacccaggaacctcttgcccgagatcctgttaaacttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataac

SEQ ID NO: 312908 - DNA, 3356 bp, Homo sapiens
tgagatgaagtataaagcgttgagctcaacgctttatacttcccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacaataaagaaggacaataagttattttccttctttattgtacgattctaactgggtctatcagttcatctttaaattgttaagtaagataagat

SEQ ID NO: 312909 - DNA, 1735 bp, Homo sapiens
tagaggatcccccggtgtgtcatgcatcgtgggtagtccagagtgtgtgttcatgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataac

SEQ ID NO: 312910 - DNA, 2961 bp, Homo sapiens
tgagatgaagtataaagcgttgagctcaacgctttatacttcccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagtcttcaattaccaagaattctccaaaacaattttctgcaggatgattgtacagaatcattgcttatgacatgatcgctttctacactgtattacataaataaattaaataaaataac

SEQ ID NO: 312911 - DNA, 2341 bp, Homo sapiens
tgagatgaagtataaagcgttgagctcaacgctttatacttcccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccatgtcccaaagtttactcaagactacccaggaacctcttgcccgagatcctgttaaacttcctacaacagcagccagtacccctgatgccgttgacaagtatctcgagacacctggggatgagaatgaacatgcccatttccagaaagccaaagagaggcttgaggccaagcaccgagagagaatgtcccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataac

SEQ ID NO: 312912 - DNA, 1688 bp, Homo sapiens
aggctagaaagctagttccagcctgacagtttcatcgtaaaagccaagctgttctattaacttccatattcctcaaacagataactcacttcctcaattttcctctgggggaaaatacatgtccatgtgcagcatcaaaagaacagcttacttaccaacttcatcctgaacctcctcggccactgcaggcacgttgtatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataac

SEQ ID NO: 312913 - DNA, 2969 bp, Homo sapiens
tgagatgaagtataaagcgttgagctcaacgctttatacttcccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataac

SEQ ID NO: 312914 - DNA, 2502 bp, Homo sapiens
tgagatgaagtataaagcgttgagctcaacgctttatacttcccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgaggagataagcaggacctgcagttagatattatttcctgtactcgtcc

SEQ ID NO: 312915 - DNA, 3178 bp, Homo sapiens
tgagatgaagtataaagcgttgagctcaacgctttatacttcccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacattcttggaggagcaaaaaaaaaatggtgtg

SEQ ID NO: 312916 - DNA, 1020 bp, Homo sapiens
ggtacccagatccccctttccatcccacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataac

SEQ ID NO: 312917 - DNA, 2331 bp, Homo sapiens
tgagatgaagtataaagcgttgagctcaacgctttatacttcccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttgaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcactttaattgcccacagaa

SEQ ID NO: 312918 - DNA, 2106 bp, Homo sapiens
  misc_feature (2058)..(2058): n is a, c, g, or t
  misc_feature (2060)..(2060): n is a, c, g, or t
  misc_feature (2065)..(2066): n is a, c, g, or t
  misc_feature (2068)..(2068): n is a, c, g, or t
  misc_feature (2077)..(2077): n is a, c, g, or t
  misc_feature (2082)..(2082): n is a, c, g, or t
tgagatgaagtataaagcgttgagctcaacgctttatacttcccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggagtnanccgcnntnaccccagangagcncacatcgtaacgggcgagctgata

SEQ ID NO: 312919 - DNA, 2086 bp, Homo sapiens
tgagatgaagtataaagcgttgagctcaacgctttatacttcccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggacttgtgatatgacaggcgcacagcgcaagctagcaaccctgcagatcgagtagaagagacccaccaatactaggatcaccattttgatagagtgtagacgttggagtcatatcctgagaggactcaacg

SEQ ID NO: 312920 - DNA, 1970 bp, Homo sapiens
tgagatgaagtataaagcgttgagctcaacgctttatacttcccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggttctatgcagaagatgtgggtcctccgcgtcgtctgtttaccctcaggagcgagctatga

SEQ ID NO: 312921 - DNA, 1791 bp, Homo sapiens
tgagatgaagtataaagcgttgagctcaacgctttatacttcccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaaggtagagcctgacgagtgccagcggaatcctgggaggt

SEQ ID NO: 312922 - DNA, 1561 bp, Homo sapiens
tgagatgaagtataaagcgttgagctcaacgctttatacttcccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttggtaagtaagctgttcttttgatgctgcac

SEQ ID NO: 312923 - DNA, 1227 bp, Homo sapiens
tgagatgaagtataaagcgttgagctcaacgctttatacttcccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccagcatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatct

SEQ ID NO: 312924 - DNA, 1132 bp, Homo sapiens
tgagatgaagtataaagcgttgagctcaacgctttatacttcccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccatgtcccaaagtttactcaagacggacaccagtgtgatcttattagctgaagtcaagggaccactgatctcctctgccacctggggcagcttctctagcagcatgtccagctgagcagcctcttggtacagctggaaggcttctgccttcttggccatctgctcagcctcggctcgggctcgggcccctatggcaaag

SEQ ID NO: 312925 - DNA, 775 bp, Homo sapiens
  misc_feature (661)..(661): n is a, c, g, or t
tgagatgaagtataaagcgttgagctcaacgctttatacttcccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaagtagtagaagtataaagcgttgagctcaacgcttatacttcattagctctagaggtccatgcatacttaatattatacttgaattcantacggaagtataaagcgttgagaagtataaagcgttgagaagtataaagcgttgagaagtataaagcgttgagaagtataaagcgttgagaagtaaagcgttgagaaatataag

SEQ ID NO: 312926 - DNA, 725 bp, Homo sapiens
tgagatgaagtataaagcgttgagctcaacgctttatacttcccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagggtaaggtggcctttgtgttcagcctcagagatgctgaaacatcttgtatggagtatttgtatcctgtaaattaatctttctgtttatcactgaaaaggtctctgcccactcccatcagagtctgctgttatgcaaaaatctgaactatgaatttttatgg

SEQ ID NO: 312927 - DNA, 441 bp, Homo sapiens
tgagatgaagtataaagcgttgagctcaacgctttatacttcccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgacgccattctcgtctctcagggttgtctgttctgtcatggggctcactcaggatgctggagactcttctgttcatcggaaccccggcggatgggatatgtcatgtgtggatactgaattatgtcttgagtagagagtgttggagggaggttgtccatggggtcagg

SEQ ID NO: 312928 - DNA, 678 bp, Homo sapiens
  misc_feature (610)..(610): n is a, c, g, or t
actacatacttccggaccaaacccaagggaccacacagcccattctgctccgattccagaaaaaaacacatttgaagcatgaattctcagcagcagaagcagccttgcaccccaccccctcagcctcagcagcagcaggtgaaacaaccttgccagcctccaccccaggaaccatgcatccccaaaaccaaggagccctgccaacccaaggtgcctgagccctgccaccccaaagtgcctgagccctgccagcccaagattccagagccctgccagcccaaggtgcctgagccctgcccttcaacggtcactccagcaccagcccagcagaagaccaagcagaagtaatgtggtccacagccatgcccttgaggagctggccactggatactgaacaccctactccattctgcttatgaatcccatttgcctattgaccctgcagttagcatgctgtcaccctgaatcataatcgctcctttgcacctctaaaaagatgtcccttaccctcattctggagggctcctgagcctctgcgtaaggctgaacgtctcactgactgagctagtcttcttgttgctcgggtgcatttgaggatggatttgggganggatcaagtgaaccatccctagtcttccctcaataaataacttttaactccaaaaaaaacagtcgacg

SEQ ID NO: 312929 - DNA, 623 bp, Homo sapiens
  misc_feature (555)..(555): n is a, c, g, or t
gactcaggatgtcaaggtggcacatttaggagtagcaggaattctgagcccctgtacactatcatgtcactgttcacttatctacacagggcgcggggatgcactggaccggacctcaccatgactcctccctcttgctgccctgccaacccaaggtgcctgagccctgccaccccaaagtgcctgagccctgccagcccaagattccagagccctgccagcccaaggtgcctgagccctgcccttcaacggtcactccagcaccagcccagcagaagaccaagcagaagtaatgtggtccacagccatgcccttgaggagctggccactggatactgaacaccctactccattctgcttatgaatcccatttgcctattgaccctgcagttagcatgctgtcaccctgaatcataatcgctcctttgcacctctaaaaagatgtcccttaccctcattctggagggctcctgagcctctgcgtaaggctgaacgtctcactgactgagctagtcttcttgttgctcgggtgcatttgaggatggatttgggganggatcaagtgaaccatccctagtcttccctcaataaataacttttaactccaaaaaaaacagtcgacg

SEQ ID NO: 312930 - DNA, 550 bp, Homo sapiens
  misc_feature (482)..(482): n is a, c, g, or t
tcggtacccatctcgtgaccggcgattatatctgaatatggaaccatgcatccccaaaaccaaggagccctgccaacccaaggtgcctgagccctgccaccccaaagtgcctgagccctgccagcccaagattccagagccctgccagcccaaggtgcctgagccctgcccttcaacggtcactccagcaccagcccagcagaagaccaagcagaagtaatgtggtccacagccatgcccttgaggagctggccactggatactgaacaccctactccattctgcttatgaatcccatttgcctattgaccctgcagttagcatgctgtcaccctgaatcataatcgctcctttgcacctctaaaaagatgtcccttaccctcattctggagggctcctgagcctctgcgtaaggctgaacgtctcactgactgagctagtcttcttgttgctcgggtgcatttgaggatggatttgggganggatcaagtgaaccatccctagtcttccctcaataaataacttttaactccaaaaaaaacagtcgacg

SEQ ID NO: 312931 - DNA, 651 bp, Homo sapiens
  misc_feature (18)..(18): n is a, c, g, or t
  misc_feature (37)..(38): n is a, c, g, or t
gggcgcgcagccctgganagaagagttggtttttttnnagccatcgggttaaacaagaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaccaaaatttatcatcctaatgtagacaagttgggaagaatatgtttagatattttgaaagataagtggtccccagcactgcagatccgcacagttctgctatcgatccaggccttgttaagtgctcccaatccagatgatccattagcaaatgatgtagcggagcagtggaagaccaacgaagcccaagccatagaaacagcaagtctaactttatttagacgctgtagatggacaagcttgattgttggaaccaaaatgggaacattaaacaaacatcacagccctcactaataacattgctgtcaagtgtagattccccccttcaaaaaaagcttgtgaccattttgtatggcttgtctggaaacttctgtaaatcttatgttttagtaaaatattttttgttatt

SEQ ID NO: 312932 - DNA, 673 bp, Homo sapiens
gtccccttcggcttgtttcctagtctcttgtcctctgcattcattgcctcatcttccgccattccccctggacccggtttgggttgtgggctttctactggttgacgtggtgtcccatgttcggatgggaagcccccgcccgtgcccgagcccgcgcccgagcagggactacatttcccgaggggcctcggcggcggctgcggcgacgggcgcggcaacgtcccccggaagtggagcccgggacttccactcgtgcgtgaggcgagaggagccggagacgagaccagaggccgaactcgggttctgacaagatggccgggctgccccgcaggatcatcaaggtaaccgcccaggccggcctccagctcttcgctctgctctcgtcggctcagctgggcaggcagcgcggcctctcgcctccttcggcccgcggcccgctctgggaggcccgaggcggcgcggagaggggttggccgcggcggcgagggaagtcgggtgctgaggagggggcgccggggagacttccggccgcggcggggcagccggacagcggggacccggggcttccaggcggctgcccggcgggccagggagtgctgtcccacgccccggcggagggtggggcggcaaggctgggggtctctgggcttgggcgcgggcctccatagcttct

SEQ ID NO: 312933 - DNA, 292 bp, Homo sapiens
agggtaaaacgaggcccagcgattcctgaagattgacctgcgttgtttcctggcggaaaaccaggtctttagaatatgctctagccaagtctaactttatttagacgctgtagatggacaagcttgattgttggaaccaaaatgggaacattaaacaaacatcacagccctcactaataacattgctgtcaagtgtagattccccccttcaaaaaaagcttgtgaccattttgtatggcttgtctggaaacttctgtaaatcttatgttttagtaaaatattttttgttatt

SEQ ID NO: 312934 - DNA, 2656 bp, Homo sapiens
  misc_feature (2639)..(2639): n is a, c, g, or t
acggttaagagagacgcgcgcgcagtcgcgcgggggtcgtgccgtaccaccgtcgcgggcaggctcggccacgagcgccagagccccgcgcctcccctcgcggcctgtcccaagtccctgccccgcaacagagcgtcacttccgccatccccggcagcggttggggcggggcgcacgggggagggggccaggtcggagggaagcccgcccgtgcccgagcccgcgcccgagcagggactacatttcccgaggggcctcggcggcggctgcggcgacgggcgcggcaacgtcccccggaagtggagcccgggacttccactcgtgcgtgaggcgagaggagccggagacgagaccagaggccgaactcgggttctgacaagatggccgggctgccccgcaggatcatcaaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaccaaaatttatcatcctaatgtagacaagttgggaagaatatgtttagatattttgaaagataagtggtccccagcactgcagatccgcacagttctgctatcgatccaggccttgttaagtgctcccaatccagatgatccattagcaaatgatgtagcggagcagtggaagaccaacgaagcccaagccatagaaacagctagagcatggactaggctatatgccatgaataatatttaaattgatacgatcatcaagtgtgcatcacttctcctgttctgccaagacttcctcctctttgtttgcatttaatggacacagtcttagaaacattacagaataaaaaagcccagacatcttcagtcctttggtgattaaatgcacattagcaaatctatgtcttgtcctgattcactgtcataaagcatgagcagaggctagaagtatcatctggattgttgtgaaacgtttaaaagcagtggcccctccctgcttttattcatttcccccatcctggtttaagtataaagcactgtgaatgaaggtagttgtcaggttagctgcaggggtgtgggtgtttttattttattttattttattttatttttgaggggggaggtagtttaattttatgggctcctttcccccttttttggtgatctaattgcattggttaaaagcagctaaccaggtctttagaatatgctctagccaagtctaactttatttagacgctgtagatggacaagcttgattgttggaaccaaaatgggaacattaaacaaacatcacagccctcactaataacattgctgtcaagtgtagattccccccttcaaaaaaagcttgtgaccattttgtatggcttgtctggaaacttctgtaaatcttatgttttagtaaaatattttttgttattctactttgcctttgtacagtttattttactgtgtttatttcattttcccaatttgacaatcgtattttaaaattgaaactgatggaacattctttcttggtcttcaccatctgacaaattgaatggcaagaggtggattttgccagtttcttttcactgatgcagatttgtgttaagatagtactgaatggagtatttataaactggccctgagcatgcataaagcatcagtatctgacctttttttaaccttctaggaatttgaaataaatgtgtttgtgttgtctgattagatgatcattggtgtcttgccacaatgtttaaaaattactgtacaggaaagtcacagcaaagatagcagttgtgactgacatgtaggactttcacagttgtgccacatttttgcctaaaatttgggttatgacatttttcttggttcttatctgaaaatttcatctgtaacctttcatgtgtgttaagaaacactgatctgatcatttgggatttgctgaggcatttgtgagtcttccttataaacctgatgagcagatctcaactatctagcttgtgtgtcatcagaaaggtttatccctttgagagtatcaagtcctcagttaatgattcttgctttcatccctccagtatttgctgtgggagctcgttttattctttaatttggaattcagtaatttttcttctttattgacgaattcctcccctcacaaaactgttctttcccacctctctccatatctaattcctgattcttgttatttttaagtcataaatgtagccagtcataaatacataaatgttaaccttcgggttgcaaccttgtctcttgcagtttaaggtaatggatattgtagcccatttgaattttcttcactcttattctcgtaattctggagtttcttcagattgtggtgtattttattgtgctcctatgtaagatgaagaattaactattaaaattacattttcaacataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatattaaaaaaaaaaaaaaaacaaaaaaaaaaanaaacaaacaaacaaaaa

SEQ ID NO: 312935 - DNA, 2478 bp, Homo sapiens
acggttaagagagacgcgcgcgcagtcgcgcgggggtcgtgccgtaccaccgtcgcgggcaggctcggccacgagcgccagagccccgcgcctcccctcgcggcctgtcccaagtccctgccccgcaacagagcgtcacttccgccatccccggcagcggttggggcggggcgcacgggggagggggccaggtcggagggaagcccgcccgtgcccgagcccgcgcccgagcagggactacatttcccgaggggcctcggcggcggctgcggcgacgggcgcggcaacgtcccccggaagtggagcccgggacttccactcgtgcgtgaggcgagaggagccggagacgagaccagaggccgaactcgggttctgacaagatggccgggctgccccgcaggatcatcaaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaccaaaatttatcatcctaatgtagacaagttgggaagaatatgtttagatattttgaaagataagtggtccccagcactgcagatccgcacagttctgctatcgatccaggccttgttaagtgctcccaatccagatgatccattagcaaatgatgtagcggagcagtggaagaccaacgaagcccaagccatagaaacagctagagcatggactaggctatatgccatgaataatatttaaattgatacgatcatcaagtgtgcatcacttctcctgttctgccaagacttcctcctctttgtttgcatttaatggacacagtcttagaaacattacagaataaaaaagcccagacatcttcagtcctttggtgattaaatgcacattagcaaatctatgtcttgtcctgattcactgtcataaagcatgagcagaggctagaagtatcatctggattgttgtgaaacgtttaaaagcagtggcccctccctgcttttattcatttcccccatcctggtttaagtataaagcactgtgaatgaaggtagttgtcaggttagctgcaggggtgtgggtgtttttattttattttattttattttatttttgaggggggaggtagtttaattttatgggctcctttcccccttttttggtgatctaattgcattggttaaaagcagctaaccaggtctttagaatatgctctagccaagtctaactttatttagacgctgtagatggacaagcttgattgttggaaccaaaatgggaacattaaacaaacatcacagccctcactaataacattgctgtcaagtgtagattccccccttcaaaaaaagcttgtgaccattttgtatggcttgtctggaaacttctgtaaatcttatgttttagtaaaatattttttgttattctactttgcctttgtacagtttattttactgtgtttatttcattttcccaatttgacaatcgtattttaaaattgaaactgatggaacattctttcttggtcttcaccatctgacaaattgaatggcaagaggtggattttgccagtttcttttcactgatgcagatttgtgttaagatagtactgaatggagtatttataaactggccctgagcatgcataaagcatcagtatctgacctttttttaaccttctaggaatttgaaataaatgtgtttgtgttgtctgattagatgatcattggtgtcttgccacaatgtttaaaaattactgtacaggaaagtcacagcaaagatagcagttgtgactgacatgtaggactttcacagttgtgccacatttttgcctaaaatttgggttatgacatttttcttggttcttatctgaaaatttcatctgtaacttgggatttgctgaggcatttgtgagtcttccttataaacctgatgagcagatctcaactatctagcttgtgtgtcatcagaaaggtttatccctttgagagtatcaagtcctcagttaatgattcttgctttcatccctccagtatttgctgtgggagctcgttttattctttaatttggaattcagtaatttttcttctttattgacgaattcctcccctcacaaaactgttctttcccacctctctccatatctaattcctgattcttgttatttttaagtcataaatgtagccagtcataaatacataaatgttaaccttcgggttgcaaccttgtctcttgcagtttaaggtaatggatattgtagcccatttgaattttcttcactcttattctcgtaattctggagtttcttcagattgtggtgtattttattgtgctcctatgtaagatgaagaattaactattaaaattacattttcaacataaaaaa

SEQ ID NO: 312936 - DNA, 2216 bp, Homo sapiens
  misc_feature (21)..(22): n is a, c, g, or t
aggctagtacgaggcggtgtnnatcggccgagggcgagaggagccggagacgagaccagaggccgaactcgggttctgacaagatggccgggctgccccgcaggatcatcaaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaccaaaatttatcatcctaatgtagacaagttgggaagaatatgtttagatattttgaaagataagtggtccccagcactgcagatccgcacagttctgctatcgatccaggccttgttaagtgctcccaatccagatgatccattagcaaatgatgtagcggagcagtggaagaccaacgaagcccaagccatagaaacagctagagcatggactaggctatatgccatgaataatatttaaattgatacgatcatcaagtgtgcatcacttctcctgttctgccaagacttcctcctctttgtttgcatttaatggacacagtcttagaaacattacagaataaaaaagcccagacatcttcagtcctttggtgattaaatgcacattagcaaatctatgtcttgtcctgattcactgtcataaagcatgagcagaggctagaagtatcatctggattgttgtgaaacgtttaaaagcagtggcccctccctgcttttattcatttcccccatcctggtttaagtataaagcactgtgaatgaaggtagttgtcaggttagctgcaggggtgtgggtgtttttattttattttattttattttatttttgaggggggaggtagtttaattttatgggctcctttcccccttttttggtgatctaattgcattggttaaaagcagctaaccaggtctttagaatatgctctagccaagtctaactttatttagacgctgtagatggacaagcttgattgttggaaccaaaatgggaacattaaacaaacatcacagccctcactaataacattgctgtcaagtgtagattccccccttcaaaaaaagcttgtgaccattttgtatggcttgtctggaaacttctgtaaatcttatgttttagtaaaatattttttgttattctactttgcctttgtacagtttattttactgtgtttatttcattttcccaatttgacaatcgtattttaaaattgaaactgatggaacattctttcttggtcttcaccatctgacaaattgaatggcaagaggtggattttgccagtttcttttcactgatgcagatttgtgttaagatagtactgaatggagtatttataaactggccctgagcatgcataaagcatcagtatctgacctttttttaaccttctaggaatttgaaataaatgtgtttgtgttgtctgattagatgatcattggtgtcttgccacaatgtttaaaaattactgtacaggaaagtcacagcaaagatagcagttgtgactgacatgtaggactttcacagttgtgccacatttttgcctaaaatttgggttatgacatttttcttggttcttatctgaaaatttcatctgtaacctttcatgtgtgttaagaaacactgatctgatcatttgggatttgctgaggcatttgtgagtcttccttataaacctgatgagcagatctcaactatctagcttgtgtgtcatcagaaaggtttatccctttgagagtatcaagtcctcagttaatgattcttgctttcatccctccagtatttgctgtgggagctcgttttattctttaatttggaattcagtaatttttcttctttattgacgaattcctcccctcacaaaactgttctttcccacctctctccatatctaattcctgattcttgttatttttaagtcataaatgtagccagtcataaatacataaatgttaaccttcgggttgcaaccttgtctcttgcagtttaaggtaatggatattgtagcccatttgaattttcttcactcttattctcgtaattctggagtttcttcagattgtggtgtattttattgtgctcctatgtaagatgaagaattaactattaaaattacattttcaacataaaaaa

SEQ ID NO: 312937 - DNA, 1518 bp, Homo sapiens
acggttaagagagacgcgcgcgcagtcgcgcgggggtcgtgccgtaccaccgtcgcgggcaggctcggccacgagcgccagagccccgcgcctcccctcgcggcctgtcccaagtccctgccccgcaacagagcgtcacttccgccatccccggcagcggttggggcggggcgcacgggggagggggccaggtcggagggaagcccgcccgtgcccgagcccgcgcccgagcagggactacatttcccgaggggcctcggcggcggctgcggcgacgggcgcggcaacgtcccccggaagtggagcccgggacttccactcgtgcgtgaggcgagaggagccggagacgagaccagaggccgaactcgggttctgacaagatggccgggctgccccgcaggatcatcaaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaccaaaatttatcatcctaatgtagacaagttgggaagaatatgtttagatattttgaaagataagtggtccccagcactgcagatccgcacagttctgctatcgatccaggccttgttaagtgctcccaatccagatgatccattagcaaatgatgtagcggagcagtggaagaccaacgaagcccaagccatagaaacagctagagcatggactaggctatatgccatgaataatatttaaattgatacgatcatcaagtgtgcatcacttctcctgttctgccaagacttcctcctctttgtttgcatttaatggacacagtcttagaaacattacagaataaaaaagcccagacatcttcagtcctttggtgattaaatgcacattagcaaatctatgtcttgtcctgattcactgtcataaagcatgagcagaggctagaagtatcatctggattgttgtgaaacgtttaaaagcagtggcccctccctgcttttattcatttcccccatcctggtttaagtataaagcactgtgaatgaaggtagttgtcaggttagctgcaggggtgtgggtgtttttattttattttattttattttatttttgaggggggaggtagtttaattttatgggctcctttcccccttttttggtgatctaattgcattggttaaaagcagctaaccaggtctttagaatatgctctagccaagtctaactttatttagacgctgtagatggacaagcttgattgttggaaccaaaatgggaacattaaacaaacatcacagccctcactaataacattgctgtcaagtgtagattccccccttcaaaaaaagcttgtgaccattttgtatggcttgtctggaaacttctgtaaatcttatgttttagtaaaatattttttgttatt

SEQ ID NO: 312938 - DNA, 2612 bp, Homo sapiens
acggttaagagagacgcgcgcgcagtcgcgcgggggtcgtgccgtaccaccgtcgcgggcaggctcggccacgagcgccagagccccgcgcctcccctcgcggcctgtcccaagtccctgccccgcaacagagcgtcacttccgccatccccggcagcggttggggcggggcgcacgggggagggggccaggtcggagggaagcccgcccgtgcccgagcccgcgcccgagcagggactacatttcccgaggggcctcggcggcggctgcggcgacgggcgcggcaacgtcccccggaagtggagcccgggacttccactcgtgcgtgaggcgagaggagccggagacgagaccagaggccgaactcgggttctgacaagatggccgggctgccccgcaggatcatcaagttatgatggcttcactgagaaaacatgaagatcttaggagctgagggagcaagccatatggatatcttggggaggaagaggaagtacaaagcccttgaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaccaaaatttatcatcctaatgtagacaagttgggaagaatatgtttagatattttgaaagataagtggtccccagcactgcagatccgcacagttctgctatcgatccaggccttgttaagtgctcccaatccagatgatccattagcaaatgatgtagcggagcagtggaagaccaacgaagcccaagccatagaaacagctagagcatggactaggctatatgccatgaataatatttaaattgatacgatcatcaagtgtgcatcacttctcctgttctgccaagacttcctcctctttgtttgcatttaatggacacagtcttagaaacattacagaataaaaaagcccagacatcttcagtcctttggtgattaaatgcacattagcaaatctatgtcttgtcctgattcactgtcataaagcatgagcagaggctagaagtatcatctggattgttgtgaaacgtttaaaagcagtggcccctccctgcttttattcatttcccccatcctggtttaagtataaagcactgtgaatgaaggtagttgtcaggttagctgcaggggtgtgggtgtttttattttattttattttattttatttttgaggggggaggtagtttaattttatgggctcctttcccccttttttggtgatctaattgcattggttaaaagcagctaaccaggtctttagaatatgctctagccaagtctaactttatttagacgctgtagatggacaagcttgattgttggaaccaaaatgggaacattaaacaaacatcacagccctcactaataacattgctgtcaagtgtagattccccccttcaaaaaaagcttgtgaccattttgtatggcttgtctggaaacttctgtaaatcttatgttttagtaaaatattttttgttattctactttgcctttgtacagtttattttactgtgtttatttcattttcccaatttgacaatcgtattttaaaattgaaactgatggaacattctttcttggtcttcaccatctgacaaattgaatggcaagaggtggattttgccagtttcttttcactgatgcagatttgtgttaagatagtactgaatggagtatttataaactggccctgagcatgcataaagcatcagtatctgacctttttttaaccttctaggaatttgaaataaatgtgtttgtgttgtctgattagatgatcattggtgtcttgccacaatgtttaaaaattactgtacaggaaagtcacagcaaagatagcagttgtgactgacatgtaggactttcacagttgtgccacatttttgcctaaaatttgggttatgacatttttcttggttcttatctgaaaatttcatctgtaacctttcatgtgtgttaagaaacactgatctgatcatttgggatttgctgaggcatttgtgagtcttccttataaacctgatgagcagatctcaactatctagcttgtgtgtcatcagaaaggtttatccctttgagagtatcaagtcctcagttaatgattcttgctttcatccctccagtatttgctgtgggagctcgttttattctttaatttggaattcagtaatttttcttctttattgacgaattcctcccctcacaaaactgttctttcccacctctctccatatctaattcctgattcttgttatttttaagtcataaatgtagccagtcataaatacataaatgttaaccttcgggttgcaaccttgtctcttgcagtttaaggtaatggatattgtagcccatttgaattttcttcactcttattctcgtaattctggagtttcttcagattgtggtgtattttattgtgctcctatgtaagatgaagaattaactattaaaattacattttcaacataaaaaa

SEQ ID NO: 312939 - DNA, 2690 bp, Homo sapiens
tttgtttcttcagtgcattctgcgatatctttttcttctgggcaacctcctcttctggtttaggaacaatctgttccttttccgtaaggatcatctcaatgtggcaggagagctcatgtatgggttaatccgaccatgagctctgtaggtccggcggcgcatcttaggtgctttgttcacttggatatgctcaatgaccagagaatctacatctaaacccttaagttcagcattactctctgcgtttttaagcatgtgcagcaaaaattcagcactctttttgggccaccgaccttgtgtccagccccattgcttggcctgcgcacacctgccaactccaccattgtaacgtcggaatggtacacactgtttctgtaaagtgacatctttcagatacttcgtggcttttcgtatatgcatacccttgatggcctgagcagtttcacgagtgttcttaaagtgaacacgaagattggaacctcttgatttgcatgatttcgtggggttctccgggtcaagtgaatagcgaaccattttcacagatcacctcagacaagatggccgggctgccccgcaggatcatcaaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaccaaaatttatcatcctaatgtagacaagttgggaagaatatgtttagatattttgaaagataagtggtccccagcactgcagatccgcacagttctgctatcgatccaggccttgttaagtgctcccaatccagatgatccattagcaaatgatgtagcggagcagtggaagaccaacgaagcccaagccatagaaacagctagagcatggactaggctatatgccatgaataatatttaaattgatacgatcatcaagtgtgcatcacttctcctgttctgccaagacttcctcctctttgtttgcatttaatggacacagtcttagaaacattacagaataaaaaagcccagacatcttcagtcctttggtgattaaatgcacattagcaaatctatgtcttgtcctgattcactgtcataaagcatgagcagaggctagaagtatcatctggattgttgtgaaacgtttaaaagcagtggcccctccctgcttttattcatttcccccatcctggtttaagtataaagcactgtgaatgaaggtagttgtcaggttagctgcaggggtgtgggtgtttttattttattttattttattttatttttgaggggggaggtagtttaattttatgggctcctttcccccttttttggtgatctaattgcattggttaaaagcagctaaccaggtctttagaatatgctctagccaagtctaactttatttagacgctgtagatggacaagcttgattgttggaaccaaaatgggaacattaaacaaacatcacagccctcactaataacattgctgtcaagtgtagattccccccttcaaaaaaagcttgtgaccattttgtatggcttgtctggaaacttctgtaaatcttatgttttagtaaaatattttttgttattctactttgcctttgtacagtttattttactgtgtttatttcattttcccaatttgacaatcgtattttaaaattgaaactgatggaacattctttcttggtcttcaccatctgacaaattgaatggcaagaggtggattttgccagtttcttttcactgatgcagatttgtgttaagatagtactgaatggagtatttataaactggccctgagcatgcataaagcatcagtatctgacctttttttaaccttctaggaatttgaaataaatgtgtttgtgttgtctgattagatgatcattggtgtcttgccacaatgtttaaaaattactgtacaggaaagtcacagcaaagatagcagttgtgactgacatgtaggactttcacagttgtgccacatttttgcctaaaatttgggttatgacatttttcttggttcttatctgaaaatttcatctgtaacctttcatgtgtgttaagaaacactgatctgatcatttgggatttgctgaggcatttgtgagtcttccttataaacctgatgagcagatctcaactatctagcttgtgtgtcatcagaaaggtttatccctttgagagtatcaagtcctcagttaatgattcttgctttcatccctccagtatttgctgtgggagctcgttttattctttaatttggaattcagtaatttttcttctttattgacgaattcctcccctcacaaaactgttctttcccacctctctccatatctaattcctgattcttgttatttttaagtcataaatgtagccagtcataaatacataaatgttaaccttcgggttgcaaccttgtctcttgcagtttaaggtaatggatattgtagcccatttgaattttcttcactcttattctcgtaattctggagtttcttcagattgtggtgtattttattgtgctcctatgtaagatgaagaattaactattaaaattacattttcaacataaaaaa

SEQ ID NO: 312940 - DNA, 1682 bp, Homo sapiens
  misc_feature (1665)..(1665): n is a, c, g, or t
acggttaagagagacgcgcgcgcagtcgcgcgggggtcgtgccgtaccaccgtcgcgggcaggctcggccacgagcgccagagccccgcgcctcccctcgcggcctgtcccaagtccctgccccgcaacagagcgtcacttccgccatccccggcagcggttggggcggggcgcacgggggagggggccaggtcggagggaagcccgcccgtgcccgagcccgcgcccgagcagggactacatttcccgaggggcctcggcggcggctgcggcgacgggcgcggcaacgtcccccggaagtggagcccgggacttccactcgtgcgtgaggcgagaggagccggagacgagaccagaggccgaactcgggttctgacaagatggccgggctgccccgcaggatcatcaaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaccaaaatttatcatcctaatgtagacaagttgggaagaatatgtttagatattttgaaagataagtggtccccagcactgcagatccgcacagttctgctatcgatccaggccttgttaagtgctcccaatccagatgatccattagcaaatgatgtagcggagcagtggaagaccaacgaagcccaagccatagaaacagctagagcatggactaggctatatgccatgaataatatttaaattgatacgatcatcaagtgtgcatcacttctcctgttctgccaagacttcctcctctttgtttgcatttaatggacacagtcttagaaacattacagaataaaaaagcccagacatcttcagtcctttggtgattaaatgcacattagcaaatctatgtcttgtcctgattcactgtcataaagcatgagcagaggctagaagtatcatctggattgttgtgaaacgtttaaaagcagtggcccctccctgcttttattcatttcccccatcctggtttaagtataaagcactgtgaatgaaggtagttgtcaggttagctgcaggggtgtgggtgtttttattttattttattttattttatttttgaggggggaggtagtttaattttatgggctcctttcccccttttttggtgatctaattgcattggttaaaagcagctaaccaggtctttagaatatgctctagccaagtctaactttatttagacgctgtagatggacaagcttgattgttggaaccaaaatgggaacattaaacaaacatcacagccctcactaataacattgctgtcaagtgtagattccccccttcaaaaaaagcttgtgaccattttgtatggcttgtctggaaacttctgtaaatcttatgttttagtaaaatattttttgttattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatattaaaaaaaaaaaaaaaacaaaaaaaaaaanaaacaaacaaacaaaaa

SEQ ID NO: 312941 - DNA, 2146 bp, Homo sapiens
cggcagccaagcccctcttctccgccccgacggggccgcggaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaccaaaatttatcatcctaatgtagacaagttgggaagaatatgtttagatattttgaaagataagtggtccccagcactgcagatccgcacagttctgctatcgatccaggccttgttaagtgctcccaatccagatgatccattagcaaatgatgtagcggagcagtggaagaccaacgaagcccaagccatagaaacagctagagcatggactaggctatatgccatgaataatatttaaattgatacgatcatcaagtgtgcatcacttctcctgttctgccaagacttcctcctctttgtttgcatttaatggacacagtcttagaaacattacagaataaaaaagcccagacatcttcagtcctttggtgattaaatgcacattagcaaatctatgtcttgtcctgattcactgtcataaagcatgagcagaggctagaagtatcatctggattgttgtgaaacgtttaaaagcagtggcccctccctgcttttattcatttcccccatcctggtttaagtataaagcactgtgaatgaaggtagttgtcaggttagctgcaggggtgtgggtgtttttattttattttattttattttatttttgaggggggaggtagtttaattttatgggctcctttcccccttttttggtgatctaattgcattggttaaaagcagctaaccaggtctttagaatatgctctagccaagtctaactttatttagacgctgtagatggacaagcttgattgttggaaccaaaatgggaacattaaacaaacatcacagccctcactaataacattgctgtcaagtgtagattccccccttcaaaaaaagcttgtgaccattttgtatggcttgtctggaaacttctgtaaatcttatgttttagtaaaatattttttgttattctactttgcctttgtacagtttattttactgtgtttatttcattttcccaatttgacaatcgtattttaaaattgaaactgatggaacattctttcttggtcttcaccatctgacaaattgaatggcaagaggtggattttgccagtttcttttcactgatgcagatttgtgttaagatagtactgaatggagtatttataaactggccctgagcatgcataaagcatcagtatctgacctttttttaaccttctaggaatttgaaataaatgtgtttgtgttgtctgattagatgatcattggtgtcttgccacaatgtttaaaaattactgtacaggaaagtcacagcaaagatagcagttgtgactgacatgtaggactttcacagttgtgccacatttttgcctaaaatttgggttatgacatttttcttggttcttatctgaaaatttcatctgtaacctttcatgtgtgttaagaaacactgatctgatcatttgggatttgctgaggcatttgtgagtcttccttataaacctgatgagcagatctcaactatctagcttgtgtgtcatcagaaaggtttatccctttgagagtatcaagtcctcagttaatgattcttgctttcatccctccagtatttgctgtgggagctcgttttattctttaatttggaattcagtaatttttcttctttattgacgaattcctcccctcacaaaactgttctttcccacctctctccatatctaattcctgattcttgttatttttaagtcataaatgtagccagtcataaatacataaatgttaaccttcgggttgcaaccttgtctcttgcagtttaaggtaatggatattgtagcccatttgaattttcttcactcttattctcgtaattctggagtttcttcagattgtggtgtattttattgtgctcctatgtaagatgaagaattaactattaaaattacattttcaacataaaaaa

SEQ ID NO: 312942 - DNA, 2457 bp, Homo sapiens
acggttaagagagacgcgcgcgcagtcgcgcgggggtcgtgccgtaccaccgtcgcgggcaggctcggccacgagcgccagagccccgcgcctcccctcgcggcctgtcccaagtccctgccccgcaacagagcgtcacttccgccatccccggcagcggttggggcggggcgcacgggggagggggccaggtcggagggaagcccgcccgtgcccgagcccgcgcccgagcagggactacatttcccgaggggcctcggcggcggctgcggcgacgggcgcggcaacgtcccccggaagtggagcccgggacttccactcgtgcgtgaggcgagaggagccggagacgagaccagaggccgaactcgggttctgacaagatggccgggctgccccgcaggatcatcaaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaccaaaatttatcatcctaatgtagacaagttgggaagaatatgtttagatattttgaaagataagtggtccccagcactgcagatccgcacagttctgctatcgatccaggccttgttaagtgctcccaatccagatgatccattagcaaatgatgtagcggagcagtggaagaccaacgaagcccaagccatagaaacagctagagcatggactaggctatatgccatgaataatatttaaattgatacgatcatcaagtgtgcatcacttctcctgttctgccaagacttcctcctctttgtttgcatttaatggacacagtcttagaaacattacagaattgtcttgtcctgattcactgtcataaagcatgagcagaggctagaagtatcatctggattgttgtgaaacgtttaaaagcagtggcccctccctgcttttattcatttcccccatcctggtttaagtataaagcactgtgaatgaaggtagttgtcaggttagctgcaggggtgtgggtgtttttattttattttattttattttatttttgaggggggaggtagtttaattttatgggctcctttcccccttttttggtgatctaattgcattggttaaaagcagctaaccaggtctttagaatatgctctagccaagtctaactttatttagacgctgtagatggacaagcttgattgttggaaccaaaatgggaacattaaacaaacatcacagccctcactaataacattgctgtcaagtgtagattccccccttcaaaaaaagcttgtgaccattttgtatggcttgtctggaaacttctgtaaatcttatgttttagtaaaatattttttgttattctactttgcctttgtacagtttattttactgtgtttatttcattttcccaatttgacaatcgtattttaaaattgaaactgatggaacattctttcttggtcttcaccatctgacaaattgaatggcaagaggtggattttgccagtttcttttcactgatgcagatttgtgttaagatagtactgaatggagtatttataaactggccctgagcatgcataaagcatcagtatctgacctttttttaaccttctaggaatttgaaataaatgtgtttgtgttgtctgattagatgatcattggtgtcttgccacaatgtttaaaaattactgtacaggaaagtcacagcaaagatagcagttgtgactgacatgtaggactttcacagttgtgccacatttttgcctaaaatttgggttatgacatttttcttggttcttatctgaaaatttcatctgtaacctttcatgtgtgttaagaaacactgatctgatcatttgggatttgctgaggcatttgtgagtcttccttataaacctgatgagcagatctcaactatctagcttgtgtgtcatcagaaaggtttatccctttgagagtatcaagtcctcagttaatgattcttgctttcatccctccagtatttgctgtgggagctcgttttattctttaatttggaattcagtaatttttcttctttattgacgaattcctcccctcacaaaactgttctttcccacctctctccatatctaattcctgattcttgttatttttaagtcataaatgtagccagtcataaatacataaatgttaaccttcgggttgcaaccttgtctcttgcagtttaaggtaatggatattgtagcccatttgaattttcttcactcttattctcgtaattctggagtttcttcagattgtggtgtattttattgtgctcctatgtaagatgaagaattaactattaaaattacattttcaacataaaaaa

SEQ ID NO: 312943 - DNA, 2459 bp, Homo sapiens
acggttaagagagacgcgcgcgcagtcgcgcgggggtcgtgccgtaccaccgtcgcgggcaggctcggccacgagcgccagagccccgcgcctcccctcgcggcctgtcccaagtccctgccccgcaacagagcgtcacttccgccatccccggcagcggttggggcggggcgcacgggggagggggccaggtcggagggaagcccgcccgtgcccgagcccgcgcccgagcagggactacatttcccgaggggcctcggcggcggctgcggcgacgggcgcggcaacgtcccccggaagtggagcccgggacttccactcgtgcgtgaggcgagaggagccggagacgagaccagaggccgaactcgggttctgacaagatggccgggctgccccgcaggatcatcaaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaccaaaaataagtggtccccagcactgcagatccgcacagttctgctatcgatccaggccttgttaagtgctcccaatccagatgatccattagcaaatgatgtagcggagcagtggaagaccaacgaagcccaagccatagaaacagctagagcatggactaggctatatgccatgaataatatttaaattgatacgatcatcaagtgtgcatcacttctcctgttctgccaagacttcctcctctttgtttgcatttaatggacacagtcttagaaacattacagaataaaaaagcccagacatcttcagtcctttggtgattaaatgcacattagcaaatctatgtcttgtcctgattcactgtcataaagcatgagcagaggctagaagtatcatctggattgttgtgaaacgtttaaaagcagtggcccctccctgcttttattcatttcccccatcctggtttaagtataaagcactgtgaatgaaggtagttgtcaggttagctgcaggggtgtgggtgtttttattttattttattttattttatttttgaggggggaggtagtttaattttatgggctcctttcccccttttttggtgatctaattgcattggttaaaagcagctaaccaggtctttagaatatgctctagccaagtctaactttatttagacgctgtagatggacaagcttgattgttggaaccaaaatgggaacattaaacaaacatcacagccctcactaataacattgctgtcaagtgtagattccccccttcaaaaaaagcttgtgaccattttgtatggcttgtctggaaacttctgtaaatcttatgttttagtaaaatattttttgttattctactttgcctttgtacagtttattttactgtgtttatttcattttcccaatttgacaatcgtattttaaaattgaaactgatggaacattctttcttggtcttcaccatctgacaaattgaatggcaagaggtggattttgccagtttcttttcactgatgcagatttgtgttaagatagtactgaatggagtatttataaactggccctgagcatgcataaagcatcagtatctgacctttttttaaccttctaggaatttgaaataaatgtgtttgtgttgtctgattagatgatcattggtgtcttgccacaatgtttaaaaattactgtacaggaaagtcacagcaaagatagcagttgtgactgacatgtaggactttcacagttgtgccacatttttgcctaaaatttgggttatgacatttttcttggttcttatctgaaaatttcatctgtaacctttcatgtgtgttaagaaacactgatctgatcatttgggatttgctgaggcatttgtgagtcttccttataaacctgatgagcagatctcaactatctagcttgtgtgtcatcagaaaggtttatccctttgagagtatcaagtcctcagttaatgattcttgctttcatccctccagtatttgctgtgggagctcgttttattctttaatttggaattcagtaatttttcttctttattgacgaattcctcccctcacaaaactgttctttcccacctctctccatatctaattcctgattcttgttatttttaagtcataaatgtagccagtcataaatacataaatgttaaccttcgggttgcaaccttgtctcttgcagtttaaggtaatggatattgtagcccatttgaattttcttcactcttattctcgtaattctggagtttcttcagattgtggtgtattttattgtgctcctatgtaagatgaagaattaactattaaaattacattttcaacataaaaaa

SEQ ID NO: 312944 - DNA, 1455 bp, Homo sapiens
acggttaagagagacgcgcgcgcagtcgcgcgggggtcgtgccgtaccaccgtcgcgggcaggctcggccacgagcgccagagccccgcgcctcccctcgcggcctgtcccaagtccctgccccgcaacagagcgtcacttccgccatccccggcagcggttggggcggggcgcacgggggagggggccaggtcggagggaagcccgcccgtgcccgagcccgcgcccgagcagggactacatttcccgaggggcctcggcggcggctgcggcgacgggcgcggcaacgtcccccggaagtggagcccgggacttccactcgtgcgtgaggcgagaggagccggagacgagaccagaggccgaactcgggttctgacaagatggccgggctgccccgcaggatcatcaaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaccaaaatttatcatcctaatgtagacaagttgggaagaatatgtttagatattttgaaagataagtggtccccagcactgcagatccgcacagttctgctatcgatccaggccttgttaagtgctcccaatccagatgatccattagcaaatgatgtagcggagcagtggaagaccaacgaagcccaagccatagaaacagctagagcatggactaggctatatgccatgaataatatttaaattgatacgatcatcaagtgtgcatcacttctcctgttctgccaagacttcctcctctttgtttgcatttaatggacacagtcttagaaacattacagaataaaaaagcccagacatcttcagtcctttggtgattaaatgcacattagcaaatctatgtcttgtcctgattcactgtcataaagcatgagcagaggctagaagtatcatctggattgttgtgaaacgtttaaaagcagtggcccctccctgcttttattcatttcccccatcctggtttaagtataaagcactgtgaatgaaggtagttgtcaggttagctgcaggggtgtgggtgtttttattttattttattttattttatttttgaggggggaggtagtacagagaaagcaatgacctcgccagcaaggcgggcaccaagaagcaggagcagcaagaacagttcgtgtaaccagtctaccagcactacagaaccctagacagctaggcttagcctctcatgcctaccttcattgtactttatcactaaagatcacctttcacaaacataacagtcctaataaactcgagggctggcccgtgccacaattcgcctatagaaaggctatttaca

SEQ ID NO: 312945 - DNA, 996 bp, Homo sapiens
acggttaagagagacgcgcgcgcagtcgcgcgggggtcgtgccgtaccaccgtcgcgggcaggctcggccacgagcgccagagccccgcgcctcccctcgcggcctgtcccaagtccctgccccgcaacagagcgtcacttccgccatccccggcagcggttggggcggggcgcacgggggagggggccaggtcggagggaagcccgcccgtgcccgagcccgcgcccgagcagggactacatttcccgaggggcctcggcggcggctgcggcgacgggcgcggcaacgtcccccggaagtggagcccgggacttccactcgtgcgtgaggcgagaggagccggagacgagaccagaggccgaactcgggttctgacaagatggccgggctgccccgcaggatcatcaaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaccaaaatttatcatcctaatgtagacaagttgggaagaatatgtttagatattttgaaagataagtggtccccagcactgcagatccgcacagttctgctatcgatccaggccttgttaagtgctcccaatccagatgatccattagcaaatgatgtagcggagcagtggaagaccaacgaagcccaagccatagaaacagctagagcatggactaggctatatgccatgaataatatttaaattgatacgatcatcaagtgtgcatcacttctcctgttctgccaagacttcctcctctttgtttgcatttaatggacacagtcttagaaacattacagaataaaaaagcccagacatcttcagtcctttggtgattaaatgcacattagcaaatcta

SEQ ID NO: 312946 - DNA, 1306 bp, Homo sapiens
cggacgcgtgggctttagaatatgctctagccaagtctaacgacctggttagctgcttttaaccaatgcaattagatcaccaggtctttagaatatgctctagccaagtctaactttatttagacgctgtagatggacaagcttgattgttggaaccaaaatgggaacattaaacaaacatcacagccctcactaataacattgctgtcaagtgtagattccccccttcaaaaaaagcttgtgaccattttgtatggcttgtctggaaacttctgtaaatcttatgttttagtaaaatattttttgttattctactttgcctttgtacagtttattttactgtgtttatttcattttcccaatttgacaatcgtattttaaaattgaaactgatggaacattctttcttggtcttcaccatctgacaaattgaatggcaagaggtggattttgccagtttcttttcactgatgcagatttgtgttaagatagtactgaatggagtatttataaactggccctgagcatgcataaagcatcagtatctgacctttttttaaccttctaggaatttgaaataaatgtgtttgtgttgtctgattagatgatcattggtgtcttgccacaatgtttaaaaattactgtacaggaaagtcacagcaaagatagcagttgtgactgacatgtaggactttcacagttgtgccacatttttgcctaaaatttgggttatgacatttttcttggttcttatctgaaaatttcatctgtaacctttcatgtgtgttaagaaacactgatctgatcatttgggatttgctgaggcatttgtgagtcttccttataaacctgatgagcagatctcaactatctagcttgtgtgtcatcagaaaggtttatccctttgagagtatcaagtcctcagttaatgattcttgctttcatccctccagtatttgctgtgggagctcgttttattctttaatttggaattcagtaatttttcttctttattgacgaattcctcccctcacaaaactgttctttcccacctctctccatatctaattcctgattcttgttatttttaagtcataaatgtagccagtcataaatacataaatgttaaccttcgggttgcaaccttgtctcttgcagtttaaggtaatggatattgtagcccatttgaattttcttcactcttattctcgtaattctggagtttcttcagattgtggtgtattttattgtgctcctatgtaagatgaagaattaactattaaaattacattttcaacataaaaaa

SEQ ID NO: 312947 - DNA, 1005 bp, Homo sapiens
acggttaagagagacgcgcgcgcagtcgcgcgggggtcgtgccgtaccaccgtcgcgggcaggctcggccacgagcgccagagccccgcgcctcccctcgcggcctgtcccaagtccctgccccgcaacagagcgtcacttccgccatccccggcagcggttggggcggggcgcacgggggagggggccaggtcggagggaagcccgcccgtgcccgagcccgcgcccgagcagggactacatttcccgaggggcctcggcggcggctgcggcgacgggcgcggcaacgtcccccggaagtggagcccgggacttccactcgtgcgtgaggcgagaggagccggagacgagaccagaggccgaactcgggttctgacaagatggccgggctgccccgcaggatcatcaaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaccaaaatttatcatcctaatgtagacaagttgggaagaatatgtttagatattttgaaagataagtggtccccagcactgcagatccgcacagttctgctatcgatccaggccttgttaagtgctcccaatccagatgatccattagcaaatgatgtagcggagcagtggaagaccaacgaagcccaagccatagaaacagcaagtctaactttatttagacgctgtagatggacaagcttgattgttggaaccaaaatgggaacattaaacaaacatcacagccctcactaataacattgctgtcaagtgtagattccccccttcaaaaaaagcttgtgaccattttgtatggcttgtctggaaacttctgtaaatcttatgttttagtaaaatattttttgttatt

SEQ ID NO: 312948 - DNA, 937 bp, Homo sapiens
acggttaagagagacgcgcgcgcagtcgcgcgggggtcgtgccgtaccaccgtcgcgggcaggctcggccacgagcgccagagccccgcgcctcccctcgcggcctgtcccaagtccctgccccgcaacagagcgtcacttccgccatccccggcagcggttggggcggggcgcacgggggagggggccaggtcggagggaagcccgcccgtgcccgagcccgcgcccgagcagggactacatttcccgaggggcctcggcggcggctgcggcgacgggcgcggcaacgtcccccggaagtggagcccgggacttccactcgtgcgtgaggcgagaggagccggagacgagaccagaggccgaactcgggttctgacaagatggccgggctgccccgcaggatcatcaaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaccaaaatttatcatcctaatgtagacaagttgggaagaatatgtttagatattttgaaagataagtggtccccagcactgcagatccgcacagttctgctatcgatccaggccttgttaagtgctcccaatccagatgatccctagagcatggactaggctatatgccatgaataatatttaaattgatacgatcatcaagtgtgcatcacttctcctgttctgccaagacttcctcctctttgtttgcatttaatggacacagtcttagaaacattacagaataaaaaagcccagacatcttcagtcctttggtgattaaatgcacattagcaaatcta

SEQ ID NO: 312949 - DNA, 666 bp, Homo sapiens
acggttaagagagacgcgcgcgcagtcgcgcgggggtcgtgccgtaccaccgtcgcgggcaggctcggccacgagcgccagagccccgcgcctcccctcgcggcctgtcccaagtccctgccccgcaacagagcgtcacttccgccatccccggcagcggttggggcggggcgcacgggggagggggccaggtcggagggaagcccgcccgtgcccgagcccgcgcccgagcagggactacatttcccgaggggcctcggcggcggctgcggcgacgggcgcggcaacgtcccccggaagtggagcccgggacttccactcgtgcgtgaggcgagaggagccggagacgagaccagaggccgaactcgggttctgacaagatggccgggctgccccgcaggatcatcaaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaccaaaatttatcatcctaatgtagacaagttgacatgtagattgagtagtgccagactagtccaagtct

SEQ ID NO: 312950 - DNA, 419 bp, Homo sapiens
atttaaatatgaacatttttctggttaaaaataaatataagtagaagttagactatttttccccatacctgagtggctccttttgttttccttccataatgtgcacatcctgccttgaaaataaccctgccttaatgatgttaacgatgaaattctgatcgtttatttccctcttttcataacatcaaatagattcagaattcagtaaatattaattgaatatctattgtgccaggcagtgttccaaatgctgaggatatagcagtccataaaatagactcaaatccatcctctcatggagcttaaattctgaacaaaataagtagaaatgagatttgttagtagtgctgtggagataaagccagggagtggggatagggagtgtgcagggtagggttgaatggggtttgcaatttcag

SEQ ID NO: 312951 - DNA, 638 bp, Homo sapiens
cggcagccaagcccctcttctccgccccgacggggccgcggaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaccaaaatttatcatcctaatgtagacaagttgggaagaatatgtttagatattttgaaagataagtggtccccagcactgcagatccgcacagttctgctatcgatccaggccttgttaagtgctcccaatccagatgatccattagcaaatgatgtagcggagcagtggaagaccaacgaagcccaagccatagaaacagcaagtctaactttatttagacgctgtagatggacaagcttgattgttggaaccaaaatgggaacattaaacaaacatcacagccctcactaataacattgctgtcaagtgtagattccccccttcaaaaaaagcttgtgaccattttgtatggcttgtctggaaacttctgtaaatcttatgttttagtaaaatattttttgttatt

SEQ ID NO: 312952 - DNA, 2513 bp, Homo sapiens
acggttaagagagacgcgcgcgcagtcgcgcgggggtcgtgccgtaccaccgtcgcgggcaggctcggccacgagcgccagagccccgcgcctcccctcgcggcctgtcccaagtccctgccccgcaacagagcgtcacttccgccatccccggcagcggttggggcggggcgcacgggggagggggccaggtcggagggaagcccgcccgtgcccgagcccgcgcccgagcagggactacatttcccgaggggcctcggcggcggctgcggcgacgggcgcggcaacgtcccccggaagtggagcccgggacttccactcgtgcgtgaggcgagaggagccggagacgagaccagaggccgaactcgggttctgacaagatggccgggctgccccgcaggatcatcaaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaccaaaatttatcatcctaatgtagacaagttgggaagaatatgtttagatattttgaaagataagtggtccccagcactgcagatccgcacagttctgctatcgatccaggccttgttaagtgctcccaatccagatgatccattagcaaatgatgtagcggagcagtggaagaccaacgaagcccaagccatagaaacagctagagcatggactaggctatatgccatgaataatatttaaattgatacgatcatcaagtgtgcatcacttctcctgttctgccaagacttcctcctctttgtttgcatttaatggacacagtcttagaaacattacagaataaaaaagcccagacatcttcagtcctttggtgattaaatgcacattagcaaatctatgtcttgtcctgattcactgtcataaagcatgagcagaggctagaagtatcatctggattgttgtgaaacgtttaaaagcagtggcccctccctgcttttattcatttcccccatcctggtttaagtataaagcactgtgaatgaaggtagttgtcaggttagctgcaggggtgtgggtgtttttattttattttattttattttatttttgaggggggaggtagtttaattttatgggctcctttcccccttttttggtgatctaattgcattggttaaaagcagctaaccaggtctttagaatatgctctagccaagtctaactttatttagacgctgtagatggacaagcttgattgttggaaccaaaatgggaacattaaacaaacatcacagccctcactaataacattgctgtcaagtgtagattccccccttcaaaaaaagcttgtgaccattttgtatggcttgtctggaaacttctgtaaatcttatgttttagtaaaatattttttgttattctactttgcctttgtacagtttattttactgtgtttatttcattttcccaatttgacaatcgtattttaaaattgaaactgatggaacattctttcttggtcttcaccatctgacaaattgaatggcaagaggtggattttgccagtttcttttcactgatgcagatttgtgttaagatagtactgaatggagtatttataaactggccctgagcatgcataaagcatcagtatctgacctttttttaaccttctaggaatttgaaataaatgtgtttgtgttgtctgattagatgatcattggtgtcttgccacaatgtttaaaaattactgtacaggaaagtcacagcaaagatagcagttgtgactgacatgtaggactttcacagttgtgccacatttttgcctaaaatttgggttatgacatttttcttggttcttatctgaaaatttcatctgtaacctttcatgtgtgttaagaaacactgatctgatcatttgggatttgctgaggcatttgtgagtcttccttataaacctgatgagcagatctcaactatctagcttgtgtgtcatcagaaaggtttatccctttgagagtatcaagtcctcagttaatgattcttgctttcatccctccagtatttgctgtgggagctcgttttattctttaatttggaattcagtaatttttcttctttattgacgaattcctcccctcacaaaactgttctttcccacctctctccatatctaattcctgattcttgttatttttaagtcataaatgtagccagtcataaatacataaatgttaaccttcgggttgcaaccttgtctcttgcagtttaaggtaatggatattgtagcccatttgaattttcttcactcttattctcgtaattctggagtttcttcagattgtggtgtattttattgtgctcctatgtaagatgaagaattaactattaaaattacattttcaacataaaaaa

SEQ ID NO: 312953 - DNA, 2572 bp, Homo sapiens
acggttaagagagacgcgcgcgcagtcgcgcgggggtcgtgccgtaccaccgtcgcgggcaggctcggccacgagcgccagagccccgcgcctcccctcgcggcctgtcccaagtccctgccccgcaacagagcgtcacttccgccatccccggcagcggttggggcggggcgcacgggggagggggccaggtcggagggaagcccgcccgtgcccgagcccgcgcccgagcagggactacatttcccgaggggcctcggcggcggctgcggcgacgggcgcggcaacgtcccccggaagtggagcccgggacttccactcgtgcgtgaggcgagaggagccggagacgagaccagaggccgaactcgggttctgacaagatggccgggctgccccgcaggatcatcaaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaccaaaatttatcatcctaatgtagacaagttgggaagaatatgtttagatattttgaaagataagtggtccccagcactgcagatccgcacagttctgctatcgatccaggccttgttaagtgctcccaatccagatgatccattagcaaatgatgtagcggagcagtggaagaccaacgaagcccaagccatagaaacagctagagcatggactaggctatatgccatgaataatatttaaattgatacgatcatcaagtgtgcatcacttctcctgttctgccaagacttcctcctctttgtttgcatttaatggacacagtcttagaaacattacagaataaaaaagcccagacatcttcagtcctttggtgattaaatgcacattagcaaatctatgtcttgtcctgattcactgtcataaagcatgagcagaggctagaagtatcatctggattgttgtgaaacgtttaaaagcagtggcccctccctgcttttattcatttcccccatcctggtttaagtataaagcactgtgaatgaaggtagttgtcaggttagctgcaggggtgtgggtgtttttattttattttattttattttatttttgaggggggaggtagtttaattttatgggctcctttcccccttttttggtgatctaattgcattggttaaaagcagctaaccaggtctttagaatatgctctagccaagtctaactttatttagacgctgtagatggacaagcttgattgttggaaccaaaatgggaacattaaacaaacatcacagccctcactaataacattgctgtcaagtgtagattccccccttcaaaaaaagcttgtgaccattttgtatggcttgtctggaaacttctgtaaatcttatgttttagtaaaatattttttgttattctactttgcctttgtacagtttattttactgtgtttatttcattttcccaatttgacaatcgtattttaaaattgaaactgatggaacattctttcttggtcttcaccatctgacaaattgaatggcaagaggtggattttgccagtttcttttcactgatgcagatttgtgttaagatagtactgaatggagtatttataaactggccctgagcatgcataaagcatcagtatctgacctttttttaaccttctaggaatttgaaataaatgtgtttgtgttgtctgattagatgatcattggtgtcttgccacaatgtttaaaaattactgtacaggaaagtcacagcaaagatagcagttgtgactgacatgtaggactttcacagttgtgccacatttttgcctaaaatttgggttatgacatttttcttggttcttatctgaaaatttcatctgtaacctttcatgtgtgttaagaaacactgatctgatcatttgggatttgctgaggcatttgtgagtcttccttataaacctgatgagcagatctcaactatctagcttgtgtgtcatcagaaaggtttatccctttgagagtatcaagtcctcagttaatgattcttgctttcatccctccagtatttgctgtgggagctcgttttattctttaatttggaattcagtaatttttcttctttattgacgaattcctcccctcacaaaactgttctttcccacctctctccatatctaattcctgattcttgttatttttaagtcataaatgtagccagtcataaatacataaatgttaaccttcgggttgcaaccttgtctcttgcagtttaaggtaatggatattgtagcccatttgaattttcttcactcttattctcgtaattctggagtttcttcagattgtggtgtattttattgtgctcctatgtaagatgaagaattaactattaaaattacattttcaacataaaaaagcttttgatgactggtaactggtatccttccaaataaatgcattgcttggtaacaaatg

SEQ ID NO: 312954 - DNA, 2521 bp, Homo sapiens
  misc_feature (2445)..(2445): n is a, c, g, or t
acggttaagagagacgcgcgcgcagtcgcgcgggggtcgtgccgtaccaccgtcgcgggcaggctcggccacgagcgccagagccccgcgcctcccctcgcggcctgtcccaagtccctgccccgcaacagagcgtcacttccgccatccccggcagcggttggggcggggcgcacgggggagggggccaggtcggagggaagcccgcccgtgcccgagcccgcgcccgagcagggactacatttcccgaggggcctcggcggcggctgcggcgacgggcgcggcaacgtcccccggaagtggagcccgggacttccactcgtgcgtgaggcgagaggagccggagacgagaccagaggccgaactcgggttctgacaagatggccgggctgccccgcaggatcatcaaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaccaaaatttatcatcctaatgtagacaagttgggaagaatatgtttagatattttgaaagataagtggtccccagcactgcagatccgcacagttctgctatcgatccaggccttgttaagtgctcccaatccagatgatccattagcaaatgatgtagcggagcagtggaagaccaacgaagcccaagccatagaaacagctagagcatggactaggctatatgccatgaataatatttaaattgatacgatcatcaagtgtgcatcacttctcctgttctgccaagacttcctcctctttgtttgcatttaatggacacagtcttagaaacattacagaataaaaaagcccagacatcttcagtcctttggtgattaaatgcacattagcaaatctatgtcttgtcctgattcactgtcataaagcatgagcagaggctagaagtatcatctggattgttgtgaaacgtttaaaagcagtggcccctccctgcttttattcatttcccccatcctggtttaagtataaagcactgtgaatgaaggtagttgtcaggttagctgcaggggtgtgggtgtttttattttattttattttattttatttttgaggggggaggtagtttaattttatgggctcctttcccccttttttggtgatctaattgcattggttaaaagcagctaaccaggtctttagaatatgctctagccaagtctaactttatttagacgctgtagatggacaagcttgattgttggaaccaaaatgggaacattaaacaaacatcacagccctcactaataacattgctgtcaagtgtagattccccccttcaaaaaaagcttgtgaccattttgtatggcttgtctggaaacttctgtaaatcttatgttttagtaaaatattttttgttattctactttgcctttgtacagtttattttactgtgtttatttcattttcccaatttgacaatcgtattttaaaattgaaactgatggaacattctttcttggtcttcaccatctgacaaattgaatggcaagaggtggattttgccagtttcttttcactgatgcagatttgtgttaagatagtactgaatggagtatttataaactggccctgagcatgcataaagcatcagtatctgacctttttttaaccttctaggaatttgaaataaatgtgtttgtgttgtctgattagatgatcattggtgtcttgccacaatgtttaaaaattactgtacaggaaagtcacagcaaagatagcagttgtgactgacatgtaggactttcacagttgtgccacatttttgcctaaaatttgggttatgacatttttcttggttcttatctgaaaatttcatctgtaacctttcatgtgtgttaagaaacactgatctgatcatttgggatttgctgaggcatttgtgagtcttccttataaacctgatgagcagatctcaactatctagcttgtgtgtcatcagaaaggtttatccctttgagagtatcaagtcctcagttaatgattcttgctttcatccctccagtatttgctgtgggagctcgttttattctttaatttggaattcagtaatttttcttctttattgacgaattcctcccctcacaaaactgttctttcccacctctctccatatctaattcctgattcttgttatttttaagtcataaatgtagccagtcataaatacataaatgttaaccttcgggttgcaaccttgtctcttgcagtttaaggtaatggatattgtatggcttgtctggaaacttctgtaaatcttatgttttagtaaaaaattttttgttattcnactttgcctttggacagtttattttactgggtttatttcattttcccaatttgccaatcgtattttaaaatccgga

SEQ ID NO: 312955 - DNA, 2172 bp, Homo sapiens
  misc_feature (21)..(22): n is a, c, g, or t
aggctagtacgaggcggtgtnnatcggccgagggacaagatggccgggctgccccgcaggatcatcaaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaccaaaatttatcatcctaatgtagacaagttgggaagaatatgtttagatattttgaaagataagtggtccccagcactgcagatccgcacagttctgctatcgatccaggccttgttaagtgctcccaatccagatgatccattagcaaatgatgtagcggagcagtggaagaccaacgaagcccaagccatagaaacagctagagcatggactaggctatatgccatgaataatatttaaattgatacgatcatcaagtgtgcatcacttctcctgttctgccaagacttcctcctctttgtttgcatttaatggacacagtcttagaaacattacagaataaaaaagcccagacatcttcagtcctttggtgattaaatgcacattagcaaatctatgtcttgtcctgattcactgtcataaagcatgagcagaggctagaagtatcatctggattgttgtgaaacgtttaaaagcagtggcccctccctgcttttattcatttcccccatcctggtttaagtataaagcactgtgaatgaaggtagttgtcaggttagctgcaggggtgtgggtgtttttattttattttattttattttatttttgaggggggaggtagtttaattttatgggctcctttcccccttttttggtgatctaattgcattggttaaaagcagctaaccaggtctttagaatatgctctagccaagtctaactttatttagacgctgtagatggacaagcttgattgttggaaccaaaatgggaacattaaacaaacatcacagccctcactaataacattgctgtcaagtgtagattccccccttcaaaaaaagcttgtgaccattttgtatggcttgtctggaaacttctgtaaatcttatgttttagtaaaatattttttgttattctactttgcctttgtacagtttattttactgtgtttatttcattttcccaatttgacaatcgtattttaaaattgaaactgatggaacattctttcttggtcttcaccatctgacaaattgaatggcaagaggtggattttgccagtttcttttcactgatgcagatttgtgttaagatagtactgaatggagtatttataaactggccctgagcatgcataaagcatcagtatctgacctttttttaaccttctaggaatttgaaataaatgtgtttgtgttgtctgattagatgatcattggtgtcttgccacaatgtttaaaaattactgtacaggaaagtcacagcaaagatagcagttgtgactgacatgtaggactttcacagttgtgccacatttttgcctaaaatttgggttatgacatttttcttggttcttatctgaaaatttcatctgtaacctttcatgtgtgttaagaaacactgatctgatcatttgggatttgctgaggcatttgtgagtcttccttataaacctgatgagcagatctcaactatctagcttgtgtgtcatcagaaaggtttatccctttgagagtatcaagtcctcagttaatgattcttgctttcatccctccagtatttgctgtgggagctcgttttattctttaatttggaattcagtaatttttcttctttattgacgaattcctcccctcacaaaactgttctttcccacctctctccatatctaattcctgattcttgttatttttaagtcataaatgtagccagtcataaatacataaatgttaaccttcgggttgcaaccttgtctcttgcagtttaaggtaatggatattgtagcccatttgaattttcttcactcttattctcgtaattctggagtttcttcagattgtggtgtattttattgtgctcctatgtaagatgaagaattaactattaaaattacattttcaacataaaaaa

SEQ ID NO: 312956 - DNA, 2212 bp, Homo sapiens
caatattcaagttactgcatggcctgggctgtactggatacaatcgaacttgaacgtggccgtcgattttacagacaagatggccgggctgccccgcaggatcatcaaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaccaaaatttatcatcctaatgtagacaagttgggaagaatatgtttagatattttgaaagataagtggtccccagcactgcagatccgcacagttctgctatcgatccaggccttgttaagtgctcccaatccagatgatccattagcaaatgatgtagcggagcagtggaagaccaacgaagcccaagccatagaaacagctagagcatggactaggctatatgccatgaataatatttaaattgatacgatcatcaagtgtgcatcacttctcctgttctgccaagacttcctcctctttgtttgcatttaatggacacagtcttagaaacattacagaataaaaaagcccagacatcttcagtcctttggtgattaaatgcacattagcaaatctatgtcttgtcctgattcactgtcataaagcatgagcagaggctagaagtatcatctggattgttgtgaaacgtttaaaagcagtggcccctccctgcttttattcatttcccccatcctggtttaagtataaagcactgtgaatgaaggtagttgtcaggttagctgcaggggtgtgggtgtttttattttattttattttattttatttttgaggggggaggtagtttaattttatgggctcctttcccccttttttggtgatctaattgcattggttaaaagcagctaaccaggtctttagaatatgctctagccaagtctaactttatttagacgctgtagatggacaagcttgattgttggaaccaaaatgggaacattaaacaaacatcacagccctcactaataacattgctgtcaagtgtagattccccccttcaaaaaaagcttgtgaccattttgtatggcttgtctggaaacttctgtaaatcttatgttttagtaaaatattttttgttattctactttgcctttgtacagtttattttactgtgtttatttcattttcccaatttgacaatcgtattttaaaattgaaactgatggaacattctttcttggtcttcaccatctgacaaattgaatggcaagaggtggattttgccagtttcttttcactgatgcagatttgtgttaagatagtactgaatggagtatttataaactggccctgagcatgcataaagcatcagtatctgacctttttttaaccttctaggaatttgaaataaatgtgtttgtgttgtctgattagatgatcattggtgtcttgccacaatgtttaaaaattactgtacaggaaagtcacagcaaagatagcagttgtgactgacatgtaggactttcacagttgtgccacatttttgcctaaaatttgggttatgacatttttcttggttcttatctgaaaatttcatctgtaacctttcatgtgtgttaagaaacactgatctgatcatttgggatttgctgaggcatttgtgagtcttccttataaacctgatgagcagatctcaactatctagcttgtgtgtcatcagaaaggtttatccctttgagagtatcaagtcctcagttaatgattcttgctttcatccctccagtatttgctgtgggagctcgttttattctttaatttggaattcagtaatttttcttctttattgacgaattcctcccctcacaaaactgttctttcccacctctctccatatctaattcctgattcttgttatttttaagtcataaatgtagccagtcataaatacataaatgttaaccttcgggttgcaaccttgtctcttgcagtttaaggtaatggatattgtagcccatttgaattttcttcactcttattctcgtaattctggagtttcttcagattgtggtgtattttattgtgctcctatgtaagatgaagaattaactattaaaattacattttcaacataaaaaa

SEQ ID NO: 312957 - DNA, 1687 bp, Homo sapiens
acggttaagagagacgcgcgcgcagtcgcgcgggggtcgtgccgtaccaccgtcgcgggcaggctcggccacgagcgccagagccccgcgcctcccctcgcggcctgtcccaagtccctgccccgcaacagagcgtcacttccgccatccccggcagcggttggggcggggcgcacgggggagggggccaggtcggagggaagcccgcccgtgcccgagcccgcgcccgagcagggactacatttcccgaggggcctcggcggcggctgcggcgacgggcgcggcaacgtcccccggaagtggagcccgggacttccactcgtgcgtgaggcgagaggagccggagacgagaccagaggccgaactcgggttctgacaagatggccgggctgccccgcaggatcatcaaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaccaaaatttatcatcctaatgtagacaagttgggaagaatatgtttagatattttgaaagataagtggtccccagcactgcagatccgcacagttctgctatcgatccaggccttgttaagtgctcccaatccagatgatccattagcaaatgatgtagcggagcagtggaagaccaacgaagcccaagccatagaaacagctagagcatggactaggctatatgccatgaataatatttaaattgatacgatcatcaagtgtgcatcacttctcctgttctgccaagacttcctcctctttgtttgcatttaatggacacagtcttagaaacattacagaataaaaaagcccagacatcttcagtcctttggtgattaaatgcacattagcaaatctatgtcttgtcctgattcactgtcataaagcatgagcagaggctagaagtatcatctggattgttgtgaaacgtttaaaagcagtggcccctccctgcttttattcatttcccccatcctggtttaagtataaagcactgtgaatgaaggtagttgtcaggttagctgcaggggtgtgggtgtttttattttattttattttattttatttttgaggggggaggtagtttaattttatgggctcctttcccccttttttggtgatctaattgcattggttaaaagcagctaaccaggtctttagaatatgctctagccaagtctaactttatttagacgctgtagatggacaagcttgattgttggaaccaaaatgggaacattaaacaaacatcacagccctcactaataacattgctgtcaagtgtagattccccccttcaaaaaaagcttgtgaccattttgtatggcttgtctggaaacttctgtaaatcttatgttttagtaaaatattttttgttattggtatcaaaaaaaaaacagaaaaaaaaaaattttgggcggcggcccggaagttttatagacaattgtgtgggggggccatagatataacgggtagtggttcagaggaacggtgaaggtggtctacaaaaacggggccggttgcaacacggtggttggtaaggaaaaagg

SEQ ID NO: 312958 - DNA, 1547 bp, Homo sapiens
  misc_feature (1530)..(1530): n is a, c, g, or t
acggttaagagagacgcgcgcgcagtcgcgcgggggtcgtgccgtaccaccgtcgcgggcaggctcggccacgagcgccagagccccgcgcctcccctcgcggcctgtcccaagtccctgccccgcaacagagcgtcacttccgccatccccggcagcggttggggcggggcgcacgggggagggggccaggtcggagggaagcccgcccgtgcccgagcccgcgcccgagcagggactacatttcccgaggggcctcggcggcggctgcggcgacgggcgcggcaacgtcccccggaagtggagcccgggacttccactcgtgcgtgaggcgagaggagccggagacgagaccagaggccgaactcgggttctgacaagatggccgggctgccccgcaggatcatcaaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaccaaaatttatcatcctaatgtagacaagttgggaagaatatgtttagatattttgaaagataagtggtccccagcactgcagatccgcacagttctgctatcgatccaggccttgttaagtgctcccaatccagatgatccattagcaaatgatgtagcggagcagtggaagaccaacgaagcccaagccatagaaacagctagagcatggactaggctatatgccatgaataatatttaaattgatacgatcatcaagtgtgcatcacttctcctgttctgccaagacttcctcctctttgtttgcatttaatggacacagtcttagaaacattacagaataaaaaagcccagacatcttcagtcctttggtgattaaatgcacattagcaaatctatgtcttgtcctgattcactgtcataaagcatgagcagaggctagaagtatcatctggattgttgtgaaacgtttaaaagcagtggcccctccctgcttttattcatttcccccatcctggtttaagtataaagcactgtgaatgaaggtagttgtcaggttagctgcaggggtgtgggtgtttttattttattttattttattttatttttgaggggggaggtagtttaattttatgggctcctttcccccttttttggtgatctaattgcattggttaaaagcagctaaccaggtctttagaatatgctctagccaagtctaactttatttagacgctgtagatggacaagcttgattgttggaaccaaaatgggaacattaaacaaacatcacagccctcactaataacattgctgtcaagtgtagattccccccttcaaaaaaagcttgtgaccattttgtatggcttgtctggaaacttctgtaaatcttatgttttagtaaaatattttttgttattaaaaaaaaaaanaaacaaacaaacaaaaa

SEQ ID NO: 312959 - DNA, 2440 bp, Homo sapiens
acggttaagagagacgcgcgcgcagtcgcgcgggggtcgtgccgtaccaccgtcgcgggcaggctcggccacgagcgccagagccccgcgcctcccctcgcggcctgtcccaagtccctgccccgcaacagagcgtcacttccgccatccccggcagcggttggggcggggcgcacgggggagggggccaggtcggagggaagcccgcccgtgcccgagcccgcgcccgagcagggactacatttcccgaggggcctcggcggcggctgcggcgacgggcgcggcaacgtcccccggaagtggagcccgggacttccactcgtgcgtgaggcgagaggagccggagacgagaccagaggccgaactcgggttctgacaagatggccgggctgccccgcaggatcatcaaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaaataagtggtccccagcactgcagatccgcacagttctgctatcgatccaggccttgttaagtgctcccaatccagatgatccattagcaaatgatgtagcggagcagtggaagaccaacgaagcccaagccatagaaacagctagagcatggactaggctatatgccatgaataatatttaaattgatacgatcatcaagtgtgcatcacttctcctgttctgccaagacttcctcctctttgtttgcatttaatggacacagtcttagaaacattacagaataaaaaagcccagacatcttcagtcctttggtgattaaatgcacattagcaaatctatgtcttgtcctgattcactgtcataaagcatgagcagaggctagaagtatcatctggattgttgtgaaacgtttaaaagcagtggcccctccctgcttttattcatttcccccatcctggtttaagtataaagcactgtgaatgaaggtagttgtcaggttagctgcaggggtgtgggtgtttttattttattttattttattttatttttgaggggggaggtagtttaattttatgggctcctttcccccttttttggtgatctaattgcattggttaaaagcagctaaccaggtctttagaatatgctctagccaagtctaactttatttagacgctgtagatggacaagcttgattgttggaaccaaaatgggaacattaaacaaacatcacagccctcactaataacattgctgtcaagtgtagattccccccttcaaaaaaagcttgtgaccattttgtatggcttgtctggaaacttctgtaaatcttatgttttagtaaaatattttttgttattctactttgcctttgtacagtttattttactgtgtttatttcattttcccaatttgacaatcgtattttaaaattgaaactgatggaacattctttcttggtcttcaccatctgacaaattgaatggcaagaggtggattttgccagtttcttttcactgatgcagatttgtgttaagatagtactgaatggagtatttataaactggccctgagcatgcataaagcatcagtatctgacctttttttaaccttctaggaatttgaaataaatgtgtttgtgttgtctgattagatgatcattggtgtcttgccacaatgtttaaaaattactgtacaggaaagtcacagcaaagatagcagttgtgactgacatgtaggactttcacagttgtgccacatttttgcctaaaatttgggttatgacatttttcttggttcttatctgaaaatttcatctgtaacctttcatgtgtgttaagaaacactgatctgatcatttgggatttgctgaggcatttgtgagtcttccttataaacctgatgagcagatctcaactatctagcttgtgtgtcatcagaaaggtttatccctttgagagtatcaagtcctcagttaatgattcttgctttcatccctccagtatttgctgtgggagctcgttttattctttaatttggaattcagtaatttttcttctttattgacgaattcctcccctcacaaaactgttctttcccacctctctccatatctaattcctgattcttgttatttttaagtcataaatgtagccagtcataaatacataaatgttaaccttcgggttgcaaccttgtctcttgcagtttaaggtaatggatattgtagcccatttgaattttcttcactcttattctcgtaattctggagtttcttcagattgtggtgtattttattgtgctcctatgtaagatgaagaattaactattaaaattacattttcaacataaaaaa

SEQ ID NO: 312960 - DNA, 1654 bp, Homo sapiens
  misc_feature (1637)..(1637): n is a, c, g, or t
acggttaagagagacgcgcgcgcagtcgcgcgggggtcgtgccgtaccaccgtcgcgggcaggctcggccacgagcgccagagccccgcgcctcccctcgcggcctgtcccaagtccctgccccgcaacagagcgtcacttccgccatccccggcagcggttggggcggggcgcacgggggagggggccaggtcggagggaagcccgcccgtgcccgagcccgcgcccgagcagggactacatttcccgaggggcctcggcggcggctgcggcgacgggcgcggcaacgtcccccggaagtggagcccgggacttccactcgtgcgtgaggcgagaggagccggagacgagaccagaggccgaactcgggttctgacaagatggccgggctgccccgcaggatcatcaaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaccaaaatttatcatcctaatgtagacaagttgggaagaatatgtttagatattttgaaagataagtggtccccagcactgcagatccgcacagttctgctatcgatccaggccttgttaagtgctcccaatccagatgatccattagcaaatgatgtagcggagcagtggaagaccaacgaagcccaagccatagaaacagctagagcatggactaggctatatgccatgaataatatttaaattgatacgatcatcaagtgtgcatcacttctcctgttctgccaagacttcctcctctttgtttgcatttaatggacacagtcttagaaacattacagaataaaaaagcccagacatcttcagtcctttggtgattaaatgcacattagcaaatctatgtcttgtcctgattcactgtcataaagcatgagcagaggctagaagtatcatctggattgttgtgaaacgtttaaaagcagtggcccctccctgcttttattcatttcccccatcctggtttaagtataaagcactgtgaatgaaggtagttgtcaggttagctgcaggggtgtgggtgtttttattttattttattttaattttatgggctcctttcccccttttttggtgatctaattgcattggttaaaagcagctaaccaggtctttagaatatgctctagccaagtctaactttatttagacgctgtagatggacaagcttgattgttggaaccaaaatgggaacattaaacaaacatcacagccctcactaataacattgctgtcaagtgtagattccccccttcaaaaaaagcttgtgaccattttgtatggcttgtctggaaacttctgtaaatcttatgttttagtaaaatattttttgttattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatattaaaaaaaaaaaaaaaacaaaaaaaaaaanaaacaaacaaacaaaaa

SEQ ID NO: 312961 - DNA, 1139 bp, Homo sapiens
  misc_feature (1122)..(1122): n is a, c, g, or t
acggttaagagagacgcgcgcgcagtcgcgcgggggtcgtgccgtaccaccgtcgcgggcaggctcggccacgagcgccagagccccgcgcctcccctcgcggcctgtcccaagtccctgccccgcaacagagcgtcacttccgccatccccggcagcggttggggcggggcgcacgggggagggggccaggtcggagggaagcccgcccgtgcccgagcccgcgcccgagcagggactacatttcccgaggggcctcggcggcggctgcggcgacgggcgcggcaacgtcccccggaagtggagcccgggacttccactcgtgcgtgaggcgagaggagccggagacgagaccagaggccgaactcgggttctgacaagatggccgggctgccccgcaggatcatcaaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaccaaaatttatcatcctaatgtagacaagttgggaagaatatgtttagatattttgaaagataagtggtccccagcactgcagatccgcacagttctgctatcgatccaggccttgttaagtgctcccaatccagatgatccattagcaaatgatgtagcggagcagtggaagaccaacgaagcccaagccatagaaacagctagagcatggactaggctatatgccatgaataatatttaaattgatacgatcatcaagtgtgcatcacttctcctgttctgccaagacttcctcctctttgtttgcatttaatggacacagtcttagaaacattacagaataaaaaagcccagacatcttcagtcctttggtgattaaatgcacattagcaaatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatattaaaaaaaaaaaaaaaacaaaaaaaaaaanaaacaaacaaacaaaaa

SEQ ID NO: 312962 - DNA, 923 bp, Homo sapiens
acggttaagagagacgcgcgcgcagtcgcgcgggggtcgtgccgtaccaccgtcgcgggcaggctcggccacgagcgccagagccccgcgcctcccctcgcggcctgtcccaagtccctgccccgcaacagagcgtcacttccgccatccccggcagcggttggggcggggcgcacgggggagggggccaggtcggagggaagcccgcccgtgcccgagcccgcgcccgagcagggactacatttcccgaggggcctcggcggcggctgcggcgacgggcgcggcaacgtcccccggaagtggagcccgggacttccactcgtgcgtgaggcgagaggagccggagacgagaccagaggccgaactcgggttctgacaagatggccgggctgccccgcaggatcatcaaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaaataagtggtccccagcactgcagatccgcacagttctgctatcgatccaggccttgttaagtgctcccaatccagatgatccattagcaaatgatgtagcggagcagtggaagaccaacgaagcccaagccatagaaacagctagagcatggactaggctatatgccatgaataatatttaaattgatacgatcatcaagtgtgcatcacttctcctgttctgccaagacttcctcctctttgtttgcatttaatggacacagtcttagaaacattacagaataaaaaagcccagacatcttcagtcctttggtgattaaatgcacattagcaaatcta

SEQ ID NO: 312963 - DNA, 1012 bp, Homo sapiens
tttgtttcttcagtgcattctgcgatatctttttcttctgggcaacctcctcttctggtttaggaacaatctgttccttttccgtaaggatcatctcaatgtggcaggagagctcatgtatgggttaatccgaccatgagctctgtaggtccggcggcgcatcttaggtgctttgttcacttggatatgctcaatgaccagagaatctacatctaaacccttaagttcagcattactctctgcgtttttaagcatgtgcagcaaaaattcagcactctttttgggccaccgaccttgtgtccagccccattgcttggcctgcgcacacctgccaactccaccattgtaacgtcggaatggtacacactgtttctgtaaagtgacatctttcagatacttcgtggcttttcgtatatgcatacccttgatggcctgagcagtttcacgagtgttcttaaagtgaacacgaagattggaacctcttgatttgcatgatttcgtggggttctccgggtcaagtgaatagcgaaccattttcacagatcacctcagacaagatggccgggctgccccgcaggatcatcaaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaccaaaatttatcatcctaatgtagacaagttcaagtctaactttatttagacgctgtagatggacaagcttgattgttggaaccaaaatgggaacattaaacaaacatcacagccctcactaataacattgctgtcaagtgtagattccccccttcaaaaaaagcttgtgaccattttgtatggcttgtctggaaacttctgtaaatcttatgttttagtaaaatattttttgttatt

SEQ ID NO: 312964 - DNA, 4342 bp, Homo sapiens
gccggttggggcggcgggcgcggggcggggcagggggcggggcgctgacgtcgcggcgcggcccgcggccagcggcccggtgaggcggggaggcggcggccggtcggcccggcccagcccagcccgcagctgcggcggcgctcagagttggttcctgaccgccttctgccgcggccgggtttgtcaccaggtcctggggtctgcaccggctcggccagacctcgccccccgcttctccgccatggccctggtgcggggcgcggagccggcggcggggccttcccgctggctgcccacgcacgtccaggtgacggtgctgcgggcccgcgggctgcggggcaagagctcgggagcgggcagcaccagcgacgcgtacacggtgatccaggtgggccgcgagaagtacagtacgtcggtggtggagaagacgcacggctgtcccgagtggcgtgaggagtgctccttcgagctgccgccgggggccctggatggcctgctgcgggcgcaggaggccgacgcgggcccggcgccctgggccgcgagctccgccgccgcctgcgagctggtgctcaccaccatgcaccgctcgctcatcggcgtcgacaagttcctgggccaggccacggtggcgctggacgaggtcttcggcgcaggccgcgcccagcacacgcagtggtacaagctgcactccaagccaggcaagaaggagaaggaacgcggcgagattgaagtcaccatccagttcacgcgcaacaacctgagcgccagtatgtttgacctgtccatgaaggacaagccaaggtctcccttcagcaagatcagggacaagatgaagggcaagaagaagtatgatctggaatctgcctctgccatcctcccaagcagcgccatagaggatcctgacctgggcagcctgggcaagatgggcaaagccaaaggcttcttcctccgcaacaagctgcgcaagtcgtccctgacccagtccaacacctcgctgggctcggacagcaccctgtcctcagccagcgggagcttggcctaccagggacctggcgccgaactcctcacccgctcaccaagccgtagcagctggctgtccactgaagggggcagggactctgcacagtcccccaagctgttcacccataagaggacctacagcgatgaggccaaccagatgcgagtggctcctcctcgggcccttctggaccttcagggccacctggatgctgcctcccgctcttcgctctgtgtcaatgggagccacatttacaatgaggagccccagggccctgtgcggcaccgcagctccatctcgggctcgcttccatcctctggctccttgcaagctgtctcttcccggttctccgaggaggggcctcgttccacagatgacacctggcccagaggcagtcgtagcaacagcagctcagaggcagtgcttggacaggaggagctgagtgctcaggctaaagtcctggcccctggggccagccaccctggagaggaggagggggcccggctaccagagggcaagccagtccaggttgccacacccatagtggcctcctctgaggctgtggcagagaaggagggagcccggaaggaggaacgcaagccccggatgggtctcttccaccaccaccaccaaggcctaagtcggagcgagttgggtcgccgaagctctctgggggaaaaggggggtcccatcctgggggcctccccacatcactcatccagtggggaggaaaaggccaagagtagctggtttggcttgagagaagccaaggacccgactcagaaacccagtccccaccccgtgaagcccctcagtgccgcccctgtggagggcagccccgacaggaagcagtcccgctccagtctgagcatagccctgagcagtgggctggagaagctcaaaacagtcacatctgggagcattcagcctgtgacccaggccccccaggctggccagatggtggacaccaaaaggctgaaggactcagctgtgctggaccagtcggccaagtactaccacctgacccacgatgagctcatcagcctgctcctgcagcgggagcgggagctgagccagcgggacgagcatgtgcaggagctggagagctacatcgaccggctgctggtgcggatcatggagacctcacccacgctgctgcagatccccccgggcccccccaaatagccttcctcaccctacccccaggagggttggcatggacctattgctgcctgccctctctcctcctgaactctctcatctgcagtggggcatcgtctgtcttgccttgtcactccttgctcctctccctcctgcctcaactggggctgctggaagggggccctctggattccctttggaggcatcaggttctgtgcacaacttgtgtgtctttgggagccctgggtctttcccacctgcctgttttcatatccctcagctttgggggccccagggaattggaactcttcccccaagacagagcaggggtgaactgtagcttgatgcagtaatctgggacaagactggttgctagcacatactttattatcccccaaggatggtcagccatttcttcccacagccaaagccccatccccttcatttccctccagtccctggaggggcttctagtattactgggacaatgaccacgctgcctgtttgtctgtgagttacgggcaaccagcctcttcagcctcacacccattcccctgagagcaagaagcctgtgtggtctgggccagtctctgccatgtcctgagtctgcttcagtctggagctgtttgtggggcgagtgccatgtggacagtggtggatgatgtgtgtgcttcaggctgctccctgacccctctgacctttccacgagtgtcacatgggaatgtgtggggcgcaggggcgggtgcggagagagcacctttttgcttttcgagctcttgaccacctccaatgtgtaggtccctccaggctggggcttgggactgcttatgatttggggatcaagcctccatgtctattcttgttgcctgtccagatgccaaaactctgtgttgctgcagggtttgaacttttggaaaccaattaaaatgtgcctttggtgggcggggtcaagagcccctggatgtcgacctctcccgctgtgtggcgtccccctcccacctgttgaatacatagggatggctctctcagggccctgggaatgggaatggacagcactgctgtgggctgttcccctcccctaaagttaatctcttggtctggccaagttgctgctccctcaaccttcctgctgtcttcccctccctcaaccccaataggaggatcccaggataaacactgctgggcaggcgggcaggcaggcctggggctgccctgctcactctcattgtctggcctcaggacttagccatactagaccagtcagcttgcctggaagagggaggtcccactatgcctttgggagacacctatacttaggaaaaagcctttgttgtcctcccatccatccattaagctgctatctcagcctgtcccttctgccccaggggcttgcctggcttggctgcagtgcactttgaaatgaagtatctgtcctttggcccagcccctggtttgcttgtagaaaacatggtaggcttccccaaggcatctgcagggaactttggcagcttggggcaccctgaattagcaaaaatggggggtgatgaggtgctgaagaaggatacttaacagcttagtgaggaggcaagagctcctctgggaccaccacttcttcaggagagggcctgtgggcttgcttttggaaggcctcaggcagacacgtgccctctgggtgatgtctgtctgctgccaggatggagcagaggagcgccacacatggaggaaagcccctgtaacgttacctaccttaaactccactcatcaaatctgagaaaagtatccactggtccccagggtttcagtcatgcttttgggggtcattgggtattagagaagtaagtatcttttctgagagagggggagtcaccccccctactggggattcctctgggctttattcactcccagccctggccctgacctttgtgggcctccctaatgcccagggcatggatggcttcagaggagtttttgaatcgaagcccagggtccttgttgatgtttcttctcctagccacacttggaggaaagttgcaggtgggttgggcagggagcaggcatggttctgctttgctgtttgtcttcctagttaaggctctttataaagagcttgttcttcatgttttaagcactttatgaagaataaaacattcatgtactgca

SEQ ID NO: 312965 - DNA, 4010 bp, Homo sapiens
agatgtaggggagatggggcagaggagaggtctctgagcaccaggagaaggtcctggggtgggaggaggcatggtgtggtaaccgccgccctacctggtggcacccgaggagcttccccactcaggatgtggttttctccatcatggaaatgttttggatagtttctcagctgcatctgaagcctggaagcccaggccgatgggtcagagcaggagcctttggggagaggctatcagtggctctcagagcaaggaggggtctgggcagtgcctggtaccgggcgggagccaggctccctgggcccgtgactgagttctgcctgctcccctcttctcacaggtggtacaagctgcactccaagccaggcaagaaggagaaggaacgcggcgagattgaagtcaccatccagttcacgcgcaacaacctgagcgccagtatgtttgacctgtccatgaaggacaagccaaggtctcccttcagcaagatcagggacaagatgaagggcaagaagaagtatgatctggaatctgcctctgccatcctcccaagcagcgccatagaggatcctgacctgggcagcctgggcaagatgggcaaagccaaaggcttcttcctccgcaacaagctgcgcaagtcgtccctgacccagtccaacacctcgctgggctcggacagcaccctgtcctcagccagcgggagcttggcctaccagggacctggcgccgaactcctcacccgctcaccaagccgtagcagctggctgtccactgaagggggcagggactctgcacagtcccccaagctgttcacccataagaggacctacagcgatgaggccaaccagatgcgagtggctcctcctcgggcccttctggaccttcagggccacctggatgctgcctcccgctcttcgctctgtgtcaatgggagccacatttacaatgaggagccccagggccctgtgcggcaccgcagctccatctcgggctcgcttccatcctctggctccttgcaagctgtctcttcccggttctccgaggaggggcctcgttccacagatgacacctggcccagaggcagtcgtagcaacagcagctcagaggcagtgcttggacaggaggagctgagtgctcaggctaaagtcctggcccctggggccagccaccctggagaggaggagggggcccggctaccagagggcaagccagtccaggttgccacacccatagtggcctcctctgaggctgtggcagagaaggagggagcccggaaggaggaacgcaagccccggatgggtctcttccaccaccaccaccaaggcctaagtcggagcgagttgggtcgccgaagctctctgggggaaaaggggggtcccatcctgggggcctccccacatcactcatccagtggggaggaaaaggccaagagtagctggtttggcttgagagaagccaaggacccgactcagaaacccagtccccaccccgtgaagcccctcagtgccgcccctgtggagggcagccccgacaggaagcagtcccgctccagtctgagcatagccctgagcagtgggctggagaagctcaaaacagtcacatctgggagcattcagcctgtgacccaggccccccaggctggccagatggtggacaccaaaaggctgaaggactcagctgtgctggaccagtcggccaagtactaccacctgacccacgatgagctcatcagcctgctcctgcagcgggagcgggagctgagccagcgggacgagcatgtgcaggagctggagagctacatcgaccggctgctggtgcggatcatggagacctcacccacgctgctgcagatccccccgggcccccccaaatagccttcctcaccctacccccaggagggttggcatggacctattgctgcctgccctctctcctcctgaactctctcatctgcagtggggcatcgtctgtcttgccttgtcactccttgctcctctccctcctgcctcaactggggctgctggaagggggccctctggattccctttggaggcatcaggttctgtgcacaacttgtgtgtctttgggagccctgggtctttcccacctgcctgttttcatatccctcagctttgggggccccagggaattggaactcttcccccaagacagagcaggggtgaactgtagcttgatgcagtaatctgggacaagactggttgctagcacatactttattatcccccaaggatggtcagccatttcttcccacagccaaagccccatccccttcatttccctccagtccctggaggggcttctagtattactgggacaatgaccacgctgcctgtttgtctgtgagttacgggcaaccagcctcttcagcctcacacccattcccctgagagcaagaagcctgtgtggtctgggccagtctctgccatgtcctgagtctgcttcagtctggagctgtttgtggggcgagtgccatgtggacagtggtggatgatgtgtgtgcttcaggctgctccctgacccctctgacctttccacgagtgtcacatgggaatgtgtggggcgcaggggcgggtgcggagagagcacctttttgcttttcgagctcttgaccacctccaatgtgtaggtccctccaggctggggcttgggactgcttatgatttggggatcaagcctccatgtctattcttgttgcctgtccagatgccaaaactctgtgttgctgcagggtttgaacttttggaaaccaattaaaatgtgcctttggtgggcggggtcaagagcccctggatgtcgacctctcccgctgtgtggcgtccccctcccacctgttgaatacatagggatggctctctcagggccctgggaatgggaatggacagcactgctgtgggctgttcccctcccctaaagttaatctcttggtctggccaagttgctgctccctcaaccttcctgctgtcttcccctccctcaaccccaataggaggatcccaggataaacactgctgggcaggcgggcaggcaggcctggggctgccctgctcactctcattgtctggcctcaggacttagccatactagaccagtcagcttgcctggaagagggaggtcccactatgcctttgggagacacctatacttaggaaaaagcctttgttgtcctcccatccatccattaagctgctatctcagcctgtcccttctgccccaggggcttgcctggcttggctgcagtgcactttgaaatgaagtatctgtcctttggcccagcccctggtttgcttgtagaaaacatggtaggcttccccaaggcatctgcagggaactttggcagcttggggcaccctgaattagcaaaaatggggggtgatgaggtgctgaagaaggatacttaacagcttagtgaggaggcaagagctcctctgggaccaccacttcttcaggagagggcctgtgggcttgcttttggaaggcctcaggcagacacgtgccctctgggtgatgtctgtctgctgccaggatggagcagaggagcgccacacatggaggaaagcccctgtaacgttacctaccttaaactccactcatcaaatctgagaaaagtatccactggtccccagggtttcagtcatgcttttgggggtcattgggtattagagaagtaagtatcttttctgagagagggggagtcaccccccctactggggattcctctgggctttattcactcccagccctggccctgacctttgtgggcctccctaatgcccagggcatggatggcttcagaggagtttttgaatcgaagcccagggtccttgttgatgtttcttctcctagccacacttggaggaaagttgcaggtgggttgggcagggagcaggcatggttctgctttgctgtttgtcttcctagttaaggctctttataaagagcttgttcttcatgttttaagcactttatgaagaataaaacattcatgtactgca

SEQ ID NO: 312966 - DNA, 3461 bp, Homo sapiens
gctctccccagtgcctcgagggccagccccacccccctggcctcccctgggaaagccctgcctgagtgggacaacaccttcaacgtctttgctgccagcaggctgcgtccagaggccaggagcgagatcctggcccctgcaggagtggggctggaggcggcagggctgcaagacccaggccctggggccatgactgcgaaggcagctgagccccagggagagcctgggggaggaggaggaggaggaggaggaggaggaggaagaggtgggagcagcgtgtggctggagcccagggttcctctggacttgggaccgaaccaccagagcgcgagcgcggctgacccagggctcctcgggtcggtaggggctggcctgccctcctcgtcagcccagctacagctgagagcctcaggctcagaaccagacagggaactgccagccccggaagtggaagcagggcagagtccggcagacagtgggacatctctatttagctccccagaagtgatcagtgtgtgggagaggctgccgggcccagagagcgctgctgagggccaggacgatgagtcctcccgaggcgaaaatcagctttgccctgacgtcgagacagctgatgatgcctggccttgggatgtggtcaccatttctcctgcagctgagacagcctcactagtctttcggggagagtctgatgagcctgctccccaggtgcagcctgaatcaccagaaactgtgagccccaaggggagcgaggggcttcccccaccggagcccgagcctaaacccgagtgggtgtctgacaaggggctgcagcccagcaccccacctcccaagccaccgcgcctcttcacaccctcaagatcccaggaggaggaggaggagaaggccgcagtggggctgagtaacagggggccggagacagagggagaagatgcctccccaagtgcactggttgtcggtcccccggagaccaaggaggagggagagaagcgtgagtcggaggagtctgacagctgctcctctgcaaccctgctgggccagcctggcctggaagagctagtggaggatgccagcccccctgtgtctgggccctgcctgtctgcacccgccagctgccctgagggtcctgcccccataccctgtcactcaaagagcttggctcttcagagtcagcacatctgggggactccagaggttggagaaggccctgaggctcctgaggcccagggccaggatccagtaggagaggggcttgggtccttgtcagccacctcccagcaggctgatgtgtgggtctccaaggaagatgccttgaaccccttcttgtttcaggggagccgagatcctcccagcctctcatctgcatccccgccagggtcgagggaatcttctattcattctggtccagaagagctgcccactcccccagagcctgactttccaccgccccctctcccgccttgggccagccaccaccgtggggggcccagccctccatgctctcccctgtctgaagcctggcccctgactacctcctctgcaccaccaggggagccagccttactccctggcccccatgagccctccccacctgggggctcccctgccctacttagggaggacctcgctgcagccaccccagcctccccgcttgtgcttctgcccttggagacacgaccagctgaggagccacagcccagtgccagtccccaccccgtgaagcccctcagtgccgcccctgtggagggcagccccgacaggaagcagtcccgctccagtctgagcatagccctgagcagtgggctggagaagctcaaaacagtcacatctgggagcattcagcctgtgacccaggccccccaggctggccagatggtggacaccaaaaggctgaaggactcagctgtgctggaccagtcggccaagtactaccacctgacccacgatgagctcatcagcctgctcctgcagcgggagcgggagctgagccagcgggacgagcatgtgcaggagctggagagctacatcgaccggctgctggtgcggatcatggagacctcacccacgctgctgcagatccccccgggcccccccaaatagccttcctcaccctacccccaggagggttggcatggacctattgctgcctgccctctctcctcctgaactctctcatctgcagtggggcatcgtctgtcttgccttgtcactccttgctcctctccctcctgcctcaactggggctgctggaagggggccctctggattccctttggaggcatcaggttctgtgcacaacttgtgtgtctttgggagccctgggtctttcccacctgcctgttttcatatccctcagctttgggggccccagggaattggaactcttcccccaagacagagcaggggtgaactgtagcttgatgcagtaatctgggacaagactggttgctagcacatactttattatcccccaaggatggtcagccatttcttcccacagccaaagccccatccccttcatttccctccagtccctggaggggcttctagtattactgggacaatgaccacgctgcctgtttgtctgtgagttacgggcaaccagcctcttcagcctcacacccattcccctgagagcaagaagcctgtgtggtctgggccagtctctgccatgtcctgagtctgcttcagtctggagctgtttgtggggcgagtgccatgtggacagtggtggatgatgtgtgtgcttcaggctgctccctgacccctctgacctttccacgagtgtcacatgggaatgtgtggggcgcaggggcgggtgcggagagagcacctttttgcttttcgagctcttgaccacctccaatgtgtaggtccctccaggctggggcttgggactgcttatgatttggggatcaagcctccatgtctattcttgttgcctgtccagatgccaaaactctgtgttgctgcagggtttgaacttttggaaaccaattaaaatgtgcctttggtgggcggggtcaagagcccctggatgtcgacctctcccgctgtgtggcgtccccctcccacctgttgaatacatagggatggctctctcagggccctgggaatgggaatggacagcactgctgtgggctgttcccctcccctaaagttaatctcttggtctggccaagttgctgctccctcaaccttcctgctgtcttcccctccctcaaccccaataggaggatcccagggcatggatggcttcagaggagtttttgaatcgaagcccagggtccttgttgatgtttcttctcctagccacacttggaggaaagttgcaggtgggttgggcagggagcaggcatggttctgctttgctgtttgtcttcctagttaaggctctttataaagagcttgttcttcatgttttaagcactttatgaagaataaaacattcatgtactgca

SEQ ID NO: 312967 - DNA, 321 bp, Homo sapiens
ggagtcaccccccctactggggattcctctgggctttattcactcccagccctggccctgacctttgtgggcctccctaatgcccagggcatggatggcttcagaggagtttttgaatcgaagcccagggtccttgttgatgtttcttctcctagccacacttggaggaaagttgcaggtgggttgggcagggagcaggcatggttctgctttgctgtttgtcttcctagttaaggctctttataaagagcttgttcttcatgttttaagcactttatgaagaataaaacattcatgtactgcatgtactgcaggtggctc

SEQ ID NO: 312968 - DNA, 4239 bp, Homo sapiens
gctctccccagtgcctcgagggccagccccacccccctggcctcccctgggaaagccctgcctgagtgggacaacaccttcaacgtctttgctgccagcaggctgcgtccagaggccaggagcgagatcctggcccctgcaggagtggggctggaggcggcagggctgcaagacccaggccctggggccatgactgcgaaggcagctgagccccagggagagcctgggggaggaggaggaggaggaggaggaggaggaggaagaggtgggagcagcgtgtggctggagcccagggttcctctggacttgggaccgaaccaccagagcgcgagcgcggctgacccagggctcctcgggtcggtaggggctggcctgccctcctcgtcagcccagctacagctgagagcctcaggctcagaaccagacagggaactgccagccccggaagtggaagcagggcagagtccggcagacagtgggacatctctatttagctccccagaagtgatcagtgtgtgggagaggctgccgggcccagagagcgctgctgagggccaggacgatgagtcctcccgaggcgaaaatcagctttgccctgacgtcgagacagctgatgatgcctggccttgggatgtggtcaccatttctcctgcagctgagacagcctcactagtctttcggggagagtctgatgagcctgctccccaggtgcagcctgaatcaccagaaactgtgagccccaaggggagcgaggggcttcccccaccggagcccgagcctaaacccgagtgggtgtctgacaaggggctgcagcccagcaccccacctcccaagccaccgcgcctcttcacaccctcaagatcccaggaggaggaggaggagaaggccgcagtggggctgagtaacagggggccggagacagagggagaagatgcctccccaagtgcactggttgtcggtcccccggagaccaaggaggagggagagaagcgtgagtcggaggagtctgacagctgctcctctgcaaccctgctgggccagcctggcctggaagagctagtggaggatgccagcccccctgtgtctgggccctgcctgtctgcacccgccagctgccctgagggtcctgcccccataccctgtcactcaaagagcttggctcttcagagtcagcacatctgggggactccagaggttggagaaggccctgaggctcctgaggcccagggccaggatccagtaggagaggggcttgggtccttgtcagccacctcccagcaggctgatgtgtgggtctccaaggaagatgccttgaaccccttcttgtttcaggggagccgagatcctcccagcctctcatctgcatccccgccagggtcgagggaatcttctattcattctggtccagaagagctgcccactcccccagagcctgactttccaccgccccctctcccgccttgggccagccaccaccgtggggggcccagccctccatgctctcccctgtctgaagcctggcccctgactacctcctctgcaccaccaggggagccagccttactccctggcccccatgagccctccccacctgggggctcccctgccctacttagggaggacctcgctgcagccaccccagcctccccgcttgtgcttctgcccttggagacacgaccagctgaggagccacagcccagtgccagtccccaccccgtgaagcccctcagtgccgcccctgtggagggcagccccgacaggaagcagtcccgctccagtctgagcatagccctgagcagtgggctggagaagctcaaaacagtcacatctgggagcattcagcctgtgacccaggccccccaggctggccagatggtggacaccaaaaggctgaaggactcagctgtgctggaccagtcggccaagtactaccacctgacccacgatgagctcatcagcctgctcctgcagcgggagcgggagctgagccagcgggacgagcatgtgcaggagctggagagctacatcgaccggctgctggtgcggatcatggagacctcacccacgctgctgcagatccccccgggcccccccaaatagccttcctcaccctacccccaggagggttggcatggacctattgctgcctgccctctctcctcctgaactctctcatctgcagtggggcatcgtctgtcttgccttgtcactccttgctcctctccctcctgcctcaactggggctgctggaagggggccctctggattccctttggaggcatcaggttctgtgcacaacttgtgtgtctttgggagccctgggtctttcccacctgcctgttttcatatccctcagctttgggggccccagggaattggaactcttcccccaagacagagcaggggtgaactgtagcttgatgcagtaatctgggacaagactggttgctagcacatactttattatcccccaaggatggtcagccatttcttcccacagccaaagccccatccccttcatttccctccagtccctggaggggcttctagtattactgggacaatgaccacgctgcctgtttgtctgtgagttacgggcaaccagcctcttcagcctcacacccattcccctgagagcaagaagcctgtgtggtctgggccagtctctgccatgtcctgagtctgcttcagtctggagctgtttgtggggcgagtgccatgtggacagtggtggatgatgtgtgtgcttcaggctgctccctgacccctctgacctttccacgagtgtcacatgggaatgtgtggggcgcaggggcgggtgcggagagagcacctttttgcttttcgagctcttgaccacctccaatgtgtaggtccctccaggctggggcttgggactgcttatgatttggggatcaagcctccatgtctattcttgttgcctgtccagatgccaaaactctgtgttgctgcagggtttgaacttttggaaaccaattaaaatgtgcctttggtgggcggggtcaagagcccctggatgtcgacctctcccgctgtgtggcgtccccctcccacctgttgaatacatagggatggctctctcagggccctgggaatgggaatggacagcactgctgtgggctgttcccctcccctaaagttaatctcttggtctggccaagttgctgctccctcaaccttcctgctgtcttcccctccctcaaccccaataggaggatcccaggataaacactgctgggcaggcgggcaggcaggcctggggctgccctgctcactctcattgtctggcctcaggacttagccatactagaccagtcagcttgcctggaagagggaggtcccactatgcctttgggagacacctatacttaggaaaaagcctttgttgtcctcccatccatccattaagctgctatctcagcctgtcccttctgccccaggggcttgcctggcttggctgcagtgcactttgaaatgaagtatctgtcctttggcccagcccctggtttgcttgtagaaaacatggtaggcttccccaaggcatctgcagggaactttggcagcttggggcaccctgaattagcaaaaatggggggtgatgaggtgctgaagaaggatacttaacagcttagtgaggaggcaagagctcctctgggaccaccacttcttcaggagagggcctgtgggcttgcttttggaaggcctcaggcagacacgtgccctctgggtgatgtctgtctgctgccaggatggagcagaggagcgccacacatggaggaaagcccctgtaacgttacctaccttaaactccactcatcaaatctgagaaaagtatccactggtccccagggtttcagtcatgcttttgggggtcattgggtattagagaagtaagtatcttttctgagagagggggagtcaccccccctactggggattcctctgggctttattcactcccagccctggccctgacctttgtgggcctccctaatgcccagggcatggatggcttcagaggagtttttgaatcgaagcccagggtccttgttgatgtttcttctcctagccacacttggaggaaagttgcaggtgggttgggcagggagcaggcatggttctgctttgctgtttgtcttcctagttaaggctctttataaagagcttgttcttcatgttttaagcactttatgaagaataaaacattcatgtactgca

SEQ ID NO: 312969 - DNA, 3350 bp, Homo sapiens
gctctccccagtgcctcgagggccagccccacccccctggcctcccctgggaaagccctgcctgagtgggacaacaccttcaacgtctttgctgccagcaggctgcgtccagaggccaggagcgagatcctggcccctgcaggagtggggctggaggcggcagggctgcaagacccaggccctggggccatgactgcgaaggcagctgagccccagggagagcctgggggaggaggaggaggaggaggaggaggaggaggaagaggtgggagcagcgtgtggctggagcccagggttcctctggacttgggaccgaaccaccagagcgcgagcgcggctgacccagggctcctcgggtcggtaggggctggcctgccctcctcgtcagcccagctacagctgagagcctcaggctcagaaccagacagggaactgccagccccggaagtggaagcagggcagagtccggcagacagtgggacatctctatttagctccccagaagtgatcagtgtgtgggagaggctgccgggcccagagagcgctgctgagggccaggacgatgagtcctcccgaggcgaaaatcagctttgccctgacgtcgagacagctgatgatgcctggccttgggatgtggtcaccatttctcctgcagctgagacagcctcactagtctttcggggagagtctgatgagcctgctccccaggtgcagcctgaatcaccagaaactgtgagccccaaggggagcgaggggcttcccccaccggagcccgagcctaaacccgagtgggtgtctgacaaggggctgcagcccagcaccccacctcccaagccaccgcgcctcttcacaccctcaagatcccaggaggaggaggaggagaaggccgcagtggggctgagtaacagggggccggagacagagggagaagatgcctccccaagtgcactggttgtcggtcccccggagaccaaggaggagggagagaagcgtgagtcggaggagtctgacagctgctcctctgcaaccctgctgggccagcctggcctggaagagctagtggaggatgccagcccccctgtgtctgggccctgcctgtctgcacccgccagctgccctgagggtcctgcccccataccctgtcactcaaagagcttggctcttcagagtcagcacatctgggggactccagaggttggagaaggccctgaggctcctgaggcccagggccaggatccagtaggagaggggcttgggtccttgtcagccacctcccagcaggctgatgtgtgggtctccaaggaagatgccttgaaccccttcttgtttcaggggagccgagatcctcccagcctctcatctgcatccccgccagggtcgagggaatcttctattcattctggtccagaagagctgcccactcccccagagcctgactttccaccgccccctctcccgccttgggccagccaccaccgtggggggcccagccctccatgctctcccctgtctgaagcctggcccctgactacctcctctgcaccaccaggggagccagccttactccctggcccccatgagccctccccacctgggggctcccctgccctacttagggaggacctcgctgcagccaccccagcctccccgcttgtgcttctgcccttggagacacgaccagctgaggagccacagcccagtgccagtccccaccccgtgaagcccctcagtgccgcccctgtggagggcagccccgacaggaagcagtcccgctccagtctgagcatagccctgagcagtgggctggagaagctcaaaacagtcacatctgggagcattcagcctgtgacccaggccccccaggctggccagatggtggacaccaaaaggctgaaggactcagctgtgctggaccagtcggccaagtactaccacctgacccacgatgagctcatcagcctgctcctgcagcgggagcgggagctgagccagcgggacgagcatgtgcaggagctggagagctacatcgaccggctgctggtgcggatcatggagacctcacccacgctgctgcagatccccccgggcccccccaaatagccttcctcaccctacccccaggagggttggcatggacctattgctgcctgccctctctcctcctgaactctctcatctgcagtggggcatcgtctgtcttgccttgtcactccttgctcctctccctcctgcctcaactggggctgctggaagggggccctctggattccctttggaggcatcaggttctgtgcacaacttgtgtgtctttgggagccctgggtctttcccacctgcctgttttcatatccctcagctttgggggccccagggaattggaactcttcccccaagacagagcaggggtgaactgtagcttgatgcagtaatctgggacaagactggttgctagcacatactttattatcccccaaggatggtcagccatttcttcccacagccaaagccccatccccttcatttccctccagtccctggaggggcttctagtattactgggacaatgaccacgctgcctgtttgtctgtgagttacgggcaaccagcctcttcagcctcacacccattcccctgagagcaagaagcctgtgtggtctgggccagtctctgccatgtcctgagtctgcttcagtctggagctgtttgtggggcgagtgccatgtggacagtggtggatgatgtgtgtgcttcaggctgctccctgacccctctgacctttccacgagtgtcacatgggaatgtgtggggcgcaggggcgggtgcggagagagcacctttttgcttttcgagctcttgaccacctccaatgtgtaggtccctccaggctggggcttgggactgcttatgatttggggatcaagcctccatgtctattcttgttgcctgtccagatgccaaaactctgtgttgctgcagggtttgaacttttggaaaccaattaaaatgtgcctttggtgggcggggtcaagagcccctggatgtcgacctctcccgctgtgtggcgtccccctcccacctgttgaatacatagggatggctctctcagggccctgggaatgggaatggacagcactgctgtgggctgttcccctcccctaaagttaatctcttggtctggccaagttgatgtttcttctcctagccacacttggaggaaagttgcaggtgggttgggcagggagcaggcatggttctgctttgctgtttgtcttcctagttaaggctctttataaagagcttgttcttcatgttttaagcactttatgaagaataaaacattcatgtactgca

SEQ ID NO: 312970 - DNA, 3952 bp, Homo sapiens
agcgggccgagggggcggggtcacgagccgccagccgccgggtggagggtcccggccgggagccgcggaaagagtagggctccccagacaacggggtccgacgagcagttgggcacgggctgagtccgcctgccggcagaatgtccctggctgcttattgcgtcatctgttgcagaagaataggaacctctacttccccaccaaaaagtggcacacactggagagatatcagaaatataataaagtttactggatcacttattttaggaggttctttatttcttacatatgaagttctggccctgaagaaggctgtgacattagatactcaagtggtagaacgagaaaaaatgaagtcatatatatatgtgcacacagtttctttagataaaggagaaaatcatggtattgcctggcaggcaagaaaagaacttcacaaagcagtaagaaaagtattggcaacatcagccaagatactgcggaatccatttgctgatccttttagtacagttgatatagaagatcatgagtgtgctgtgtggctgctcctacggaagagcaagtcagatgacaaaaccacgcgactcgaggctgtgcgggaaatgtcggagacccatcactggcatgattaccagtataggataattgctcaagcctgtgatccgaaaactcttattggtttggcacgaagcgaagagagtgatcttcgcttttttctcctaccacctcctttgccatctttaaaagaagattcttccactgaagaagagctcagacagttgctggcttccttacctcaaacagagctagatgagtgtatccagtattttacatctttggctcttagtgaaagcagtcagagtctagctgctcagaagggtggtttatggtgttttggaggaaatggacttccttatgctgaaagttttggagaagttccttcagcaacagtggaaatgttctgtttagaagctatagtaaaacattctgagatatccacacattgtgataaaatcgaagcaaatggaggcctgcagctacttcagaggctgtaccgacttcacaaggactgccctaaagtacagagaaatataatgcgtgtcattggaaatatggctttgaatgaacatcttcattcttctatagttcgctcaggctgggtttccatcatggcagaagcaatgaaatctccccacattatggagtcctcacacgctgccagaatcctggcaaatctagaccgagaaactgtgcaagaaaaatatcaggatggcgtatatgtgctgcatccccaatatcgaacaagtcagcccattaaagcagatgtcctttttattcatggccttatgggagcagcattcaaaacatggcgccagcaggacagtgagcaggctgtaattgaaaaacctatggaggatgaagacagatatacgacgtgctggcccaagacatggttagcaaaagactgtcctgctctccgaattatatctgtggagtatgacaccagcctcagcgactggagagcaaggtgccctatggaaagaaagtccattgcattcagaagcaacgaacttcttaggaagctcagagctgctggtgttggggataggccagtggtttggatatcacatagcatgggaggtcttcttgtcaaaaagatgctgttggaagcctctacgaagccagaaatgagtactgttatcaacaataccagaggaataattttttatagtgtccctcatcatggatcacgtttggctgaatactctgttaatattcgctatcttctcttcccctcgttggaagtcaaagaactcagcaaggattctcctgcacttaaaacactacaagatgactttctggagtttgctaaagacaaaaacttccaggtgctgaattttgtggaaacactaccaacctacattggcagcatgattaagctccatgtggtacctgtggaatcagcagatttaggcattggagatctaattcctgtggatgttaaccatttgaacatttgtaagccaaagaaaaaggatgcttttttgtaccagcgtactttacaattcattcgtgaagctttagccaaagaccttgaaaactaacagttgtgctcttccagttttcatatgtgaattcagtgcaagaaacttggtgttctgtttcttcttttaagctctatgcaatcatgcaaacatagtgatcatagcgtcaacatggtctggagtgtgttgcagactacagaacattgttctcccttcaagcgctgtaaagcaccaacccggaagtggcaggcacagaaggaagggctggattgggcccctttggtgtaaagaagtccctgtgtgctgctttatggttcgcagtgttgggcttggtgactggagcaaagctgctgtgagagagtgtcctttcccatctgtgactttcctggtgcatccaggaggggcacggcaggttctgaggtaactcaacttaccataaaaatgccattaagagagtacctaaaatggagagaagaatgaactagaacattcaagactcttttacttctgggtattgatttgctgtacatttttaaagtttgagtttttagctcagttctaccttttatctgacacattattactagtgttaactttgttagacttattgtcatgtctgggtcagttccttgtatctattttcgtattcctgagaacaaatctttttcttagaaaaattctagcttataataattcttttcagactgtagctgcctatgcttggaatttgtcctagataaggataaagtagctaatccattattgatcacagtatgaagtaaaactattctaagccattatatgaattagcaattcttagtatcaagattctcagattctctttggctaaataaacctttcttcttccttgctcatttgcaagtggtattaattgacctctatagcatgtgagtagtagataatcatgtcgatgacctttttttctttagagtaacagcattattgagatataatttacataccataagattcacccttttaaattatacaattcatttttgttttgttttgtttgtttagagacagggtctgactctgttgcccaagctggagtgcagtggcatgatcatagctcattgtaacctcaaactcctgggctcaagagatccttttgcttcagcctcccaagcagctaggactacaggcacatgccaccacacttgggtaattaaaaaataaataaatacttttttgtagagacagggtctcactgtgttgcccaggtctcaaactcccgatctcaagccaccctcccaaaatgctgtgattataggccagagccattgttcccaggctcaattcattggtttttagtatagttcactgagttgtgcaacatcattgctatttaatttcaggctatttcatcatccccaaaagaaccccatacccatgagcagtcagttcccacctctgctttcccaagcctgcggtaaacactaatctgttttctgtctctatggatttgggaattttatgtaaatggaatcatacaatatgtggccctctctgccttcttccttctattagcatgttttcaaggttcattcatgatatagcatgtatcagtactacttcatttctttttatggccgaaattactccattgtatgatatgccatgtttctttatccattcatcagctgatggacatctaggttctgttcatttttgtctatgataaataatgctaccatgatcatttgtgtacaaatttatgtgtggatagatgtttttgattctcttgggtggaattgctggtcaaatggtaagtctatgtttaaattttgaagatggtgaacttttgtagaatgagatagtcgaagctaaaactggagtatggcatctgaaggtaaatggctcatcaataaactcgatatcaacaa

SEQ ID NO: 312971 - DNA, 1924 bp, Homo sapiens
agcgggccgagggggcggggtcacgagccgccagccgccgggtggagggtcccggccgggagccgcggaaagagtagggctccccagacaacggggtccgacgagcagttgggcacgggctgagtccgcctgccggcagaatgtccctggctgcttattgcgtcatctgttgcagaagaataggaacctctacttccccaccaaaaagtggcacacactggagagatatcagaaatataataaagtttactggatcacttattttaggaggttctttatttcttacatatgaagttctggccctgaagaaggctgtgacattagatactcaagtggtagaacgagaaaaaatgaagtcatatatatatgtgcacacagtttctttagataaaggagaaaatcatggtattgcctggcaggcaagaaaagaacttcacaaagcagtaagaaaagtattggcaacatcagccaagatactgcggaatccatttgctgatccttttagtacagttgatatagaagatcatgagtgtgctgtgtggctgctcctacggaagagcaagtcagatgacaaaaccacgcgactcgaggctgtgcgggaaatgtcggagacccatcactggcatgattaccagtataggataattgctcaagcctgtgatccgaaaactcttattggtttggcacgaagcgaagagagtgatcttcgcttttttctcctaccacctcctttgccatctttaaaagaagattcttccactgaagaagagctcagacagttgctggcttccttacctcaaacagagctagatgagtgtatccagtattttacatctttggctcttagtgaaagcagtcagagtctagctgctcagaagggtggtttatggtgttttggaggaaatggacttccttatgctgaaagttttggagaagttccttcagcaacagtggaaatgttctgtttagaagctatagtaaaacattctgagatatccacacattgtgataaaatcgaagcaaatggaggcctgcagctacttcagaggctgtaccgacttcacaaggactgccctaaagtacagagaaatataatgcgtgtcattggaaatatggctttgaatgaacatcttcattcttctatagttcgctcaggctgggtttccatcatggcagaagcaatgaaatctccccacattatggagtcctcacacgctgccagaatcctggcaaatctagaccgagaaactgtgcaagaaaaatatcaggatggcgtatatgtgctgcatccccaatatcgaacaagtcagcccattaaagcagatgtcctttttattcatggccttatgggagcagcattcaaaacatggcgccagcaggacagtgagcaggctgtaattgaaaaacctatggaggatgaagacagatatacgacgtgctggcccaagacatggttagcaaaagactgtcctgctctccgaattatatctgtggagtatgacaccagcctcagcgactggagagcaaggtgccctatggaaagaaagtccattgcattcagaagcaacgaacttcttaggaagctcagagctgctggtgttggggataggccagtggtttggatatcacatagcatgggaggtcttcttgtcaaaaagatgctgttggaagcctctacgaagccagaaatgagtactgttatcaacaataccagaggaataattttttatagtgtccctcatcatggatcacgtttggctgaatactctgttaatattcgctatcttctcttcccctcgttggaagtcaaagaactcagcaagggtaatactttttgtcataaaggaaattggggttatattaacatcagttacacagagaagaagaaaaagtttcttccttgaatgtattatctcattttaaa

SEQ ID NO: 312972 - DNA, 367 bp, Homo sapiens
gtaggacgtgaaggcaggggtggtgtgggggcggacgggggcgtcggcgcagctgggcgcggtggggagcggagaatggggagggcagggaccgggcacggccgagcaccgccgtctggcgcgcggaccggaccgaccagctgacgctcggctgggcgtgagggcctctctctctggtggtcgcgagcctgactcgtctttccctgtcgctgcctttctctggctgctgtcgaggccttggggagtgcacctgccggtccgtcttcccgggctcggtagtcacggagagatgaggaggaggaggaaagggcctcaccagtcacttctgagccttgcagaccaccgcttcctgctccctctctaaccc

SEQ ID NO: 312973 - DNA, 431 bp, Homo sapiens
gagcaagtcagatgacaaaaccacgcgactcgaggctgtgcgggaaatgtcggagacccatcactggcatggtaatgagactacctgaacaggtggcatgccttcagctggctcttgattgctgacataaaagacaagggagtggccaggtgcggtggctcacgcctgtaatcccagcactttgggaggccacgctggttggatcacaaggtcaggagttcaagacccaccctggctaacatggtgaaaccccgtctctactaaaaatacaaaaaaattagccaggcatggtggcgggcgtctgtagtcccagctactcgagaggctgaagcaggagaatggcgtgaacccaggaggcagagcttgcagtgagccgagattgcgccactgcactccagcctgggcaacagagcgagactccatctcaaaaa

SEQ ID NO: 312974 - DNA, 478 bp, Homo sapiens
aaatactggtaccacttcgagaccagagacttgaaaagatagtgctggaattgtttttacggtaccttcaaaccttattccagtgctatctttaattatagtgcaagaggcctttagttataaatttgatttactaggcagtaattgcagtggtgaagattcatacttgttctcacatatgttttattttacttagacatggttagcaaaagactgtcctgctctccgaattatatctgtggagtatgacaccagcctcagcgactggagagcaaggtgccctatggaaaggtaacagaggcgactttagaccaggaggacagggaagaattcaggccgcaagtttaggtcctcttggatgggaagtgattttaattttttgatgccacagacaggattttcttatgaagaacaaacctaatcttttttgtcttccttctagaaggagtttgctgtcaataagcagtggaatagtaga

SEQ ID NO: 312975 - DNA, 2496 bp, Homo sapiens
gactaaagttcttaactctaaaaattagacagcaaattgaggggatcgatagccttgtgtcatgcctgctgtttttgttttgttcagaaagtccattgcattcagaagcaacgaacttcttaggaagctcagagctgctggtgttggggataggccagtggtttggatatcacatagcatgggaggtcttcttgtcaaaaagatgctgttggaagcctctacgaagccagaaatgagtactgttatcaacaataccagaggaataattttttatagtgtccctcatcatggatcacgtttggctgaatactctgttaatattcgctatcttctcttcccctcgttggaagtcaaagaactcagcaaggattctcctgcacttaaaacactacaagatgactttctggagtttgctaaagacaaaaacttccaggtgctgaattttgtggaaacactaccaacctacattggcagcatgattaagctccatgtggtacctgtggaatcagcagatttaggcattggagatctaattcctgtggatgttaaccatttgaacatttgtaagccaaagaaaaaggatgcttttttgtaccagcgtactttacaattcattcgtgaagctttagccaaagaccttgaaaactaacagttgtgctcttccagttttcatatgtgaattcagtgcaagaaacttggtgttctgtttcttcttttaagctctatgcaatcatgcaaacatagtgatcatagcgtcaacatggtctggagtgtgttgcagactacagaacattgttctcccttcaagcgctgtaaagcaccaacccggaagtggcaggcacagaaggaagggctggattgggcccctttggtgtaaagaagtccctgtgtgctgctttatggttcgcagtgttgggcttggtgactggagcaaagctgctgtgagagagtgtcctttcccatctgtgactttcctggtgcatccaggaggggcacggcaggttctgaggtaactcaacttaccataaaaatgccattaagagagtacctaaaatggagagaagaatgaactagaacattcaagactcttttacttctgggtattgatttgctgtacatttttaaagtttgagtttttagctcagttctaccttttatctgacacattattactagtgttaactttgttagacttattgtcatgtctgggtcagttccttgtatctattttcgtattcctgagaacaaatctttttcttagaaaaattctagcttataataattcttttcagactgtagctgcctatgcttggaatttgtcctagataaggataaagtagctaatccattattgatcacagtatgaagtaaaactattctaagccattatatgaattagcaattcttagtatcaagattctcagattctctttggctaaataaacctttcttcttccttgctcatttgcaagtggtattaattgacctctatagcatgtgagtagtagataatcatgtcgatgacctttttttctttagagtaacagcattattgagatataatttacataccataagattcacccttttaaattatacaattcatttttgttttgttttgtttgtttagagacagggtctgactctgttgcccaagctggagtgcagtggcatgatcatagctcattgtaacctcaaactcctgggctcaagagatccttttgcttcagcctcccaagcagctaggactacaggcacatgccaccacacttgggtaattaaaaaataaataaatacttttttgtagagacagggtctcactgtgttgcccaggtctcaaactcccgatctcaagccaccctcccaaaatgctgtgattataggccagagccattgttcccaggctcaattcattggtttttagtatagttcactgagttgtgcaacatcattgctatttaatttcaggctatttcatcatccccaaaagaaccccatacccatgagcagtcagttcccacctctgctttcccaagcctgcggtaaacactaatctgttttctgtctctatggatttgggaattttatgtaaatggaatcatacaatatgtggccctctctgccttcttccttctattagcatgttttcaaggttcattcatgatatagcatgtatcagtactacttcatttctttttatggccgaaattactccattgtatgatatgccatgtttctttatccattcatcagctgatggacatctaggttctgttcatttttgtctatgataaataatgctaccatgatcatttgtgtacaaatttatgtgtggatagatgtttttgattctcttgggtggaattgctggtcaaatggtaagtctatgtttaaattttgaagatggtgaacttttgtagaatgagatagtcgaagctaaaactggagtatggcatctgaaggtaaatggctcatcaataaactcgatatcaacaa

SEQ ID NO: 312976 - DNA, 1931 bp, Homo sapiens
ttcagcaagttcccctgaaatttgggctgctgcttgggtgaatatcccaggatgggggttccattctaggagtggactggcaggctgagcctcccatggagctgatccagccaggatacagagaaggggaggcaaaggctgagacagaaccagcttgagagcggaggcgcaactcttgtctcctggtggccttgagcatttcacaatagggggataaaggataggagcagaaaagtggggctgacttcagaaatggggtcctctagagctcacgggagggtgttagattggagtgggagcttagtggaggtgagccttagaggcaaaagtctccagaccaatccagggcccctcttctatccgggggcccctcttctatccagggcccctcttctgtctgggagcccctcttctatctggggcctcatgcagtggggcctaggggaggttctctgaggacttggccttgatgacagggtggctggaggaatcagaacggtcagaccttctttgacctgcgggcacctttagttggaatggtcaggcctgggatggtggagggggctcttgcaggtggggactggggtggcggggaggaggctgtatggccgccatatctcctttggctgggggcgtcagggctggagaggtgtgaagagtccctgaggcctcgatgcatctcactccagctcaccaggtctgcatttgcccgtccccagctcctgctgccacctccggccgttttaggcacttggctcccttggcccagaggagcttgcctcacaggcctgtgcacctctgacccctgtgaaccagttttcctttgtgcctccacaccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggacccagcagctacacccctacaggcttccaggcacctcatcagtcatgttcctcctccattttaccccctacccatccttgatcggtcatgcctagcctgaccctttagtaaagcaatgaggtaggaagaacaaacccttgtccctttgccatgtggaggaaagtgcctgcctctggtccgagccgcctcggttctgaagcgagtgctcctgcttaccttgctctaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgtatggctggt

SEQ ID NO: 312977 - DNA, 373 bp, Homo sapiens
aagttcaaaaacaagactgtccttaagaagcgctgcaaggactgttacctgctgaagaggctgtgtcgctggtacgtctactgtccaagccctcggctgtacacggagagccctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgtatggctggtaaaaaaataaaaatattaaaatagaccttccgaaa

SEQ ID NO: 312978 - DNA, 314 bp, Homo sapiens
tgcccctctgaactgtcttctgggcagtgacagtcatggtcataatcctgaccctgagccagtgccaggtctccaagtgccttctgaatgaccacaggcgattggttttagtggtaggtgtgtggggatctgttctggtcatctggatgctggtcatcggtgtgcagtattgatcaggacctgcaaacccaaaagcttatgggagctggcacgtcactgagtagagcaggcaggtgcaggggttttgatgtccctgcactgacacagttgtctgcagttctcaattgacatagggagattttctttggtaaaag

SEQ ID NO: 312979 - DNA, 1444 bp, Homo sapiens
tgcccctctgaactgtcttctgggcagtgacagtcatggtcataatcctgaccctgagccagtgccaggtctccaagtgccttctgaatgaccacaggcgattggttttagtggtaggtgtgtggggatctgttctggtcatctggatgctggtcatcggtgtgcagtattgatcaggacctgcaaacccaaaagcttatgggagctggcacgtcacaaaaagaaaaaaaccaagcccatcatcttcgtttcggacagagcaaacagcaacaaggagctgggtgtggaccaggagtcagaggagggcaaaggcaaaacaagccctgataagcaaaagcagtccccacagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggacccagcagctacacccctacaggcttccaggcacctcatcagtcatgttcctcctccattttaccccctacccatccttgatcggtcatgcctagcctgaccctttagtaaagcaatgaggtaggaagaacaaacccttgtccctttgccatgtggaggaaagtgcctgcctctggtccgagccgcctcggttctgaagcgagtgctcctgcttaccttgctctaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgtatggctggt

SEQ ID NO: 312980 - DNA, 1312 bp, Homo sapiens
tgcccctctgaactgtcttctgggcagtgacagtcatggtcataatcctgaccctgagccagtgccaggtctccaagtgccttctgaatgaccacaggcgattggttttagtggtaggtgtgtggggatctgttctggtcatctggatgctggtcatcggtgtgcagtattgatcaggacctgcaaacccaaaagcttatgggagctggcacgtcacccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggacccagcagctacacccctacaggcttccaggcacctcatcagtcatgttcctcctccattttaccccctacccatccttgatcggtcatgcctagcctgaccctttagtaaagcaatgaggtaggaagaacaaacccttgtccctttgccatgtggaggaaagtgcctgcctctggtccgagccgcctcggttctgaagcgagtgctcctgcttaccttgctctaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgtatggctggt

SEQ ID NO: 312981 - DNA, 1426 bp, Homo sapiens
tgcccctctgaactgtcttctgggcagtgacagtcatggtcataatcctgaccctgagccagtgccaggtctccaagtgccttctgaatgaccacaggcgattggttttagtggtaggtgtgtggggatctgttctggtcatctggatgctggtcatcggtgtgcagtattgatcaggacctgcaaacccaaaagcttatgggagctggcacgtcaccccatcatcttcgtttcggacagagcaaacagcaacaaggagctgggtgtggaccaggagtcagaggagggcaaaggcaaaacaagccctgataagcaaaagcagtccccacagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggacccagcagctacacccctacaggcttccaggcacctcatcagtcatgttcctcctccattttaccccctacccatccttgatcggtcatgcctagcctgaccctttagtaaagcaatgaggtaggaagaacaaacccttgtccctttgccatgtggaggaaagtgcctgcctctggtccgagccgcctcggttctgaagcgagtgctcctgcttaccttgctctaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgtatggctggt

SEQ ID NO: 312982 - DNA, 1547 bp, Homo sapiens
tgcccctctgaactgtcttctgggcagtgacagtcatggtcataatcctgaccctgagccagtgccaggtctccaagtgccttctgaatgaccacaggcgattggttttagtggtaggtgtgtggggatctgttctggtcatctggatgctggtcatcggtgtgcagtattgatcaggacctgcaaacccaaaagcttatgggagctggcacgtcacaaaaagaaaaaaaccaagcccatcatcttcgtttcggacagagcaaacagcaacaaggagctgggtgtggaccaggagtcagaggagggcaaaggcaaaacaagccctgataagcaaaagcagtccccacagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggacccagcagctacacccctacaggcttccaggcacctcatcagtcatgttcctcctccattttaccccctacccatccttgatcggtcatgcctagcctgaccctttagtaaagcaatgaggtaggaagaacaaacccttgtccctttgccatgtggaggaaagtgcctgcctctggtccgagccgcctcggttctgaagcgagtgctcctgcttaccttgctctaggctgtctgcagaagcacctgccggtggcactcagcacctccttgtgctagagccctccatcaccttcacgctgtcccaccatgggccaggaaccaaaccagcactgggttctactgctgtggggctagtcggggccccgactagcccccccgactagcccgacagccgttggggagaggacggtggccccatggaccacgccccatagctcactgtgcatgccatatatacggaagcccaagaagttggccagcatcccgaccattgcggccctcaacttgtcttcggtgtcaagttttgcagcgactagcaccagctgtcctgtcgggctagt

SEQ ID NO: 312983 - DNA, 1365 bp, Homo sapiens
tgcccctctgaactgtcttctgggcagtgacagtcatggtcataatcctgaccctgagccagtgccaggtctccaagtgccttctgaatgaccacaggcgattggttttagtggtaggtgtgtggggatctgttctggtcatctggatgctggtcatcggtgtgcagtattgatcaggacctgcaaacccaaaagcttatgggagctggcacgtcacaaaaagaaaaaaaccaagcccatcatcttcgtttcggacagagcaaacagcaacaaggagctgggtgtggaccaggagtcagaggagggcaaaggcaaaacaagccctgataagcaaaagcagtccccacagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggacccagcagctacacccctacaggcttccaggcacctcatcagtcatgttcctcctccattttaccccctacccatccttgatcggtcatgcctagcctgaccctttagtaaagcaatgagcgagtgctcctgcttaccttgctctaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgtatggctggt

SEQ ID NO: 312984 - DNA, 1302 bp, Homo sapiens
caacgaaagatacgagcgcgtacccgtttttatttcagtacgcgggccggcgttagctttatgttactgggcactgggtcttacaatatactacccatcatcttcgtttcggacagagcaaacagcaacaaggagctgggtgtggaccaggagtcagaggagggcaaaggcaaaacaagccctgataagcaaaagcagtccccacagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggacccagcagctacacccctacaggcttccaggcacctcatcagtcatgttcctcctccattttaccccctacccatccttgatcggtcatgcctagcctgaccctttagtaaagcaatgaggtaggaagaacaaacccttgtccctttgccatgtggaggaaagtgcctgcctctggtccgagccgcctcggttctgaagcgagtgctcctgcttaccttgctctaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgtatggctggt

SEQ ID NO: 312985 - DNA, 1100 bp, Homo sapiens
tgcccctctgaactgtcttctgggcagtgacagtcatggtcataatcctgaccctgagccagtgccaggtctccaagtgccttctgaatgaccacaggcgattggttttagtggtaggtgtgtggggatctgttctggtcatctggatgctggtcatcggtgtgcagtattgatcaggacctgcaaacccaaaagcttatgggagctggcacgtcacaaaaagaaaaaaaccaagcccatcatcttcgtttcggacagagcaaacagcaacaaggagctgggtgtggaccaggagtcagaggagggcaaaggcaaaacaagccctgataagcaaaagcagtccccacagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgtatggctggt

SEQ ID NO: 312986 - DNA, 1551 bp, Homo sapiens
tgcccctctgaactgtcttctgggcagtgacagtcatggtcataatcctgaccctgagccagtgccaggtctccaagtgccttctgaatgaccacaggcgattggttttagtggtaggtgtgtggggatctgttctggtcatctggatgctggtcatcggtgtgcagtattgatcaggacctgcaaacccaaaagcttatgggagctggcacgtcacaaaaagaaaaaaaccaagcccatcatcttcgtttcggacagagcaaacagcaacaaggagctgggtgtggaccaggagtcagaggagggcaaaggcaaaacaagccctgataagcaaaagcagtccccacagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagatgcgaaatgcagtcaacgacgcgattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggacccagcagctacacccctacaggcttccaggcacctcatcagtcatgttcctcctccattttaccccctacccatccttgatcggtcatgcctagcctgaccctttagtaaagcaatgaggtaggaagaacaaacccttgtccctttgccatgtggaggaaagtgcctgcctctggtccgagccgcctcggttctgaagcgagtgctcctgcttaccttgctctaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgtatggctggtaaaaaaaaagcacaagacgcaaaacaaaccacaaacgacagaacaaagacggcacgcaacacagaacaccacaacgagcgcccacgcccacacaaaaacccccaccggagcccacgacacacgcgccccccacacacgcgaacaaggagcggcccccacagag

SEQ ID NO: 312987 - DNA, 1406 bp, Homo sapiens
gaggaacctctctgaggaagttgaaaataccatctccgtggatcggccagtgaaaaagaaaaaaaccaagcccatcatcttcgtttcggacagagcaaacagcaacaaggagctgggtgtggaccaggagtcagaggagggcaaaggcaaaacaagccctgataagcaaaagcagtccccacagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatccctgacctccctcctccagacagatggctctggaaagctcaacctgcaggagttccaccacctctggaacaagattaaggcctggcagatgcgaaatgcagtcaacgacgcgattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggacccagcagctacacccctacaggcttccaggcacctcatcagtcatgttcctcctccattttaccccctacccatccttgatcggtcatgcctagcctgaccctttagtaaagcaatgaggtaggaagaacaaacccttgtccctttgccatgtggaggaaagtgcctgcctctggtccgagccgcctcggttctgaagcgagtgctcctgcttaccttgctctaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgtatggctggtaaaaaaaaagcacaagacgcaaaacaaaccacaaacgacagaacaaagacggcacgcaacacagaacaccacaacgagcgcccacgcccacacaaaaacccccaccggagcccacgacacacgcgccccccacacacgcgaacaaggagcggcccccacagag

SEQ ID NO: 312988 - DNA, 1020 bp, Homo sapiens
  misc_feature (987)..(987): n is a, c, g, or t
  misc_feature (1019)..(1020): n is a, c, g, or t
tgcccctctgaactgtcttctgggcagtgacagtcatggtcataatcctgaccctgagccagtgccaggtctccaagtgccttctgaatgaccacaggcgattggttttagtggtaggtaaaaagaaaaaaaccaagcccatcatcttcgtttcggacagagcaaacagcaacaaggagctgggtgtggaccaggagtcagaggagggcaaaggcaaaacaagccctgataagcaaaagcagtccccacagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagctttcatgcctttgacacgatgggatggtatcatcagctcaacgttctggaagtggtgcagctcacatgtgtggcctgaccggtgggtcattcaagcatggggagcctccgattcgttcccccttttccagctttctccaggcccgttaccctaggccgggccttggggtgcccattagccccactttggggcagcgctttaaagggggggaaccccttcggagagagcggcgcccaggggtttctggaggcgcctgacctctcccngtggggtgtgttttggtgttctagacattctnn

SEQ ID NO: 312989 - DNA, 1102 bp, Homo sapiens
tgcccctctgaactgtcttctgggcagtgacagtcatggtcataatcctgaccctgagccagtgccaggtctccaagtgccttctgaatgaccacaggcgattggttttagtggtaggtgtgtggggatctgttctggtcatctggatgctggtcatcggtgtgcagtattgatcaggacctgcaaacccaaaagcttatgggagctggcacgtcactgagtagagcaggcaggtgcaggggttttgatgtccctgcactgacacagttgtctgcagttctcaattgacatttcgctccagtgtcgagggtcaacaggaatgttggggcgtggggcaatctggaagacacagggagcagggcccttggctcagctgatagttgccgcagggattacaggcccaggcagcctgccacagctggggcttttaccaaagaaaatctccctatgttaaatgcttgctcaaaaatttttaaaaaatattctgtaagtcaaaatccattgttaggtcagtttgagagagccatgtttttggtgttttagtaaccaatttcatttttttattatttatttatttgtttatttttgagacggagtttcactcttgtcacccaggctggagtgcaatggcatgatctcagctcactgcaacctccgcctcccgggttcaagcaattctcctgcctcagcctcctgagtagctgagattacaggtgcccaccatcacgcctggataatttttgtattttttagtcgagatggggtttcaccatgttggccaggatagtcctgaactactgacctcagataatccgcccacctcagcctcccaaagtgctgggattacaggcatgagccagcacgcccggccaccaatttcattttttaaaaaaggaagaaagaaaaccttagccagaagatctttttccttgccatatgcagtaagagtagattataaaaacaaagtcagagcagtcactggtgtctgggcatggaggagaaagaagaattctcttctcccttcaccctccatgcccctttttggctccatgtgattcagatttctggaccctggagccccaccccaagctaaagaccagga

SEQ ID NO: 312990 - DNA, 742 bp, Homo sapiens
tagtcatagtcgagctggtgtgattcggtcgggccctagccataagcttatggtgagctggccgtcgccccatcatcttcgtttcggacagagcaaacagcaacaaggagctgggtgtggaccaggagtcagaggagggcaaaggcaaaacaagccctgataagcaaaagcagtccccacagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcagattccacctcaaaacagtctatgacatcattaccatgcggtaagctggagggcatgttcagagcgtttcatgcgtttgaccaggctggcgatggtttcatcaaagctcaccgtctggaggcggttggaaaccccgtccggtggctccgacctcttggtgtaaagcttcataactttcgcggcccacgggcggacccccacgggttctgcgg

SEQ ID NO: 312991 - DNA, 1607 bp, Homo sapiens
tgcccctctgaactgtcttctgggcagtgacagtcatggtcataatcctgaccctgagccagtgccaggtctccaagtgccttctgaatgaccacaggcgattggttttagtggtaggtgtgtggggatctgttctggtcatctggatgctggtcatcggtgtgcagtattgatcaggacctgcaaacccaaaagcttatgggagctggcacgtcacaaaaagaaaaaaaccaagcccatcatcttcgtttcggacagagcaaacagcaacaaggagctgggtgtggaccaggagtcagaggagggcaaaggcaaaacaagccctgataagcaaaagcagtccccacagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggacccagcagctacacccctacaggcttccaggcacctcatcagtcatgttcctcctccattttaccccctacccatccttgatcggtcatgcctagcctgaccctttagtaaagcaatgaggtaggaagaacaaacccttgtccctttgccatgtggaggaaagtgcctgcctctggtccgagccgcctcggttctgaagcgagtgctcctgcttaccttgctctaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgtatggctggtaaaaaaaaagcacaagacgcaaaacaaaccacaaacgacagaacaaagacggcacgcaacacagaacaccacaacgagcgcccacgcccacacaaaaacccccaccggagcccacgacacacgcgccccccacacacgcgaacaaggagcggcccccacagag

SEQ ID NO: 312992 - DNA, 1426 bp, Homo sapiens
  misc_feature (18)..(18): n is a, c, g, or t
tatttcagtcaccgggantgggcgttaactgtagattagatggaccgtcgtccgtacagactcttctgaatgaccacaggcgattggttttagtggtaggtgtgtggggatctgttctggtcatctggatgctggtcatcggtgtgcagtattgatcaggacctgcaaacccaaaagcttatgggagctggcacgtcacaaaaagaaaaaaaccaagcccatcatcttcgtttcggacagagcaaacagcaacaaggagctgggtgtggaccaggagtcagaggagggcaaaggcaaaacaagccctgataagcaaaagcagtccccacagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggacccagcagctacacccctacaggcttccaggcacctcatcagtcatgttcctcctccattttaccccctacccatccttgatcggtcatgcctagcctgaccctttagtaaagcaatgaggtaggaagaacaaacccttgtccctttgccatgtggaggaaagtgcctgcctctggtccgagccgcctcggttctgaagcgagtgctcctgcttaccttgctctaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgtatggctggt

SEQ ID NO: 312993 - DNA, 1333 bp, Homo sapiens
tgcccctctgaactgtcttctgggcagtgacagtcatggtcataatcctgaccctgagccagtgccaggtctccaagtgccttctgaatgaccacaggcgattggttttagtggtaggtgtgtggggatctgttctggtcatctggatgctggtcatcggtgtgcagtattgatcaggacctgcaaacccaaaagcttatgggagctggcacgtcacaaaaagaaaaaaaccaagcccatcatcttcgtttcggacagagcaaacagcaacaaggagctgggtgtggaccaggagtcagaggagggcaaaggcaaaacaagccctgataagcaaaagcagtccccacagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggacccagcagctacacccctacaggcttccaggcacctcatcagtcatgttcctcctccattttaccccctacccatccttgatcggtcatgcctagcctgaccctttagtaaagcaatgagctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgtatggctggt

SEQ ID NO: 312994 - DNA, 1312 bp, Homo sapiens
  misc_feature (18)..(18): n is a, c, g, or t
tatttcagtcaccgggantgggcgttaactgtagattagatggaccgtcgtccgtacagactcttctgaatgaccacaggcgattggttttagtggtaggtgtgtggggatctgttctggtcatctggatgctggtcatcggtgtgcagtattgatcaggacctgcaaacccaaaagcttatgggagctggcacgtcacaaaaagaaaaaaaccaagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggacccagcagctacacccctacaggcttccaggcacctcatcagtcatgttcctcctccattttaccccctacccatccttgatcggtcatgcctagcctgaccctttagtaaagcaatgaggtaggaagaacaaacccttgtccctttgccatgtggaggaaagtgcctgcctctggtccgagccgcctcggttctgaagcgagtgctcctgcttaccttgctctaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgtatggctggt

SEQ ID NO: 312995 - DNA, 1279 bp, Homo sapiens
gaggaacctctctgaggaagttgaaaataccatctccgtggatcggccagtgaaaaagaaaaaaaccaagcccatcatcttcgtttcggacagagcaaacagcaacaaggagctgggtgtggaccaggagtcagaggagggcaaaggcaaaacaagccctgataagcaaaagcagtccccacagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggacccagcagctacacccctacaggcttccaggcacctcatcagtcatgttcctcctccattttaccccctacccatccttgatcggtcatgcctagcctgaccctttagtaaagcaatgaggtaggaagaacaaacccttgtccctttgccatgtggaggaaagtgcctgcctctggtccgagccgcctcggttctgaagcgagtgctcctgcttaccttgctctaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgtatggctggt

SEQ ID NO: 312996 - DNA, 1521 bp, Homo sapiens
  misc_feature (18)..(18): n is a, c, g, or t
tatttcagtcaccgggantgggcgttaactgtagattagatggaccgtcgtccgtacagactcttctgaatgaccacaggcgattggttttagtggtaggtgtgtggggatctgttctggtcatctggatgctggtcatcggtgtgcagtattgatcaggacctgcaaacccaaaagcttatgggagctggcacgtcaccccatcatcttcgtttcggacagagcaaacagcaacaaggagctgggtgtggaccaggagtcagaggagggcaaaggcaaaacaagccctgataagcaaaagcagtccccacaggtgtctgggcatgtggcatgggtggggtggccagcacgctacaggggcttcctatgcgcttgggatacacaggggctggaggcttcccaggagtttgtcttgaacatctggagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggacccagcagctacacccctacaggcttccaggcacctcatcagtcatgttcctcctccattttaccccctacccatccttgatcggtcatgcctagcctgaccctttagtaaagcaatgaggtaggaagaacaaacccttgtccctttgccatgtggaggaaagtgcctgcctctggtccgagccgcctcggttctgaagcgagtgctcctgcttaccttgctctaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgtatggctggt

SEQ ID NO: 312997 - DNA, 1226 bp, Homo sapiens
ggctgcaggattcggcacgagagtccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagatgcgaaatgcagtcaacgacgcgattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggacccagcagctacacccctacaggcttccaggcacctcatcagtcatgttcctcctccattttaccccctacccatccttgatcggtcatgcctagcctgaccctttagtaaagcaatgaggtaggaagaacaaacccttgtccctttgccatgtggaggaaagtgcctgcctctggtccgagccgcctcggttctgaagcgagtgctcctgcttaccttgctctaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgtatggctggtaaaaaaaaagcacaagacgcaaaacaaaccacaaacgacagaacaaagacggcacgcaacacagaacaccacaacgagcgcccacgcccacacaaaaacccccaccggagcccacgacacacgcgccccccacacacgcgaacaaggagcggcccccacagag

SEQ ID NO: 312998 - DNA, 891 bp, Homo sapiens
tgcccctctgaactgtcttctgggcagtgacagtcatggtcataatcctgaccctgagccagtgccaggtctccaagtgccttctgaatgaccacaggcgattggttttagtggtaggtgtgtggggatctgttctggtcatctggatgctggtcatcggtgtgcagtattgatcaggacctgcaaacccaaaagcttatgggagctggcacgtcaccccatcatcttcgtttcggacagagcaaacagcaacaaggagctgggtgtggaccaggagtcagaggagggcaaaggcaaaacaagccctgataagcaaaagcagtccccacagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcagattccacctcaaaacagtctatgacatcattaccatgcggtaagctggagggcatgttcagagcgtttcatgcgtttgaccaggctggcgatggtttcatcaaagctcaccgtctggaggcggttggaaaccccgtccggtggctccgacctcttggtgtaaagcttcataactttcgcggcccacgggcggacccccacgggttctgcgg

SEQ ID NO: 312999 - DNA, 6585 bp, Homo sapiens
gaggcgctccgggatactgagggcggagggcggtggcagcgctggcgctggggaccggcttggtggcttcgggaaacagtttggcgccggcggccgtccgtgttactccgcatcccgccccgtctcggcacggctagcagccccctggccaccagcgtccagcaatgtgtctcaccggccgggcgtagcagctgcgcgtgcgcggaaccgcggggccatgagcgaagccggcggccggggctgtgggtccccggttccccagcgagcgcgatggagactagtggcggcgacggccgcgttctgcctggtgtcggccacctccgtgtggacggcgggggccgagcccatgagtagggaggagaaacagaagcttgggaatcaagtactggaaatgtttgatcatgcttatggtaactatatggaacatgcttaccctgctgatgaactcatgcctttaacctgtagaggtcgagttagaggccaagagccaagtcgcggtgacgttgatgatgccttgggaaaattttctctgacactgattgattctttggacactcttgttttaaataaaactaaagaatttgaagatgcagtgagaaaagttttaagagatgttaatttagataacgatgtagtcgtatcagtctttgaaacaaacatcagagttcttgggggtcttttgggtgggcactccctggcaatcatgctgaaagaaaaaggtgaatatatgcagtggtacaatgatgaacttctccaaatggcaaagcagttaggttacaaacttttaccggctttcaacactaccagtggccttccttatccaagaattaatttaaagtttggcatcagaaaaccagaagctcggacaggaactgagacagatacctgtacagcttgtgcaggtaccttgatccttgaatttgctgctttaagtcgattcacaggagcaacaatatttgaggaatatgccagaaaagctcttgattttctctgggaaaaaagacagcgaagtagtaatttagtgggcgtgactataaatattcatactggagattgggtacgaaaagatagtggagttggagcagggattgattcatattatgaatatctgttgaaagcctatgtcttgcttggagatgacagttttctggaaagatttaacacacactatgatgccataatgaggtatattagccagccacctcttctacttgatgtgcatatccacaaaccaatgctgaatgctcggacttggatggatgctttgcttgccttcttcccaggcttgcaggtgttaaagggggatattagacctgctattgaaactcatgaaatgttatatcaggtgattaaaaaacacaattttctaccagaggcatttaccacagatttcagagtacactgggctcaacatcctttaaggccagaatttgcagaaagtacctacttcttatataaagctacaggagatccttactaccttgaagtagggaagacacttattgaaaatttaaataaatatgctagagtgccttgcggatttgctgccatgaaggatgttcgtactggaagtcatgaggacagaatggattctttcttcttggctgaaatgtttaaatatctttacctgttatttgctgataaagaagacattatttttgacatagaagattacatctttacaacagaagctcatctgttacctctttggctctctactacaaatcaaagcatctctaaaaagaacacaacctcggaatatacagaactggatgacagtaacttcgattggacttgtccaaatactcagatcctctttcctaatgacccattgtatgctcaaagtattcgtgagcccttgaaaaatgtggtggataagagctgtcctagaggcatcatcagagtagaggagagtttcaggagtggagctaaaccccctctgagagccagagatttcatggccactaaccctgagcatttagaaatcctgaagaagatgggggtgagtttgattcacctcaaagatgggagagtccagttggtccaacatgcaatccaagctgctagttcaatcgacgctgaagatgggttgaggttcatgcaggagatgattgaattgtcaagtcagcaacaaaaagaacagcagctgcctccacgagctgtacaaattgtttcccacccattttttggcagggtagtattgactgctggaccagctcagtttgggctggatctgtctaaacataaagagacaagaggatttgttgcaagcagtaaaccatccaatggttgttcagagcttactaacccagaggcagtgatgggaaaaatcgcactgatacaaagaggacagtgcatgtttgcagaaaaggcacgcaacatccagaatgctggagccattggtggcattgttattgatgacaatgaggggagcagcagtgatactgcccctctgttccagatggcaggtgatggaaaggatacagatgacatcaagatccccatgctgttcttattcagcaaagaaggaagtatcatactggatgccatccgggaatatgaggaggtagaagtgctcctctctgataaagcaaaagatcgagatcctgaaatggaaaatgaagaacaaccatcctctgaaaatgattctcagaatcagagtggtgaacagatttcatcaagttctcaggaggttgatttggttgatcaagagtcttctgaggaaaattctctaaattctcacccagaatcattatctctagcagatatggacaatgctgcaagcatttccccttctgaacagacttctaatcccacagaaaaccatgagactacaaatcttaatggtgaatgtacagatttagataaccagcttcaagaacaatcagaaactgaggaagattccaatcctaatgttagctggggtaaaaaggtccagcctatagactccatattagcagactggaatgaagatatagaagcatttgaaatgatggagaaggatgagctatgacttgctaaacaatctgttggtaggtatttaaaaagaaaaggtaaactgtgtgtggttaatagacatcctaatactaagcaggctttctaatgggaggctttaagtatggtgatgaacaaccacgttctgactggcgtagttatcgtaggaatctggagcatgctgtgttagaattgaccttgtttaaaactgtcccatcaaaaatggaaatccacagttcccccttcaaatgcagcactgcaccaccctgcaacacctcaggccagggaaagattactgagcattcctgcgaaccagatttctgttgtctctggatagacaagaaacaaaattcatttagtagtggagtggggaataggagtttggatagccttctaattaaaggaagctcgcctttcttggttttgggggttagaggctcttttgggaagatgcatccgagtattgtggcattctgattatgctgccttcacaaaacactctaagtgacctaagtggttatgaagcaaatgcatttatggtgaaaacagtctttgctcattgctttctcttgtttcatttagtgacaaatgatcaagatgacttgattttttttccttcttaacaatgtcttttttatttaaaccaaaggtgaagccagtgtactttctcagtgagttctctgcataaagactaatcagtgggaccaggtaaaaaggtcatataatacattgtggagattgcttacttaatacttctgaaaaatggagtaagggagaaactgtaatgttgcaatatgaacctcccattgggccttccatagggaaagctgtgactactctgaaatggaacctagcattatatccttgtagggtagattataaatcatttccagttcatttctcttagaggtgattacctctagccatcagccttactccatcccatgtttggtatgcaatttgagccacaaggctcgtatcgccaacagctatatacattttgttccatttttctgtcttacagagccatgataaaactgtggttagtgagttaaaattcctggagtaactactgtttttctcctttgaaacttaggtttctaaagttgcacctaaggaatctgtcacattttctgttgaatcatggtttttgtttttgtttttaacagatattccttctgatacggacttgaaaattagtgtatggtgacctgtgtttaaaaaaaaaagtacaatacaactacatatagctatatagcttaatgagacttccaccccccccctttttttttttggtttgttgttgttgtagtagtctggtgctggccacatttaagtcttaaaaatttttaaattttgttgttgatgtttgtagacagccctgttgttgaaatcatggctttattcattttatttattttttaaacttgcctgaatttgttctaaaggaatatttaagagacataattttcttctctttaccataacattacacaaaactttttcctaaaacacggttgtgaggtactgatgaggtgtaagtggagctgttaaaaacagcagtgctgtattgcagttatgtatattcgtgtacagtatgtttagatcccaggtaaacatattcttttctgagaggataaatacctgcattcagatattccaggtaaatataattgagtcagggagtagtaaatctgatggagaattcactttggggaggggaaaaagaatagtatgcaagacccttattggcttttaattatacctgaaaccaaaatggatatttttagtctctctgcatgtgagatttggtgtaacaagatagaactataatatatacagtatatggaaggatagatatagtgctttgttcattttaattgcaaagctgccaaaatagttgaagcttaattacttgacttgccttgatttataggactggggcttggagaaaatgagcagatgttcctctaagacatcgattacagaagccttatatacatggatttgattttgtatttgtagctgaaagtcactgttgtctaaaactaacttttctaagttatcaaaacaacctaatttcttttccaacaaggagaacttaatggcatgaaggattgtgtgacacattggaaaagccagcttactgccactctcttcctttggccattagagggaggtgttgcctttcattgacgcttagaagcaaattgttcacttgttaagaaaagtaaatccttaaaaaaagaaaaggaaaaaatttaaccaatttttcttaatacccagaaggaattatactcaatatttccctagttaagaaaagaggagataatgttcgtctaaaaaactccaacgttgtaattacaactctacattcatttacttacttgacatactgccacaaagtagtttttgagttcattaaaaattccaaaggcattagttgtttttttttttttttagtgttttgttttttagttaacttttatagacattttagtaacttgctaaagattcaggggattctatgaaaccccgaatttagaaacatctggtctacctcagttaaatgttgactgcttagaaatatagctgaagtgatcaccacagccataaaattgtttaagaaagatttatataatgtttacaaatctggaatcaaggattttagctgaaatcctttaagagatattagagcaagtatttaattcaggtattttcaagttttaaaacttaacctgtttacctactaaaaataaaatagctagtttttttctgcatataaaagttcattgaaatgatatgcccttatttgcaatacttttcccataaagttttaagtgtgaaagaattgtaatttactagatatgtttggtatgggatattttgttaggcaagttttcttttttcttcttaaattgcaataggcttccaaaaagagtataattgtttcagaacaaattaactcttggcattatacgtctccctttttctttacagtattagtaaaaagaaaaattgtacactttctgattttaacttcactaatgtaattactctctcaagaagcttttaaaatttaaattaccatcacacaaccttttttatagtaaagccaacatttgttctctcaccaaaccccatgccaaattcatcatgaagaaagctcagcataagtaattcaaatactgcttataattttagaggggggtagaatttagtaaatattccagccggtcgttttatgcacaaggcttcagtcagaacatagaaaaaaaaaacattctgtgaatgaaatattgtatgttcagattttataaaagacatttttaaaagcccaatttacagccgtatattttcttatgatgtaatttatgaaaaagatgtctgtactaacaggtgctgtaacactactgttgttggattttattgtttggtgataaatgtatacaatatttctaagggaaactatgtactgtgatgtaaaagtctgggcaaaatgtatataatcctgtatataattatgtatttgattataattactgattgtaaagatttaataaaatatgtaaatattccagtttagtttta

SEQ ID NO: 313000 - DNA, 742 bp, Homo sapiens
gaggcgctccgggatactgagggcggagggcggtggcagcgctggcgctggggaccggcttggtggcttcgggaaacagtttggcgccggcggccgtccgtgttactccgcatcccgccccgtctcggcacggctagcagccccctggccaccagcgtccagcaatgtgtctcaccggccgggcgtagcagctgcgcgtgcgcggaaccgcggggccatgagcgaagccggcggccggggctgtgggtccccggttccccagcgagcgcgatggagactagtggcggcgacggccgcgttctgcctggtgtcggccacctccgtgtggacggcgggggccgagcccatgagtagggaggagaaacagaagcttgggaacatgcttaccctgctgatgaactcatgcctttaacctgtagaggtcgagttagaggccaagagccaagtcgcggtgacgttgatgatgccttgggaaaattttctctgacactgattgattctttggacactcttgttttaaataaaactaaagaatttgaagatgcagtgagaaaagttttaagagatgttaatttagataacgatgtagtcgtatcagtctttgaaacaaacatcagagttcttggggggtctttgggtgggacatccctgggaatcaatggtgaaaggaaaaagggggaattttttgcacaggggtaccaaaggatgaacttcttccaatgggcaaaggagtagggtacaa

SEQ ID NO: 313001 - DNA, 3247 bp, Homo sapiens
gaggcgctccgggatactgagggcggagggcggtggcagcgctggcgctggggaccggcttggtggcttcgggaaacagtttggcgccggcggccgtccgtgttactccgcatcccgccccgtctcggcacggctagcagccccctggccaccagcgtccagcaatgtgtctcaccggccgggcgtagcagctgcgcgtgcgcggaaccgcggggccatgagcgaagccggcggccggggctgtgggtccccggttccccagcgagcgcgatggagactagtggcggcgacggccgcgttctgcctggtgtcggccacctccgtgtggacggcgggggccgagcccatgagtagggaggagaaacagaagcttgggaatcaagtactggaaatgtttgatcatgcttatggtaactatatggaacatgcttaccctgctgatgaactcatgcctttaacctgtagaggtcgagttagaggccaagagccaagtcgcggtgacgttgatgatgccttgggaaaattttctctgacactgattgattctttggacactcttttagaggtgattacctctagccatcagccttactccatcccatgtttggtatgcaatttgagccacaaggctcgtatcgccaacagctatatacattttgttccatttttctgtcttacagagccatgataaaactgtggttagtgagttaaaattcctggagtaactactgtttttctcctttgaaacttaggtttctaaagttgcacctaaggaatctgtcacattttctgttgaatcatggtttttgtttttgtttttaacagatattccttctgatacggacttgaaaattagtgtatggtgacctgtgtttaaaaaaaaaagtacaatacaactacatatagctatatagcttaatgagacttccaccccccccctttttttttttggtttgttgttgttgtagtagtctggtgctggccacatttaagtcttaaaaatttttaaattttgttgttgatgtttgtagacagccctgttgttgaaatcatggctttattcattttatttattttttaaacttgcctgaatttgttctaaaggaatatttaagagacataattttcttctctttaccataacattacacaaaactttttcctaaaacacggttgtgaggtactgatgaggtgtaagtggagctgttaaaaacagcagtgctgtattgcagttatgtatattcgtgtacagtatgtttagatcccaggtaaacatattcttttctgagaggataaatacctgcattcagatattccaggtaaatataattgagtcagggagtagtaaatctgatggagaattcactttggggaggggaaaaagaatagtatgcaagacccttattggcttttaattatacctgaaaccaaaatggatatttttagtctctctgcatgtgagatttggtgtaacaagatagaactataatatatacagtatatggaaggatagatatagtgctttgttcattttaattgcaaagctgccaaaatagttgaagcttaattacttgacttgccttgatttataggactggggcttggagaaaatgagcagatgttcctctaagacatcgattacagaagccttatatacatggatttgattttgtatttgtagctgaaagtcactgttgtctaaaactaacttttctaagttatcaaaacaacctaatttcttttccaacaaggagaacttaatggcatgaaggattgtgtgacacattggaaaagccagcttactgccactctcttcctttggccattagagggaggtgttgcctttcattgacgcttagaagcaaattgttcacttgttaagaaaagtaaatccttaaaaaaagaaaaggaaaaaatttaaccaatttttcttaatacccagaaggaattatactcaatatttccctagttaagaaaagaggagataatgttcgtctaaaaaactccaacgttgtaattacaactctacattcatttacttacttgacatactgccacaaagtagtttttgagttcattaaaaattccaaaggcattagttgtttttttttttttttagtgttttgttttttagttaacttttatagacattttagtaacttgctaaagattcaggggattctatgaaaccccgaatttagaaacatctggtctacctcagttaaatgttgactgcttagaaatatagctgaagtgatcaccacagccataaaattgtttaagaaagatttatataatgtttacaaatctggaatcaaggattttagctgaaatcctttaagagatattagagcaagtatttaattcaggtattttcaagttttaaaacttaacctgtttacctactaaaaataaaatagctagtttttttctgcatataaaagttcattgaaatgatatgcccttatttgcaatacttttcccataaagttttaagtgtgaaagaattgtaatttactagatatgtttggtatgggatattttgttaggcaagttttcttttttcttcttaaattgcaataggcttccaaaaagagtataattgtttcagaacaaattaactcttggcattatacgtctccctttttctttacagtattagtaaaaagaaaaattgtacactttctgattttaacttcactaatgtaattactctctcaagaagcttttaaaatttaaattaccatcacacaaccttttttatagtaaagccaacatttgttctctcaccaaaccccatgccaaattcatcatgaagaaagctcagcataagtaattcaaatactgcttataattttagaggggggtagaatttagtaaatattccagccggtcgttttatgcacaaggcttcagtcagaacatagaaaaaaaaaacattctgtgaatgaaatattgtatgttcagattttataaaagacatttttaaaagcccaatttacagccgtatattttcttatgatgtaatttatgaaaaagatgtctgtactaacaggtgctgtaacactactgttgttggattttattgtttggtgataaatgtatacaatatttctaagggaaactatgtactgtgatgtaaaagtctgggcaaaatgtatataatcctgtatataattatgtatttgattataattactgattgtaaagatttaataaaatatgtaaatattccagtttagtttta

SEQ ID NO: 313002 - DNA, 3236 bp, Homo sapiens
gaggcgctccgggatactgagggcggagggcggtggcagcgctggcgctggggaccggcttggtggcttcgggaaacagtttggcgccggcggccgtccgtgttactccgcatcccgccccgtctcggcacggctagcagccccctggccaccagcgtccagcaatgtgtctcaccggccgggcgtagcagctgcgcgtgcgcggaaccgcggggccatgagcgaagccggcggccggggctgtgggtccccggttccccagcgagcgcgatggagactagtggcggcgacggccgcgttctgcctggtgtcggccacctccgtgtggacggcgggggccgagcccatgagtagggaggagaaacagaagcttgggaatcaagtactggaaatgtttgatcatgcttatggtaactatatggaacatgcttaccctgctgatgaactcatgcctttaacctgtagaggtcgagttagaggccaagagccaagtcgcggtgacgttgatgatgccttgggaaaattttctctgacactgattgattctttggacactcttttagaggtgattacctctagccatcagccttactccatcccatgtttggtatgcaatttgagccacaaggctcgtatcgccaacagctatatacattttgttccatttttctgtcttacagagccatgataaaactgtggttagtgagttaaaattcctggagtaactactgtttttctcctttgaaacttaggtttctaaagttgcacctaaggaatctgtcacattttctgttgaatcatggtttttgtttttgtttttaacagatattccttctgatacggacttgaaaattagtgtatggtgacctgtgtttaaaaaaaaaagtacaatacaactacatatagctatatagcttaatgagacttccaccccccccctttttttttttggtttgttgttgttgtagtagtctggtgctggccacatttaagtcttaaaaatttttaaattttgttgttgatgtttgtagacagccctgttgttgaaatcatggctttattcattttatttattttttaaacttgcctgaatttgttctaaaggaatatttaagagacataattttcttctctttaccataacattacacaaaactttttcctaaaacacggttgtgaggtactgatgaggtgtaagtggagctgttaaaaacagcagtgctgtattgcagttatgtatattcgtgtacagtatgtttagatcccaggtaaacatattcttttctgagaggataaatacctgcattcagatattccaggtaaatataattgagtcagggagtagtaaatctgatggagaattcactttggggaggggaaaaagaatagtatgcaagacccttattggcttttaattatacctgaaaccaaaatggatatttttagtctctctgcatgtgagatttggtgtaacaagatagaactataatatatacagtatatggaaggatagatatagtgctttgttcattttaattgcaaagctgccaaaatagttgaagcttaattacttgacttgccttgatttataggactggggcttggagaaaatgagcagatgttcctctaagacatcgattacagaagccttatatacatggatttgattttgtatttgtagctgaaagtcactgttgtctaaaactaacttttctaagttatcaaaacaacctaatttcttttccaacaaggagaacttaatggcatgaaggattgtgtgacacattggaaaagccagcttactgccactctcttcctttggccattagagggaggtgttgcctttcattgacgcttagaagcaaattgttcacttgttaagaaaagtaaatccttaaaaaaagaaaaggaaaaaatttaaccaatttttcttaatacccagaaggaattatactcaatatttccctagttaagaaaagaggagataatgttcgtctaaaaaactccaacgttgtaattacaactctacattcatttacttacttgacatactgccacaaagtagtttttgagttcattaaaaattccaaaggcattagttgtttttttttttttttagtgttttgttttttagttaacttttatagacattttagtaacttgctaaagattcaggggattctatgaaaccccgaatttagaaacatctggtctacctcagttaaatgttgactgcttagaaatatagctgaagtgatcaccacagccataaaattgtttaagaaagatttatataatgtttacaaatctggaatcaaggattttagctgaaatcctttaagagatattagagcaagtatttaattcaggtattttcaagttttaaaacttaacctgtttacctactaaaaataaaatagctagtttttttctgcatataaaagttcattgaaatgatatgcccttatttgcaatacttttcccataaagttttaagtgtgaaagaattgtaatttactagatatgtttggtatgggatattttgttaggcaagttttcttttttcttcttaaattgcaataggcttccaaaaagagtataattgtttcagaacaaattaactcttggcattatacgtctccctttttctttacagtattagtaaaaagaaaaattgtacactttctgattttaacttcactaatgtaattactctctcaagaagcttttaaaatttaaattaccatcacacaaccttttttatagtaaagccaacatttgttctctcaccaaaccccatgccaaattcatcatgaagaaagctcagcataagtaattcaaatactgcttataattttagaggggggtagaatttagtaaatattccagccggtcgttttatgcacaaggcttcagtcagaacatagaaaaaaaaaacattctgtgaatgaaatattgtatgttcagattttataaaagacatttttaaaagcccaatttacagccgtatattttcttatgatgtaatttatgaaaaagatgtctgtactaacaggtgctgtaacactactgttgttggattttattgtttggtgataaatgtatacaatatttctaagggaaactatgtactgtgatgtaaaagtctgggcaaaatgtatataatcctgtatataattatgtatttgattataattactgattgtaaagattgggttttctttgtaaaaattcca

SEQ ID NO: 313003 - DNA, 4259 bp, Homo sapiens
gaggcgctccgggatactgagggcggagggcggtggcagcgctggcgctggggaccggcttggtggcttcgggaaacagtttggcgccggcggccgtccgtgttactccgcatcccgccccgtctcggcacggctagcagccccctggccaccagcgtccagcaatgtgtctcaccggccgggcgtagcagctgcgcgtgcgcggaaccgcggggccatgagcgaagccggcggccggggctgtgggtccccggttccccagcgagcgcgatggagactagtggcggcgacggccgcgttctgcctggtgtcggccacctccgtgtggacggcgggggccgagcccatgagtagggaggagaaacagaagcttgggaatcaagtactggaaatgtttgatcatgcttatggtaactatatggaacatgcttaccctgctgatgaactcatgcctttaacctgtagaggtcgagttagaggccaagagccaagtcgcggtgacgttgatgatgccttgggaaaattttctctgacactgattgattctttggacactcttgttttaaataaaactaaagaatttgaagatgcagtgagaaaagttttaagagatgttaatttagataacgatgtagtcgtatcagtctttgaaacaaacatcagagttcttgggggtcttttgggtgggcactccctggcaatcatgctgaaagaaaaaggtgaatatatgcagtggtacaatgatgaacttctccaaatggcaaagcagttaggttacaaacttttaccggctttcaacactaccagtggccttccttatccaagaattaatttaaagtttggcatcagaaaaccagaagctcggacaggaactgagacagatacctgtacagcttgtgcaggtaccttgatccttgaatttgctgctttaagtcgattcacaggagcaacaatatttgaggaatatgccagaaaagctcttgattttctctgggaaaaaagacagcgaagtagtaatttagtgggcgtgactataaatattcatactggagattgggtacgaaaagatagtggagttggagcagggattgattcatattatgaatatctgttgaaagcctatgtcttgcttggagatgacagttttctggaaagatttaacacacactatgatgccataatgaggtatattagccagccacctcttctacttgatgtgcatatccacaaaccaatgctgaatgctcggacttggatggatgctttgcttgccttcttcccaggcttgcaggtgttaaagggggatattagacctgctattgaaactcatgaaatgttatatcaggtgattaaaaaacacaattttctaccagaggcatttaccacagatttcagagtacactgggctcaacatcctttaaggccagaatttgcagaaagtacctacttcttatataaagctacaggagatccttactaccttgaagtagggaagacacttattgaaaatttaaataaatatgctagagtgccttgcggatttgctgccatgaaggatgttcgtactggaagtcatgaggacagaatggattctttcttcttggctgaaatgtttaaatatctttacctgttatttgctgataaagaagacattatttttgacatagaagattacatctttacaacagaagctcatctgttacctctttggctctctactacaaatcaaagcatctctaaaaagaacacaacctcggaatatacagaactggatgacagtaacttcgattggacttgtccaaatactcagatcctctttcctaatgacccattgtatgctcaaagtattcgtgagcccttgaaaaatgtggtggataagagctgtcctagaggcatcatcagagtagaggagagtttcaggagtggagctaaaccccctctgagagccagagatttcatggccactaaccctgagcatttagaaatcctgaagaagatgggggtgagtttgattcacctcaaagatgggagagtccagttggtccaacatgcaatccaagctgctagttcaatcgacgctgaagatgggttgaggttcatgcaggagatgattgaattgtcaagtcagcaacaaaaagaacagcagctgcctccacgagctgtacaaattgtttcccacccattttttggcagggtagtattgactgctggaccagctcagtttgggctggatctgtctaaacataaagagacaagaggatttgttgcaagcagtaaaccatccaatggttgttcagagcttactaacccagaggcagtgatgggaaaaatcgcactgatacaaagaggacagtgcatgtttgcagaaaaggcacgcaacatccagaatgctggagccattggtggcattgttattgatgacaatgaggggagcagcagtgatactgcccctctgttccagatggcaggtgatggaaaggatacagatgacatcaagatccccatgctgttcttattcagcaaagaaggaagtatcatactggatgccatccgggaatatgaggaggtagaagtgctcctctctgataaagcaaaagatcgagatcctgaaatggaaaatgaagaacaaccatcctctgaaaatgattctcagaatcagagtggtgaacagatttcatcaagttctcaggaggttgatttggttgatcaagagtcttctgaggaaaattctctaaattctcacccagaatcattatctctagcagatatggacaatgctgcaagcatttccccttctgaacagacttctaatcccacagaaaaccatgagactacaaatcttaatggtgaatgtacagatttagataaccagcttcaagaacaatcagaaactgaggaagattccaatcctaatgttagctggggtaaaaaggtccagcctatagactccatattagcagactggaatgaagatatagaagcatttgaaatgatggagaaggatgagctatgacttgctaaacaatctgttggtaggtatttaaaaagaaaaggtaaactgtgtgtggttaatagacatcctaatactaagcaggctttctaatgggaggctttaagtatggtgatgaacaaccacgttctgactggcgtagttatcgtaggaatctggagcatgctgtgttagaattgaccttgtttaaaactgtcccatcaaaaatggaaatccacagttcccccttcaaatgcagcactgcaccaccctgcaacacctcaggccagggaaagattactgagcattcctgcgaaccagatttctgttgtctctggatagacaagaaacaaaattcatttagtagtggagtggggaataggagtttggatagccttctaattaaaggaagctcgcctttcttggttttgggggttagaggctcttttgggaagatgcatccgagtattgtggcattctgattatgctgccttcacaaaacactctaagtgacctaagtggttatgaagcaaatgcatttatggtgaaaacagtctttgctcattgctttctcttgtttcatttagtgacaaatgatcaagatgacttgattttttttccttcttaacaatgtcttttttatttaaaccaaaggtgaagccagtgtactttctcagtgagttctctgcataaagactaatcagtgggaccaggtaaaaaggtcatataatacattgtggagattgcttacttaatacttctgaaaaatggagtaagggagaaactgtaatgttgcaatatgaacctcccattgggccttccatagggaaagctgtgactactctgaaatggaacctagcattatatccttgtagggtagattataaatcatttccagttcatttctcttagaggtgattacctctagccatcagccttactccatcccatgtttggtatgcaatttgagccacaaggctcgtatcgccaacagctatatacattttgttccatttttctgtcttacagagccatgataaaactgtggttagtgagttaaaattcctggagtaactactgtttttctcctttgaaacttaggtttctaaagttgcacctaaggaatctgtcacattttctgttgaatcatggtttttgtttttgtttttaacagatattccttctgatacggacttgaaaattagtgtatggtgacctgtgtttaaaaaaggggcactcacacatggggatagtgttaagcgctcccccc

SEQ ID NO: 313004 - DNA, 3841 bp, Homo sapiens
gaggcgctccgggatactgagggcggagggcggtggcagcgctggcgctggggaccggcttggtggcttcgggaaacagtttggcgccggcggccgtccgtgttactccgcatcccgccccgtctcggcacggctagcagccccctggccaccagcgtccagcaatgtgtctcaccggccgggcgtagcagctgcgcgtgcgcggaaccgcggggccatgagcgaagccggcggccggggctgtgggtccccggttccccagcgagcgcgatggagactagtggcggcgacggccgcgttctgcctggtgtcggccacctccgtgtggacggcgggggccgagcccatgagtagggaggagaaacagaagcttgggaatcaagtactggaaatgtttgatcatgcttatggtaactatatggaacatgcttaccctgctgatgaactcatgcctttaacctgtagaggtcgagttagaggccaagagccaagtcgcggtgacgttgatgatgccttgggaaaattttctctgacactgattgattctttggacactcttgttttaaataaaactaaagaatttgaagatgcagtgagaaaagttttaagagatgttaatttagataacgatgtagtcgtatcagtctttgaaacaaacatcagagttcttgggggtcttttgggtgggcactccctggcaatcatgctgaaagaaaaaggtgaatatatgcagtggtacaatgatgaacttctccaaatggcaaagcagttaggttacaaacttttaccggctttcaacactaccagtggccttccttatccaagaattaatttaaagtttggcatcagaaaaccagaagctcggacaggaactgagacagatacctgtacagcttgtgcaggtaccttgatccttgaatttgctgctttaagtcgattcacaggagcaacaatatttgaggaatatgccagaaaagctcttgattttctctgggaaaaaagacagcgaagtagtaatttagtgggcgtgactataaatattcatactggagattgggtacgaaaagatagtggagttggagcagggattgattcatattatgaatatctgttgaaagcctatgtcttgcttggagatgacagttttctggaaagatttaacacacactatgatgccataatgaggtatattagccagccacctcttctacttgatgtgcatatccacaaaccaatgctgaatgctcggacttggatggatgctttgcttgccttcttcccaggcttgcaggtgttaaagggggatattagacctgctattgaaactcatgaaatgttatatcaggtgattaaaaaacacaattttctaccagaggcatttaccacagatttcagagtacactgggctcaacatcctttaaggccagaatttgcagaaagtacctacttcttatataaagctacaggagatccttactaccttgaagtagggaagacacttattgaaaatttaaataaatatgctagagtgccttgcggatttgctgccatgaaggatgttcgtactggaagtcatgaggacagaatggattctttcttcttggctgaaatgtttaaatatctttacctgttatttgctgataaagaagacattatttttgacatagaagattacatctttacaacagaagctcatctgttacctctttggctctctactacaaatcaaagcatctctaaaaagaacacaacctcggaatatacagaactggatgacagtaacttcgattggacttgtccaaatactcagatcctctttcctaatgacccattgtatgctcaaagtattcgtgagcccttgaaaaatgtggtggataagagctgtcctagaggcatcatcagagtagaggagagtttcaggagtggagctaaaccccctctgagagccagagatttcatggccactaaccctgagcatttagaaatcctgaagaagatgggggtgagtttgattcacctcaaagatgggagagtccagttggtccaacatgcaatccaagctgctagttcaatcgacgctgaagatgggttgaggttcatgcaggagatgattgaattgtcaagtcagcaacaaaaagaacagcagctgcctccacgagctgtacaaattgtttcccacccattttttggcagggtagtattgactgctggaccagctcagtttgggctggatctgtctaaacataaagagacaagaggatttgttgcaagcagtaaaccatccaatggttgttcagagcttactaacccagaggcagtgatgggaaaaatcgcactgatacaaagaggacagtgcatgtttgcagaaaaggcacgcaacatccagaatgctggagccattggtggcattgttattgatgacaatgaggggagcagcagtgatactgcccctctgttccagatggcaggtgatggaaaggatacagatgacatcaagatccccatgctgttcttattcagcaaagaaggaagtatcatactggatgccatccgggaatatgaggaggtagaagtgctcctctctgataaagcaaaagatcgagatcctgaaatggaaaatgaagaacaaccatcctctgaaaatgattctcagaatcagagtggtgaacagatttcatcaagttctcaggaggttgatttggttgatcaagagtcttctgaggaaaattctctaaattctcacccagaatcattatctctagcagatatggacaatgctgcaagcatttccccttctgaacagacttctaatcccacagaaaaccatgagactacaaatcttaatggtgaatgtacagatttagataaccagcttcaagaacaatcagaaactgaggaagattccaatcctaatgttagctggggtaaaaaggtccagcctatagactccatattagcagactggaatgaagatatagaagcatttgaaatgatggagaaggatgagctatgacttgctaaacaatctgttggtaggtatttaaaaagaaaaggtaaactgtgtgtggttaatagacatcctaatactaagcaggctttctaatgggaggctttaagtatggtgatgaacaaccacgttctgactggcgtagttatcgtaggaatctggagcatgctgtgttagaattgaccttgtttaaaactgtcccatcaaaaatggaaatccacagttcccccttcaaatgcagcactgcaccaccctgcaacacctcaggccagggaaagattactgagcattcctgcgaaccagatttctgttgtctctggatagacaagaaacaaaattcatttagtagtggagtggggaataggagtttggatagccttctaattaaaggaagctcgcctttcttggttttgggggttagaggctcttttgggaagatgcatccgagtattgtggcattctgattatgctgccttcacaaaacactctaagtgacctaagtggttatgaagcaaatgcatttatggtgaaaacagtctttgctcattgctttctcttgtttcatttagtgacaaatgatcaagatgacttgattttttttccttcttaacaatgtcttttttatttaaaccaaaggtgaagccagtgtactttctcagtgagttctctgcataaagactaatcagtgggaccaggtaaaaaggtcatataatacattgtggagattgcttacttaatacttctgaaaaatggagtaagggagaaactgtaatgttgcagtgtgcttccgaccgatattccagcacactgcgccgtactatgaacgagcgcgta

SEQ ID NO: 313005 - DNA, 476 bp, Homo sapiens
gtggccttccttatccaagagtaagtacttctgaaaaatatgagtctttatatactttctttgctgttttacaaaatgaagttttgtgatcagagccattgttcttcaccagcttgaggctgaaaaaaaaatgcttcaaagctatataacaaatttatattttcatttcaattaactgattatacttctaagtgatgtgataattagattagtttaagctttaaaaaagttttatttctgatttctgtgggtacatagtaggtatatattaatggggtatgtgagatattttgatacaatcatacaatgcataataatcacatcagggtaaatgaggtggccattacctcgagcatttatcatttctttgtgttacaaacattccaattatactcttttagttgttttaaaatgtatgatacatttctgttgactgtaatcgctctgttgtgctattaaatactgtatcttattca

SEQ ID NO: 313006 - DNA, 359 bp, Homo sapiens
tgaagtagggaagacacttattgaaaatttaaataaatatgctagagtgccttgcggatttgctgccatgaaggatgttcgtactggaagtcatgaggacaggtaaaacaattgctaacatcctctttcctcagggtctctctgaaacaacacaaaatgcagctaccatttaggattcaaataagtttaattcttttacaaaggatagaaacctttgttccttgtgtttacttttttaaactctgttgaatacactaattttaatttgtttgaaaagtttgtatttttatcatagtgcctggcatatagtaggtgctcaaatgatttttaaataaatgaatcgatgattgttaaatatc

SEQ ID NO: 313007 - DNA, 1646 bp, Homo sapiens
gaggcgctccgggatactgagggcggagggcggtggcagcgctggcgctggggaccggcttggtggcttcgggaaacagtttggcgccggcggccgtccgtgttactccgcatcccgccccgtctcggcacggctagcagccccctggccaccagcgtccagcaatgtgtctcaccggccgggcgtagcagctgcgcgtgcgcggaaccgcggggccatgagcgaagccggcggccggggctgtgggtccccggttccccagcgagcgcgatggagactagtggcggcgacggccgcgttctgcctggtgtcggccacctccgtgtggacggcgggggccgagcccatgagtagggaggagaaacagaagcttgggtaagggtgctggcagcctggggtgggtttctcggtgaggctgacaacaggaggggtgcctgtcattgcgacccggtcgcgtagtggcctctcctgtcgcgattggaacggctcttcccgcgcgagaaccctagaggggtggacagggtccggggaggtgggaaccgccgcccgcgacctgacctcgggggagctgacggggtgtcgccctggccgccggtgacatgtgcaggctccttgaagccaggcgcggtgtgtcaacgcggctgccatgtcagtggcccaagaagggggctacagcccgcatcgctgcgcgctggagttctgcggttggctgcctgtcgaccgaagcatggttagctttctcgcgcaagtgagcttccaactgggaaaatgttgctgatctcacagtagttaaggaaatgatgtttacacctgttacggaaaagggggcgttcattggaacttgaactttacacattttactatttccttgcagtgttttcttgcactgtattttcataatagaatgtttggggggaaattattcaaaagtctcaagtatacctattcagtagtttttatccgtcttggaagtgtgttaaaattatcaattctatttacaccatttaattcagagtaatacatacacgaggtcctacacatgaataagaaaaaagcgaagaaccagtaggaaatgggagaaaggcatgaacggttaagccagaagaggaaatggaagtggtaaataaacatgaaaagttactcaacctccataaacgtaggagatgcagattaaaacgaggagctagctggtttttgcccatcagattagtaaatataatacaaaacacaaggatacggttctggttagttaaggaatagaaaaaaaaggcttagtgagagtgtaaattgctgtaacttattggtagtatctactaaaatttaaattgtgcacactttgattcatcagttctatttctgagaatctaccctaagaaaataaaagcactcttaatgcagagatagatccagcctgggcaacaagagcgaaactctgtctcgaaaaaaaaaaaaaaagtgcattttgaaagaacagctcttccttggaggaaatggttcaatagggtacgttcatattatggaataatattgagacattaagaagaaggaagtacgtcactggaagcctatccagaatatatttccaaaacaaaaaaaaatgcaagttgtagaataatatgtatagtatcatcccatgttttttttaa

SEQ ID NO: 313008 - DNA, 6451 bp, Homo sapiens
gaggcgctccgggatactgagggcggagggcggtggcagcgctggcgctggggaccggcttggtggcttcgggaaacagtttggcgccggcggccgtccgtgttactccgcatcccgccccgtctcggcacggctagcagccccctggccaccagcgtccagcaatgtgtctcaccggccgggcgtagcagctgcgcgtgcgcggaaccgcggggccatgagcgaagccggcggccggggctgtgggtccccggttccccagcgagcgcgatggagactagtggcggcgacggccgcgttctgcctggtgtcggccacctccgtgtggacggcgggggccgagcccatgagtagggaggagaaacagaagcttgggaatcaagtactggaaatgtttgatcatgcttatggtaactatatggaacatgcttaccctgctgatgaactcatgcctttaacctgtagaggtcgagttagaggccaagagccaagtcgcggtgacgttgatgatgccttgggaaaattttctctgacactgattgattctttggacactcttgttttaaataaaactaaagaatttgaagatgcagtgagaaaagttttaagagatgttaatttagataacgatgtagtcgtatcagtctttgaaacaaacatcagagttcttgggggtcttttgggtgggcactccctggcaatcatgctgaaagaaaaaggtgaatatatgcagtggtacaatgatgaacttctccaaatggcaaagcagttaggttacaaacttttaccggctttcaacactaccagtggccttccttatccaagaattaatttaaagtttggcatcagaaaaccagaagctcggacaggaactgagacagatacctgtacagcttgtgcaggtaccttgatccttgaatttgctgctttaagtcgattcacaggagcaacaatatttgaggaatatgccagaaaagctcttgattttctctgggaaaaaagacagcgaagtagtaatttagtgggcgtgactataaatattcatactggagattgggtacgaaaagatagtggagttggagcagggattgattcatattatgaatatctgttgaaagcctatgtcttgcttggagatgacagttttctggaaagatttaacacacactatgatgccataatgaggtatattagccagccacctcttctacttgatgtgcatatccacaaaccaatgctgaatgctcggacttggatggatgctttgcttgccttcttcccaggcttgcaggtgttaaagggggatattagacctgctattgaaactcatgaaatgttatatcaggtgattaaaaaacacaattttctaccagaggcatttaccacagatttcagagtacactgggctcaacatcctttaaggccagaatttgcagaaagtacctacttcttatataaagctacaggagatccttactaccttgaagtagggaagacacttattgaaaatttaaataaatatgctagagtgccttgcggatttgctgccatgaaggatgttcgtactggaagtcatgaggacagaatggattctttcttcttggctgaaatgtttaaatatctttacctgttatttgctgataaagaagacattatttttgacatagaagattacatctttacaacagaagctcatctgttacctctttggctctctactacaaatcaaagcatctctaaaaagaacacaacctcggaatatacagaactggatgacagtaacttcgattggacttgtccaaatactcagatcctctttcctaatgacccattgtatgctcaaagtattcgtgagcccttgaaaaatgtggtggataagagctgtcctagaggcatcatcagagtagaggagagtttcaggagtggagctaaaccccctctgagagccagagatttcatggccactaaccctgagcatttagaaatcctgaagaagatgggggtgagtttgattcacctcaaagatgggagagtccagttggtccaacatgcaatccaaggtagtattgactgctggaccagctcagtttgggctggatctgtctaaacataaagagacaagaggatttgttgcaagcagtaaaccatccaatggttgttcagagcttactaacccagaggcagtgatgggaaaaatcgcactgatacaaagaggacagtgcatgtttgcagaaaaggcacgcaacatccagaatgctggagccattggtggcattgttattgatgacaatgaggggagcagcagtgatactgcccctctgttccagatggcaggtgatggaaaggatacagatgacatcaagatccccatgctgttcttattcagcaaagaaggaagtatcatactggatgccatccgggaatatgaggaggtagaagtgctcctctctgataaagcaaaagatcgagatcctgaaatggaaaatgaagaacaaccatcctctgaaaatgattctcagaatcagagtggtgaacagatttcatcaagttctcaggaggttgatttggttgatcaagagtcttctgaggaaaattctctaaattctcacccagaatcattatctctagcagatatggacaatgctgcaagcatttccccttctgaacagacttctaatcccacagaaaaccatgagactacaaatcttaatggtgaatgtacagatttagataaccagcttcaagaacaatcagaaactgaggaagattccaatcctaatgttagctggggtaaaaaggtccagcctatagactccatattagcagactggaatgaagatatagaagcatttgaaatgatggagaaggatgagctatgacttgctaaacaatctgttggtaggtatttaaaaagaaaaggtaaactgtgtgtggttaatagacatcctaatactaagcaggctttctaatgggaggctttaagtatggtgatgaacaaccacgttctgactggcgtagttatcgtaggaatctggagcatgctgtgttagaattgaccttgtttaaaactgtcccatcaaaaatggaaatccacagttcccccttcaaatgcagcactgcaccaccctgcaacacctcaggccagggaaagattactgagcattcctgcgaaccagatttctgttgtctctggatagacaagaaacaaaattcatttagtagtggagtggggaataggagtttggatagccttctaattaaaggaagctcgcctttcttggttttgggggttagaggctcttttgggaagatgcatccgagtattgtggcattctgattatgctgccttcacaaaacactctaagtgacctaagtggttatgaagcaaatgcatttatggtgaaaacagtctttgctcattgctttctcttgtttcatttagtgacaaatgatcaagatgacttgattttttttccttcttaacaatgtcttttttatttaaaccaaaggtgaagccagtgtactttctcagtgagttctctgcataaagactaatcagtgggaccaggtaaaaaggtcatataatacattgtggagattgcttacttaatacttctgaaaaatggagtaagggagaaactgtaatgttgcaatatgaacctcccattgggccttccatagggaaagctgtgactactctgaaatggaacctagcattatatccttgtagggtagattataaatcatttccagttcatttctcttagaggtgattacctctagccatcagccttactccatcccatgtttggtatgcaatttgagccacaaggctcgtatcgccaacagctatatacattttgttccatttttctgtcttacagagccatgataaaactgtggttagtgagttaaaattcctggagtaactactgtttttctcctttgaaacttaggtttctaaagttgcacctaaggaatctgtcacattttctgttgaatcatggtttttgtttttgtttttaacagatattccttctgatacggacttgaaaattagtgtatggtgacctgtgtttaaaaaaaaaagtacaatacaactacatatagctatatagcttaatgagacttccaccccccccctttttttttttggtttgttgttgttgtagtagtctggtgctggccacatttaagtcttaaaaatttttaaattttgttgttgatgtttgtagacagccctgttgttgaaatcatggctttattcattttatttattttttaaacttgcctgaatttgttctaaaggaatatttaagagacataattttcttctctttaccataacattacacaaaactttttcctaaaacacggttgtgaggtactgatgaggtgtaagtggagctgttaaaaacagcagtgctgtattgcagttatgtatattcgtgtacagtatgtttagatcccaggtaaacatattcttttctgagaggataaatacctgcattcagatattccaggtaaatataattgagtcagggagtagtaaatctgatggagaattcactttggggaggggaaaaagaatagtatgcaagacccttattggcttttaattatacctgaaaccaaaatggatatttttagtctctctgcatgtgagatttggtgtaacaagatagaactataatatatacagtatatggaaggatagatatagtgctttgttcattttaattgcaaagctgccaaaatagttgaagcttaattacttgacttgccttgatttataggactggggcttggagaaaatgagcagatgttcctctaagacatcgattacagaagccttatatacatggatttgattttgtatttgtagctgaaagtcactgttgtctaaaactaacttttctaagttatcaaaacaacctaatttcttttccaacaaggagaacttaatggcatgaaggattgtgtgacacattggaaaagccagcttactgccactctcttcctttggccattagagggaggtgttgcctttcattgacgcttagaagcaaattgttcacttgttaagaaaagtaaatccttaaaaaaagaaaaggaaaaaatttaaccaatttttcttaatacccagaaggaattatactcaatatttccctagttaagaaaagaggagataatgttcgtctaaaaaactccaacgttgtaattacaactctacattcatttacttacttgacatactgccacaaagtagtttttgagttcattaaaaattccaaaggcattagttgtttttttttttttttagtgttttgttttttagttaacttttatagacattttagtaacttgctaaagattcaggggattctatgaaaccccgaatttagaaacatctggtctacctcagttaaatgttgactgcttagaaatatagctgaagtgatcaccacagccataaaattgtttaagaaagatttatataatgtttacaaatctggaatcaaggattttagctgaaatcctttaagagatattagagcaagtatttaattcaggtattttcaagttttaaaacttaacctgtttacctactaaaaataaaatagctagtttttttctgcatataaaagttcattgaaatgatatgcccttatttgcaatacttttcccataaagttttaagtgtgaaagaattgtaatttactagatatgtttggtatgggatattttgttaggcaagttttcttttttcttcttaaattgcaataggcttccaaaaagagtataattgtttcagaacaaattaactcttggcattatacgtctccctttttctttacagtattagtaaaaagaaaaattgtacactttctgattttaacttcactaatgtaattactctctcaagaagcttttaaaatttaaattaccatcacacaaccttttttatagtaaagccaacatttgttctctcaccaaaccccatgccaaattcatcatgaagaaagctcagcataagtaattcaaatactgcttataattttagaggggggtagaatttagtaaatattccagccggtcgttttatgcacaaggcttcagtcagaacatagaaaaaaaaaacattctgtgaatgaaatattgtatgttcagattttataaaagacatttttaaaagcccaatttacagccgtatattttcttatgatgtaatttatgaaaaagatgtctgtactaacaggtgctgtaacactactgttgttggattttattgtttggtgataaatgtatacaatatttctaagggaaactatgtactgtgatgtaaaagtctgggcaaaatgtatataatcctgtatataattatgtatttgattataattactgattgtaaagatttaataaaatatgtaaatattccagtttagtttta

SEQ ID NO: 313009 - DNA, 4754 bp, Homo sapiens
gaggcgctccgggatactgagggcggagggcggtggcagcgctggcgctggggaccggcttggtggcttcgggaaacagtttggcgccggcggccgtccgtgttactccgcatcccgccccgtctcggcacggctagcagccccctggccaccagcgtccagcaatgtgtctcaccggccgggcgtagcagctgcgcgtgcgcggaaccgcggggccatgagcgaagccggcggccggggctgtgggtccccggttccccagcgagcgcgatggagactagtggcggcgacggccgcgttctgcctggtgtcggccacctccgtgtggacggcgggggccgagcccatgagtagggaggagaaacagaagcttgggaatcaagtactggaaatgtttgatcatgcttatggtaactatatggaacatgcttaccctgctgatgaactcatgcctttaacctgtagaggtcgagttagaggccaagagccaagtcgcggtgacgttgatgatgccttgggaaaattttctctgacactgattgattctttggacactcttgttttaaataaaactaaagaatttgaagatgcagtgagaaaagttttaagagatgttaatttagataacgatgtagtcgtatcagtctttgaaacaaacatcagagttcttgggggtcttttgggtgggcactccctggcaatcatgctgaaagaaaaaggtgaatatatgcagtggtacaatgatgaacttctccaaatggcaaagcagttaggttacaaacttttaccggctttcaacactaccagtggccttccttatccaagaattaatttaaagtttggcatcagaaaaccagaagctcggacaggaactgagacagatacctgtacagcttgtgcaggtaccttgatccttgaatttgctgctttaagtcgattcacaggagcaacaatatttgaggaatatgccagaaaagctcttgattttctctgggaaaaaagacagcgaagtagtaatttagtgggcgtgactataaatattcatactggagattgggtacgaaaagatagtggagttggagcagggattgattcatattatgaatatctgttgaaagcctatgtcttgcttggagatgacagttttctggaaagatttaacacacactatgatgccataatgaggtatattagccagccacctcttctacttgatgtgcatatccacaaaccaatgctgaatgctcggacttggatggatgctttgcttgccttcttcccaggcttgcaggtgttaaagggggatattagacctgctattgaaactcatgaaatgttatatcaggtgattaaaaaacacaattttctaccagaggcatttaccacagatttcagagtacactgggctcaacatcctttaaggccagaatttgcagaaagtacctacttcttatataaagctacaggagatccttactaccttgaagtagggaagacacttattgaaaatttaaataaatatgctagagtgccttgcggatttgctgccatgaaggatgttcgtactggaagtcatgaggacagaatggattctttcttcttggctgaaatgtttaaatatctttacctgttatttgctgataaagaagacattatttttgacatagaagattacatctttacaacagaagctcatctgttacctctttggctctctactacaaatcaaagcatctctaaaaagaacacaacctcggaatatacagaactggatgacagtaacttcgattggacttgtccaaatactcagatcctctttcctaatgacccattgtatgctcaaagtattcgtgagcccttgaaaaatgtggtggataagagctgtcctagaggcatcatcagagtagaggagagtttcaggagtggagctaaaccccctctgagagccagagatttcatggccactaaccctgagcatttagaaatcctgaagaagatgggggtgagtttgattcacctcaaagatgggagagtccagttggtccaacatgcaatccaagctgctagttcaatcgacgctgaagatgggttgaggttcatgcaggagatgattgaattgtcaagtcagcaacaaaaagaacagcagctgcctccacgagctgtacaaattgtttcccacccattttttggcagggtagtattgactgctggaccagctcagtttgggctggatctgtctaaacataaagagacaagaggatttgttgcaagcagtaaaccatccaatggttgttcagagcttactaacccagaggcagtgatgggaaaaatcgcactgatacaaagaggacagtgcatgtttgcagaaaaggcacgcaacatccagaatgctggagccattggtggcattgttattgatgacaatgaggggagcagcagtgatactgcccctctgttccagatggcaggtgatggaaaggatacagatgacatcaagatccccatgctgttcttattcagcaaagaaggaagtatcatactggatgccatccgggaatatgaggaggtagaagtgctcctctctgataaagcaaaagatcgagatcctgaaatggaaaatgaagaacaaccatcctctgaaaatgattctcagaatcagagtggtgaacagatttcatcaagttctcaggaggttgatttggttgatcaagagtcttctgaggaaaattctctaaattctcacccagaatcattatctctagcagatatggacaatgctgcaagcatttccccttctgaacagacttctaatcccacagaaaaccatgagactacaaatcttaatggtgaatgtacagatttagataaccagcttcaagaacaatcagaaactgaggaagattccaatcctaatgttagctggggtaaaaaggtccagcctatagactccatattagcagactggaatgaagatatagaagcatttgaaatgatggagaaggatgagctatgacttgctaaacaatctgttggtgaagccagtgtactttctcagtgagttctctgcataaagactaatcagtgggaccaggtaaaaaggactggggcttggagaaaatgagcagatgttcctctaagacatcgattacagaagccttatatacatggatttgattttgtatttgtagctgaaagtcactgttgtctaaaactaacttttctaagttatcaaaacaacctaatttcttttccaacaaggagaacttaatggcatgaaggattgtgtgacacattggaaaagccagcttactgccactctcttcctttggccattagagggaggtgttgcctttcattgacgcttagaagcaaattgttcacttgttaagaaaagtaaatccttaaaaaaagaaaaggaaaaaatttaaccaatttttcttaatacccagaaggaattatactcaatatttccctagttaagaaaagaggagataatgttcgtctaaaaaactccaacgttgtaattacaactctacattcatttacttacttgacatactgccacaaagtagtttttgagttcattaaaaattccaaaggcattagttgtttttttttttttttagtgttttgttttttagttaacttttatagacattttagtaacttgctaaagattcaggggattctatgaaaccccgaatttagaaacatctggtctacctcagttaaatgttgactgcttagaaatatagctgaagtgatcaccacagccataaaattgtttaagaaagatttatataatgtttacaaatctggaatcaaggattttagctgaaatcctttaagagatattagagcaagtatttaattcaggtattttcaagttttaaaacttaacctgtttacctactaaaaataaaatagctagtttttttctgcatataaaagttcattgaaatgatatgcccttatttgcaatacttttcccataaagttttaagtgtgaaagaattgtaatttactagatatgtttggtatgggatattttgttaggcaagttttcttttttcttcttaaattgcaataggcttccaaaaagagtataattgtttcagaacaaattaactcttggcattatacgtctccctttttctttacagtattagtaaaaagaaaaattgtacactttctgattttaacttcactaatgtaattactctctcaagaagcttttaaaatttaaattaccatcacacaaccttttttatagtaaagccaacatttgttctctcaccaaaccccatgccaaattcatcatgaagaaagctcagcataagtaattcaaatactgcttataattttagaggggggtagaatttagtaaatattccagccggtcgttttatgcacaaggcttcagtcagaacatagaaaaaaaaaacattctgtgaatgaaatattgtatgttcagattttataaaagacatttttaaaagcccaatttacagccgtatattttcttatgatgtaatttatgaaaaagatgtctgtactaacaggtgctgtaacactactgttgttggattttattgtttggtgataaatgtatacaatatttctaagggaaactatgtactgtgatgtaaaagtctgggcaaaatgtatataatcctgtatataattatgtatttgattataattactgattgtaaagatttaataaaatatgtaaatattccagtttagtttta

SEQ ID NO: 313010 - DNA, 998 bp, Homo sapiens
cttttcctccctgtcgccaccgaggtcgcacgcgtgagacttctccgccgcctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatctaaaaaaaaaaaaaaaaaaaaaaaaatttaaattaccatcacacaaccttttttatagtaaagccaacatttgttctctcaccaaaccccatgccaaattcatcatgaagaaagctcagcataagtaattcaaatactgcttataattttagaggggggtagaatttagtaaatattccagccggtcgttttatgcacaaggcttcagtcagaacatagaaaaaaaaaacattctgtgaatgaaatattgtatgttcagattttataaaagacatttttaaaagcccaatttacagccgtatattttcttatgatgtaatttatgaaaaagatgtctgtactaacaggtgctgtaacactactgttgttggattttattgtttggtgataaatgtatacaatatttctaagggaaactatgtactgtgatgtaaaagtctgggcaaaatgtatataatcctgtatataattatgtatttgattataattactgattgtaaagatttaataaaatatgtaaatattccagtttagtttta

SEQ ID NO: 313011 - DNA, 4147 bp, Homo sapiens
  misc_feature (3464)..(3464): n is a, c, g, or t
atccaacacgagtaactactaaattaaacgtctgttttagctgatgtctgaaaggccattacctcatagttgattggcaaaatatgagttcataaagaattttcctttctgcttaggaggataaagcaatacaataattaaaggatatctaatatgcaaaagtctatatttagggaaatattaaatattctctttaaaatgttcaaatgtcatacatatgttaatgtatccaatgctttgaaactttataggggcaatatagggatgaaaattaaaaagcagtgactgaggggcctggcataggcaaaatcatagagatagaaaatagagctgagtgtgattagtgtttagtgggtggagtttctgtttgggatagcaaaaagttctggatgtggacagtggtaatagttgcaagacaacacgaatgtacttaatgtcactgaattgtacgcttaaatgataaccattgacatttttctattacaaacttaaatctaaatttcaccataatttaaacaaaaagcaatggctagagtgaggagagtcagcttcaatgcttcagtaggcccccgaccagctgggagcagatctggaagatggacggttgtggtgtcttctaaatgtaaaattgcacaattttggtattcgctatcccatttactcctcacaataattatgtgagatgtgtatggcagaaaactccattttaaagattaagtatcgaaaaacagaaaaatatttaaaaattatatcaaaagtcatctcttaaaagagattatcttgaaatcaaaagagaaccaaataataatcatcatcagtaaaagacccagtaaaacatgggacctcccaactgtagccaaagaaaaagcaatttctgataacatctcatttcattcccctttatcacttcttcagtgctttctttgtcctccttcctcagctactataattcatcttcattatcttaaaaagaagtctgcattaggaaagggtgagagataatgaagtaacagaaaaataatctcaaacactttactatttaaataataaacctgggttatagcttatgaaacagtgcaatgaagtatcatattacaataagaacaagtttcaaaaccaacattaaaataagcgataagtaagaaagccataaaaaaggaaacaataaattgttataatattgtttttataatttgcttactaactcgtatgtttttaggcatttataatgcagtatggcacacacctgaaattccttaactcagtggtttttaaacttaattgttgccgggtgcgttggctcatgcctgtaatcccagcactttgggagcccgaggcgggcagatcacttgaggtcaggagtttgagaccagcctggccaacatggtgaaaccctgtctctactaaaaatacaaaaattagccagccatggtagtgcatgtctgtaatcctggctgctagggaggctgaggcagaagaattgcttgaacccagcaggcggaggttgcagtgagcagagatcatgccactgcactccagcctgggcgacagagtaagactctgtctcaaaaaaaaaaaaccaacttaattgtatatctaaaattcttgtggcttgtttcacccttccttccatcccaggcctctaaatcagaacagaggcaggttagtgtttgttttttaagtttcaagtgattctaatgtaccagccttgggaaatacctccgtaactgttgaaaagggttcagaatataattttaaataaaattactttagatcaaaacagacttacaataagtataatatcacataaaggatcaactttcaagcgccaaagaatacaggtgtgtacttgaagaccttttagtagtgaaactcagcagctgtaggcagtgaagaaaggagcatatgtgataaacaaaattagctgtggtcaacaattatgctatagctaacttatgtagtcagtactttccagtgaagttgaaaataaagcaaagttccatgtattaaccctgttttccactaacccttctttacatgtaggacatatgccagggtaccaaaaactgcaggaatattccctagcattgcagcctcagttctaataccaaaatctccctgcagactaaatgtctagagcagcactgtatcaatagaacataggggcagatctcataccttccaagggtagaaatcgctgagcacaggtaaaaataaaatattccagagggaaatattattttacaaatttttataaacacttttgtaaaataatgtacacagccttgcacactgaaagagtcaaagccatttaactctgtataaccactgcagaatctttatcttcttttttacctgacttccaattggcgggtgttactaaaactttatcaccaaagttatttcactagctgagcgtggtggctcatgcctgtaatcccaacactttgggaggccaaggcaggtggatcatttgaggccaggagtttgacaccaacctggccaacacggtgaaacctcatctccactaaaaatacaacaaattggctgggtgtggtggcgcatacctgtaatcccagctactcagaaggctgaggcacgagaatcacttgagcctgggaggcataggttgcaatgagtcaagatcgcgccactgcactccagcctgggagacagagcaagactgtctcaatgtctcaaaaaaaaaaaaaaaagttatttcactagcaacatataattaccataaaacaaaggagggttttaaatgaactacacatgcaaaatacactagaaaagctagatatttttaaaaacgtggtgaattatttggtaaagccaaaatattttaattcataagttactattcccccaatgcatctattttgtaaatgctgtttcacatatgaggtttgtaaaaaagcaaaatatatgtataaaatggcgtacataaagatgttctacaaatatagccagaagttattgttttactgtatgcaaagagtgatggcaatttttaattcaaatgtttttaaatatttcgaactgaaactaaatcttaccaatgtaaaattgccacaaagacggctggaaaagagaaaagttattaaaagctgctttattataaaataccattaaaacaagtatttcaaatgtattattttacatgtctagaaaagatagcacagaaagcaagatggccagctaatcctgtctctatgagcataggaaaaaatccaggacacaaagtaaattctgaacagagcttacctctctgcagcagggcttgacaagcaaagggagagacttgagagggtttttttacttcagttaattggtaggagtgatggaattatggaatattgtgaccttttttgtttttctttttagtattctattcctttatatgaaattttttaaagaagtaaatatatacagtatgcttcagctcgttctaaccaagaggngccactctagatcagtttctctagcattcatcagaagacgattaaatgcaggcaatcacttcctcagcagcacatctaaaagccccattgtgcaactcaacccttgatgaattgcaagctctttgcaagcgcccagacttaggaactactagatggcctaggagacttatctggaggcacctgtgccagcaccccatgtatacgtaagacttcaccagggagctgggagacactgctctgggtatggagcttttaccagagctgcaaacgcagcctgtgcccctgtttcgttggggaattgcttgttttcaagggtaccatggagctggagagagaaaagtggggaatagaacaagttaaaacaccacagactttgctgttcttatagaggttcagcagcttttcttgaattaatgccctttagattgttgtaaacctttggttaacttccaaagttttgaagaaaatgattttgataattttccaagtattttcattgtcatcatggaggagtgcatttccttggctattccagaagtcctacctcccttctgagattttataatggtatttcttatggttatcccaaatatacttggcaagtcgtcttataaaccaccaataatagcctcttaaaaattcaaaaattactcctcttggctaacaaaataaatgcaaattaa

SEQ ID NO: 313012 - DNA, 5103 bp, Homo sapiens
  misc_feature (3464)..(3464): n is a, c, g, or t
atccaacacgagtaactactaaattaaacgtctgttttagctgatgtctgaaaggccattacctcatagttgattggcaaaatatgagttcataaagaattttcctttctgcttaggaggataaagcaatacaataattaaaggatatctaatatgcaaaagtctatatttagggaaatattaaatattctctttaaaatgttcaaatgtcatacatatgttaatgtatccaatgctttgaaactttataggggcaatatagggatgaaaattaaaaagcagtgactgaggggcctggcataggcaaaatcatagagatagaaaatagagctgagtgtgattagtgtttagtgggtggagtttctgtttgggatagcaaaaagttctggatgtggacagtggtaatagttgcaagacaacacgaatgtacttaatgtcactgaattgtacgcttaaatgataaccattgacatttttctattacaaacttaaatctaaatttcaccataatttaaacaaaaagcaatggctagagtgaggagagtcagcttcaatgcttcagtaggcccccgaccagctgggagcagatctggaagatggacggttgtggtgtcttctaaatgtaaaattgcacaattttggtattcgctatcccatttactcctcacaataattatgtgagatgtgtatggcagaaaactccattttaaagattaagtatcgaaaaacagaaaaatatttaaaaattatatcaaaagtcatctcttaaaagagattatcttgaaatcaaaagagaaccaaataataatcatcatcagtaaaagacccagtaaaacatgggacctcccaactgtagccaaagaaaaagcaatttctgataacatctcatttcattcccctttatcacttcttcagtgctttctttgtcctccttcctcagctactataattcatcttcattatcttaaaaagaagtctgcattaggaaagggtgagagataatgaagtaacagaaaaataatctcaaacactttactatttaaataataaacctgggttatagcttatgaaacagtgcaatgaagtatcatattacaataagaacaagtttcaaaaccaacattaaaataagcgataagtaagaaagccataaaaaaggaaacaataaattgttataatattgtttttataatttgcttactaactcgtatgtttttaggcatttataatgcagtatggcacacacctgaaattccttaactcagtggtttttaaacttaattgttgccgggtgcgttggctcatgcctgtaatcccagcactttgggagcccgaggcgggcagatcacttgaggtcaggagtttgagaccagcctggccaacatggtgaaaccctgtctctactaaaaatacaaaaattagccagccatggtagtgcatgtctgtaatcctggctgctagggaggctgaggcagaagaattgcttgaacccagcaggcggaggttgcagtgagcagagatcatgccactgcactccagcctgggcgacagagtaagactctgtctcaaaaaaaaaaaaccaacttaattgtatatctaaaattcttgtggcttgtttcacccttccttccatcccaggcctctaaatcagaacagaggcaggttagtgtttgttttttaagtttcaagtgattctaatgtaccagccttgggaaatacctccgtaactgttgaaaagggttcagaatataattttaaataaaattactttagatcaaaacagacttacaataagtataatatcacataaaggatcaactttcaagcgccaaagaatacaggtgtgtacttgaagaccttttagtagtgaaactcagcagctgtaggcagtgaagaaaggagcatatgtgataaacaaaattagctgtggtcaacaattatgctatagctaacttatgtagtcagtactttccagtgaagttgaaaataaagcaaagttccatgtattaaccctgttttccactaacccttctttacatgtaggacatatgccagggtaccaaaaactgcaggaatattccctagcattgcagcctcagttctaataccaaaatctccctgcagactaaatgtctagagcagcactgtatcaatagaacataggggcagatctcataccttccaagggtagaaatcgctgagcacaggtaaaaataaaatattccagagggaaatattattttacaaatttttataaacacttttgtaaaataatgtacacagccttgcacactgaaagagtcaaagccatttaactctgtataaccactgcagaatctttatcttcttttttacctgacttccaattggcgggtgttactaaaactttatcaccaaagttatttcactagctgagcgtggtggctcatgcctgtaatcccaacactttgggaggccaaggcaggtggatcatttgaggccaggagtttgacaccaacctggccaacacggtgaaacctcatctccactaaaaatacaacaaattggctgggtgtggtggcgcatacctgtaatcccagctactcagaaggctgaggcacgagaatcacttgagcctgggaggcataggttgcaatgagtcaagatcgcgccactgcactccagcctgggagacagagcaagactgtctcaatgtctcaaaaaaaaaaaaaaaagttatttcactagcaacatataattaccataaaacaaaggagggttttaaatgaactacacatgcaaaatacactagaaaagctagatatttttaaaaacgtggtgaattatttggtaaagccaaaatattttaattcataagttactattcccccaatgcatctattttgtaaatgctgtttcacatatgaggtttgtaaaaaagcaaaatatatgtataaaatggcgtacataaagatgttctacaaatatagccagaagttattgttttactgtatgcaaagagtgatggcaatttttaattcaaatgtttttaaatatttcgaactgaaactaaatcttaccaatgtaaaattgccacaaagacggctggaaaagagaaaagttattaaaagctgctttattataaaataccattaaaacaagtatttcaaatgtattattttacatgtctagaaaagatagcacagaaagcaagatggccagctaatcctgtctctatgagcataggaaaaaatccaggacacaaagtaaattctgaacagagcttacctctctgcagcagggcttgacaagcaaagggagagacttgagagggtttttttacttcagttaattggtaggagtgatggaattatggaatattgtgaccttttttgtttttctttttagtattctattcctttatatgaaattttttaaagaagtaaatatatacagtatgcttcagctcgttctaaccaagaggngccactctagatcagtttctctagcattcatcagaagacgattaaatgcaggcaatcacttcctcagcagcacatctaaaagccccattgtgcaactcaacccttgatgaattgcaagctctttgcaagcgcccagacttaggaactactagatggcctaggagacttatctggaggcacctgtgccagcaccccatgtatacgtaagacttcaccagggagctgggagacactgctctgggtatggagcttttaccagagctgcaaacgcagcctgtgcccctgtttcgttggggaattgcttgttttcaagggtaccatggagctggagagagaaaagtggggaatagaacaagttaaaacaccacagactttgctgttcttatagaggttcagcagcttttcttgaattaatgccctttagattgttgtaaacctttggttaacttccaaagttttgaagaaaatgattttgataattttccaagtattttcattgtcatcatggaggagtgcatttccttggctattccagaagtcctacctcccttctgagattttataatggtatttcttatggttatcccaaatatacttggcaagtcgtcttataaaccaccaataatagcctcttaaaaattcaaaaattactcctcttggctaacaaaataaatgcaaattaatttaataattgttgaagaaattaaattttttaaaattaaaaaattgcaatgttgaaattctcaaccatgcttatccagaccttttcctatactactaactgccctgggcttatcttaaatacttctcagaagatttacttgttttacaccaggataggcaaagtatggcccacagtgtatttttggactgtctgcaagcacagttgctataatttttaaaaggctgaaaactttaaatttttgtaaatatgctcattaactgtttattaggcttcattaattttaaaatatacagagactatcctattcaactatatttgtatcctatttctaattctcctaacaattatatacactggcaaaaactcttcagatgatatataaggaaaaggtcaaatatactaccgaattcatccagctttccaaagatgctcaaaatctttctgtgtctctcactccctcccttaacccacataccacatctgaaaaaaaatgatatggtgtaacgatgccagtattctaaatgcttgaagggcttatcacatgccctttccaagctgtgacagaagcatgtcccttggaccccggcatcctgtcaatctcacctctgaaggtgacccagtctcatacttcactgaaacaaagaccattagacgccagcactcccgacttcttttatctccactttaacatttctccatatagtaatcctcacttttctactccctgtcatctcagaaaaggaattctctctcctcttttccacagttagcttctcaaatttgtgcctttaattctacccctcccaaatattccaagacttgctccactaattatttcctctcttggaatcttaatctcatcctcttcccttgatccctcccctcagcctttaaaactcctagaccttaaaacactctctgtgatctgacagcccttcaaaccaatatactccc

SEQ ID NO: 313013 - DNA, 2321 bp, Homo sapiens
  misc_feature (1638)..(1638): n is a, c, g, or t
atccaacacgagtaactactaaattaaacgtctgttttagctgatgtctgaaaggccattacctcatagttgattggcaaaatatgagttcataaagaattttcctttctgcttaggaggataaagcaatacaataattaaaggatatctaatatgcaaaagtctatatttagggaaatattaaatattctctttaaaatgttcaaatgtcatacatatgttaatgtatccaatgctttgaaactttataggggcaatatagggatgaaaattaaaaagcagtgactgaggggcctggcataggcaaaatcatagagatagaaaatagagctgagtgtgattagtgtttagtgggtggagtttctgtttgggatagcaaaaagttctggatgtggacagtggtaatagttgcaagacaacacgaatgtacttaatgtcactgaattgtacgcttaaatgataaccattgacatttttctattacaaacttaaatctaaatttcaccataatttaaacaaaaagcaatggctagagtgaggagagtcagcttcaatgcttcagtaggcccccgaccagctgggagcagatctggaagatggacggttgtggtgtcttctaaatgtaaaattgcacaattttggtattcgctatcccatttactcctcacaataattatgtgagatgtgtatggcagaaaactccattttaaagattaagtatcgaaaaacagaaaaatatttaaaaattatatcaaaagtcatctcttaaaagagattatcttgaaatcaaaagagaaccaaataataatcatcatcagtaaaagacccagtaaaacatgggacctcccaactgtagccaaagaaaaagcaatttctgataacatctcatttcattcccctttatcacttcttcagtgctttctttgtcctccttcctcagctactataattcatcttcattatcttaaaaagaagtctgcattaggaaagggtgagagataatgaagtaacagaaaaataatctcaaacactttatattcccccaatgcatctattttgtaaatgctgtttcacatatgaggtttgtaaaaaagcaaaatatatgtataaaatggcgtacataaagatgttctacaaatatagccagaagttattgttttactgtatgcaaagagtgatggcaatttttaattcaaatgtttttaaatatttcgaactgaaactaaatcttaccaatgtaaaattgccacaaagacggctggaaaagagaaaagttattaaaagctgctttattataaaataccattaaaacaagtatttcaaatgtattattttacatgtctagaaaagatagcacagaaagcaagatggccagctaatcctgtctctatgagcataggaaaaaatccaggacacaaagtaaattctgaacagagcttacctctctgcagcagggcttgacaagcaaagggagagacttgagagggtttttttacttcagttaattggtaggagtgatggaattatggaatattgtgaccttttttgtttttctttttagtattctattcctttatatgaaattttttaaagaagtaaatatatacagtatgcttcagctcgttctaaccaagaggngccactctagatcagtttctctagcattcatcagaagacgattaaatgcaggcaatcacttcctcagcagcacatctaaaagccccattgtgcaactcaacccttgatgaattgcaagctctttgcaagcgcccagacttaggaactactagatggcctaggagacttatctggaggcacctgtgccagcaccccatgtatacgtaagacttcaccagggagctgggagacactgctctgggtatggagcttttaccagagctgcaaacgcagcctgtgcccctgtttcgttggggaattgcttgttttcaagggtaccatggagctggagagagaaaagtggggaatagaacaagttaaaacaccacagactttgctgttcttatagaggttcagcagcttttcttgaattaatgccctttagattgttgtaaacctttggttaacttccaaagttttgaagaaaatgattttgataattttccaagtattttcattgtcatcatggaggagtgcatttccttggctattccagaagtcctacctcccttctgagattttataatggtatttcttatggttatcccaaatatacttggcaagtcgtcttataaaccaccaataatagcctcttaaaaattcaaaaattactcctcttggctaacaaaataaatgcaaattaa

SEQ ID NO: 313014 - DNA, 1601 bp, Homo sapiens
  misc_feature (918)..(918): n is a, c, g, or t
gactaaatatcttggttaagagaataaggtcccttaaattacccttatttgggaaaactttaaagatggagacttagataaaaaaaataaaggttgagaatatgtttatcaggggctaaaacagcaccagttggggggcctttttttgtctcaaaaaaaaaaaaaaaagttatttcactagcaacatataattaccataaaacaaaggagggttttaaatgaactacacatgcaaaatacactagaaaagctagatatttttaaaaacgtggtgaattatttggtaaagccaaaatattttaattcataagttactattcccccaatgcatctattttgtaaatgctgtttcacatatgaggtttgtaaaaaagcaaaatatatgtataaaatggcgtacataaagatgttctacaaatatagccagaagttattgttttactgtatgcaaagagtgatggcaatttttaattcaaatgtttttaaatatttcgaactgaaactaaatcttaccaatgtaaaattgccacaaagacggctggaaaagagaaaagttattaaaagctgctttattataaaataccattaaaacaagtatttcaaatgtattattttacatgtctagaaaagatagcacagaaagcaagatggccagctaatcctgtctctatgagcataggaaaaaatccaggacacaaagtaaattctgaacagagcttacctctctgcagcagggcttgacaagcaaagggagagacttgagagggtttttttacttcagttaattggtaggagtgatggaattatggaatattgtgaccttttttgtttttctttttagtattctattcctttatatgaaattttttaaagaagtaaatatatacagtatgcttcagctcgttctaaccaagaggngccactctagatcagtttctctagcattcatcagaagacgattaaatgcaggcaatcacttcctcagcagcacatctaaaagccccattgtgcaactcaacccttgatgaattgcaagctctttgcaagcgcccagacttaggaactactagatggcctaggagacttatctggaggcacctgtgccagcaccccatgtatacgtaagacttcaccagggagctgggagacactgctctgggtatggagcttttaccagagctgcaaacgcagcctgtgcccctgtttcgttggggaattgcttgttttcaagggtaccatggagctggagagagaaaagtggggaatagaacaagttaaaacaccacagactttgctgttcttatagaggttcagcagcttttcttgaattaatgccctttagattgttgtaaacctttggttaacttccaaagttttgaagaaaatgattttgataattttccaagtattttcattgtcatcatggaggagtgcatttccttggctattccagaagtcctacctcccttctgagattttataatggtatttcttatggttatcccaaatatacttggcaagtcgtcttataaaccaccaataatagcctcttaaaaattcaaaaattactcctcttggctaacaaaataaatgcaaattaa

SEQ ID NO: 313015 - DNA, 424 bp, Homo sapiens
tttggtgaggggggtggtgtggtgataaaaagagtagaaaaaaggaaaagaaaaaataaaaaagaaaaaaaaaaaaaaaaaaaaaaaaaaaaaaaaaaaaaaaaaaaaatctacctgctttacagactgtgggaaaagaatctacctgctttacagttgcatgacatggtcacttaagagagtggggacagaaagacatggacctgggtagctttggaaaatggtgttttgactataatctataaaaactacaaaaagaactgcataaacgctgtactctagtgggtaaagtttctcatgggacacaggttgacagttccaacgctgctttatatatgtacaagggttaaacaaatagtgaaggggtggtggatggagagagccaagtttcccacagctggagaggaaagtcaaaggtatgcaa

SEQ ID NO: 313016 - DNA, 806 bp, Homo sapiens
tgatttctagtgattgcatgtaattcattttccagcctgtaggtgtaacataattttttcaactatttacttattactgaattttaaataacactgcagtgaacattattctagttttattgaatgacttccagcaattaactgtgttgaattactaaacatagtagtttctttcaataaatttgtggaatatgttcatcttattagtatctgagtaatttacttcgtggtccagaactgagctaggtgtcagggatacacgtagacataagtattgtagtactaaggataaaacaatgcgtataccaataggaagggatgtcagctacttaagtaaatagactttaattatttagataaaatagacatgaaagaactttagtgtatgcaaatttataaaacatcaaccagcagctgttcatacctctccatgtgtggggtgttgggagtggggcactgagatgcagactgtggcaaaaaaaaaaaaaaaatctacctgctttacagactgtgggaaaagaatctacctgctttacagttgcatgacatggtcacttaagagagtggggacagaaagacatggacctgggtagctttggaaaatggtgttttgactataatctataaaaactacaaaaagaactgcataaacgctgtactctagtgggtaaagtttctcatgggacacaggttgacagttccaacgctgctttatatatgtacaagggttaaacaaatagtgaaggggtggtggatggagagagccaagtttcccacagctggagaggaaagtcaaaggtatgcaa

SEQ ID NO: 313017 - DNA, 6658 bp, Homo sapiens
aaagccctcagcctttgtgtccttctctgcgccggagtggctgcagctcacccctcagctccccttggggcccagctgggagccgagatagaagctcctgtcgccgctgggcttctcgcctcccgcagagggccacacagagaccgggatggccacctccatgggcctgctgctgctgctgctgctgctcctgacccagcccggggcggggacgggagctgacacggaggcggtggtctgcgtggggaccgcctgctacacggcccactcgggcaagctgagcgctgccgaggcccagaaccactgcaaccagaacgggggcaacctggccactgtgaagagcaaggaggaggcccagcacgtccagcgagtactggcccagctcctgaggcgggaggcagccctgacggcgaggatgagcaagttctggattgggctccagcgagagaagggcaagtgcctggaccctagtctgccgctgaagggcttcagctgggtgggcgggggggaggacacgccttactctaactggcacaaggagctccggaactcgtgcatctccaagcgctgtgtgtctctgctgctggacctgtcccagccgctccttcccaaccgcctgcccaagtggtctgagggcccctgtgggagcccaggctcccccggaagtaacattgagggcttcgtgtgcaagttcagcttcaaaggcatgtgccggcctctggccctggggggcccaggtcaggtgacctacaccacccccttccagaccaccagttcctccttggaggctgtgccctttgcctctgcggccaatgtagcctgtggggaaggtgacaaggacgagactcagagtcattatttcctgtgcaaggagaaggcccccgatgtgttcgactggggcagctcgggccccctctgtgtcagccccaagtatggctgcaacttcaacaatgggggctgccaccaggactgctttgaagggggggatggctccttcctctgcggctgccgaccaggattccggctgctggatgacctggtgacctgtgcctctcgaaacccttgcagctccagcccatgtcgtgggggggccacgtgcgtcctgggaccccatgggaaaaactacacgtgccgctgcccccaagggtaccagctggactcgagtcagctggactgtgtggacgtggatgaatgccaggactccccctgtgcccaggagtgtgtcaacacccctgggggcttccgctgcgaatgctgggttggctatgagccgggcggtcctggagagggggcctgtcaggatgtggatgagtgtgctctgggtcgctcgccttgcgcccagggctgcaccaacacagatggctcatttcactgctcctgtgaggagggctacgtcctggccggggaggacgggactcagtgccaggacgtggatgagtgtgtgggcccggggggccccctctgcgacagcttgtgcttcaacacacaagggtccttccactgtggctgcctgccaggctgggtgctggccccaaatggggtctcttgcaccatggggcctgtgtctctgggaccaccatctgggccccccgatgaggaggacaaaggagagaaagaagggagcaccgtgccccgcgctgcaacagccagtcccacaaggggccccgagggcacccccaaggctacacccaccacaagtagaccttcgctgtcatctgacgcccccatcacatctgccccactcaagatgctggcccccagtgggtcctcaggcgtctggagggagcccagcatccatcacgccacagctgcctctggcccccaggagcctgcaggtggggactcctccgtggccacacaaaacaacgatggcactgacgggcaaaagctgcttttattctacatcctaggcaccgtggtggccatcctactcctgctggccctggctctggggctactggtctatcgcaagcggagagcgaagagggaggagaagaaggagaagaagccccagaatgcggcagacagttactcctgggttccagagcgagctgagagcagggccatggagaaccagtacagtccgacacctgggacagactgctgaaagtgaggtggccctagagacactagagtcaccagccaccatcctcagagctttgaactccccattccaaaggggcacccacatttttttgaaagactggactggaatcttagcaaacaattgtaagtctcctccttaaaggccccttggaacatgcaggtattttctacgggtgtttgatgttcctgaagtggaagctgtgtgttggcgtgccacggtggggatttcgtgactctataatgattgttactccccctcccttttcaaattccaatgtgaccaattccggatcagggtgtgaggaggctggggctaaggggctcccctgaatatcttctctgctcacttccaccatctaagaggaaaaggtgagttgctcatgctgattaggattgaaatgatttgtttctcttcctaggatgaaaactaaatcaattaattattcaattaggtaagaagatctggttttttggtcaaagggaacatgttcggactggaaacatttctttacatttgcattcctccatttcgccagcacaagtcttgctaaatgtgatactgttgacatcctccagaatggccagaagtgcaattaacctcttaggtggcaaggaggcaggaagtgcctctttagttcttacatttctaatagccttgggtttatttgcaaaggaagcttgaaaaatatgagaaaagttgcttgaagtgcattacaggtgtttgtgaagtcacataatctacggggctagggcgagagaggccagggatttgttcacagatacttgaattaattcatccaaatgtactgaggttaccacacacttgactacggatgtgatcaacactaacaaggaaacaaattcaaggacaacctgtctttgagccagggcaggcctcagacaccctgcctgtggccccgcctccacttcatcctgcccggaatgccagtgctccgagctcagacagaggaagccctgcagaaagttccatcaggctgtttcctaaaggatgtgtgaacgggagatgatgcactgtgttttgaaagttgtcattttaaagcattttagcacagttcatagtccacagttgatgcagcatcctgagattttaaatcctgaagtgtgggtggcgcacacaccaagtagggagctagtcaggcagtttgcttaaggaacttttgttctctgtctcttttccttaaaattgggggtaaggagggaaggaagagggaaagagatgactaactaaaatcatttttacagcaaaaactgctcaaagccatttaaattatatcctcattttaaaagttacatttgcaaatatttctccctatgataatgtagtcgatagtgtgcactctttctctctctctctctctctcacacacacacacacacacacacacacacacacagagacacggcaccattctgcctggggcactggaacacattcctgggggtcaccgatggtcagagtcactagaagttacctgagtatctctgggaggcctcatgtctcctgtgggctttttaccaccactgtgcaggagaacagacagaggaaatgtgtctccctccaaggccccaaagcctcagagaaagggtgtttctggttttgccttagcaatgcatcggtctctgaggtgacactctggagcggttgaagggccacaaggtgcagggttaatactcttgccagttttgaaatatagatgctatggttcagattgtttttaatagaaaactaaaggggcaggggaagtgaaaggaaagatggaggttttgtgcggctcgatggggcatttggaacttctttttaaagtcatctcatggtctccagttttcagttggaactctggtgtttaacacttaagggagacaaaggctgtgtccatttggcaaaacttccttggccacgagactctaggtgatgtgtgaagctgggcagtctgtggtgtggagagcagccatctgtctggccattcagaggattctaaagacatggctggatgcgctgctgaccaacatcagcacttaaataaatgcaaatgcaacatttctccctctgggccttgaaaatccttgcccttatcatttggggtgaaggagacatttctgtccttggcttcccacagccccaacgcagtctgtgtatgattcctgggatccaacgagccctcctattttcacagtgttctgattgctctcacagcccaggcccatcgtctgttctctgaatgcagccctgttctcaacaacagggaggtcatggaacccctctgtggaacccacaaggggagaaatgggtgataaagaatccagttcctcaaaaccttccctggcaggctgggtccctctcctgctgggtggtgctttctcttgcacaccactcccaccacggggggagagccagcaacccaaccagacagctcaggttgtgcatctgatggaaaccactgggctcaaacacgtgctttattctcctgtttatttttgctgttactttgaagcatggaaattcttgtttgggggatcttggggctacagtagtgggtaaacaaatgcccaccggccaagaggccattaacaaatcgtccttgtcctgaggggccccagcttgctcgggcgtggcacagtggggaatccaagggtcacagtatggggagaggtgcaccctgccacctgctaacttctcgctagacacagtgtttctgcccaggtgacctgttcagcagcagaacaagccagggccatggggacgggggaagttttcacttggagatggacaccaagacaatgaagatttgttgtccaaataggtcaataattctgggagactcttggaaaaaactgaatatattcaggaccaactctctccctcccctcatcccacatctcaaagcagacaatgtaaagagagaacatctcacacacccagctcgccatgcctactcattcctgaatttcaggtgccatcactgctctttctttcttctttgtcatttgagaaaggatgcaggaggacaattcccacagataatctgaggaatgcagatgtagagggactccacccctgctcaacagcttggcttccaggcaagaccaaccacatctggtctctgccttcggtggcccacacacctaagcgtcatcgtcattgccatagcatcatgatgcaacacatctacgtgtagcactacgacgttatgtttgggtaatgtggggatgaactgcatgaggctctgattaaggatgtggggaagtgggctgcggtcactgtcggccttgcaaggccacctggaggcctgtctgttagccagtggtggaggagcaaggcttcaggaagggccagccacatgccatcttccctgcgatcaggcaaaaaagtggaattaaaaagtcaaacctttatatgcatgtgttatgtccattttgcaggatgaactgagtttaaaagaatttttttttctcttcaagttgctttgtcttttccatcctcatcacaagcccttgtttgagtgtcttatccctgagcaatctttcgatggatggagatgatcattaggtacttttgtttcaacctttattcctgtaaatatttctgtgaaaactaggagaacagagatgagatttgacaaaaaaaaattgaattaaaaataacacagtctttttaaaactaacataggaaagcctttcctattatttctcttcttagcttctccattgtctaaatcaggaaaacaggaaaacacagctttctagcagctgcaaaatggtttaatgccccctacatatttccatcaccttgaacaatagctttagcttgggaatctgagatatgatcccagaaaacatctgtctctacttcggctgcaaaacccatggtttaaatctatatggtttgtgcattttctcaactaaaaatagagatgataatccgaattctccatatattcactaatcaaagacactattttcatactagattcctgagacaaatactcactgaagggcttgtttaaaaataaattgtgttttggtctgttcttgtagataatgcccttctattttaggtagaagctctggaatccctttattgtgctgttgctcttatctgcaaggtggcaagcagttcttttcagcagattttgcccactattcctctgagctgaagttctttgcatagatttggcttaagcttgaattagatccctgcaaaggcttgctctgtgatgtcagatgtaattgtaaatgtcagtaatcacttcatgaacgctaaatgagaatgtaagtatttttaaatgtgtgtatttcaaatttgtttgactaattctggaattacaagatttctatgcaggatttaccttcatcctgtgcatgtttcccaaactgtgaggagggaaggctcagagatcgagcttctcctctgagttctaacaaaatggtgctttgagggtcagcctttaggaaggtgcagctttgttgtcctttgagctttctgttatgtgcctatcctaataaactcttaaacacattgattgtgaaaaag

SEQ ID NO: 313018 - DNA, 6712 bp, Homo sapiens
aaagccctcagcctttgtgtccttctctgcgccggagtggctgcagctcacccctcagctccccttggggcccagctgggagccgagatagaagctcctgtcgccgctgggcttctcgcctcccgcagagggccacacagagaccgggatggccacctccatgggcctgctgctgctgctgctgctgctcctgacccagcccggggcggggacgggagctgacacggaggcggtggtctgcgtggggaccgcctgctacacggcccactcgggcaagctgagcgctgccgaggcccagaaccactgcaaccagaacgggggcaacctggccactgtgaagagcaaggaggaggcccagcacgtccagcgagtactggcccagctcctgaggcgggaggcagccctgacggcgaggatgagcaagttctggattgggctccagcgagagaagggcaagtgcctggaccctagtctgccgctgaagggcttcagctgggtgggcgggggggaggacacgccttactctaactggcacaaggagctccggaactcgtgcatctccaagcgctgtgtgtctctgctgctggacctgtcccagccgctccttcccaaccgcctgcccaagtggtctgagggcccctgtgggagcccaggctcccccggaagtaacattgagggcttcgtgtgcaagttcagcttcaaaggcatgtgccggcctctggccctggggggcccaggtcaggtgacctacaccacccccttccagaccaccagttcctccttggaggctgtgccctttgcctctgcggccaatgtagcctgtggggaaggtgacaaggacgagactcagagtcattatttcctgtgcaaggagaaggcccccgatgtgttcgactggggcagctcgggccccctctgtgtcagccccaagtatggctgcaacttcaacaatgggggctgccaccaggactgctttgaagggggggatggctccttcctctgcggctgccgaccaggattccggctgctggatgacctggtgacctgtgcctctcgaaacccttgcagctccagcccatgtcgtgggggggccacgtgcgtcctgggaccccatgggaaaaactacacgtgccgctgcccccaagggtaccagctggactcgagtcagctggactgtgtggacgtggatgaatgccaggactccccctgtgcccaggagtgtgtcaacacccctgggggcttccgctgcgaatgctgggttggctatgagccgggcggtcctggagagggggcctgtcaggatgtggatgagtgtgctctgggtcgctcgccttgcgcccagggctgcaccaacacagatggctcatttcactgctcctgtgaggagggctacgtcctggccggggaggacgggactcagtgccaggacgtggatgagtgtgtgggcccggggggccccctctgcgacagcttgtgcttcaacacacaagggtccttccactgtggctgcctgccaggctgggtgctggccccaaatggggtctcttgcaccatggggcctgtgtctctgggaccaccatctgggccccccgatgaggaggacaaaggagagaaagaagggagcaccgtgccccgcgctgcaacagccagtcccacaaggggccccgagggcacccccaaggctacacccaccacaagtagaccttcgctgtcatctgacgcccccatcacatctgccccactcaagatgctggcccccagtgggtcctcaggcgtctggagggagcccagcatccatcacgccacagctgcctctggcccccaggagcctgcaggtggggactcctccgtggccacacaaaacaacgatggcactgacgggcaaaagctgcttttattctacatcctaggcaccgtggtggccatcctactcctgctggccctggctctggggctactggtctatcgcaagcggagagcgaagagggaggagaagaaggagaagaagccccagaatgcggcagacagttactcctgggttccagagcgagctgagagcagggccatggagaaccagtacagtccgacacctgggacagactgctgaaagtgaggtggccctagagacactagagtcaccagccaccatcctcagagctttgaactccccattccaaaggggcacccacatttttttgaaagactggactggaatcttagcaaacaattgtaagtctcctccttaaaggccccttggaacatgcaggtattttctacgggtgtttgatgttcctgaagtggaagctgtgtgttggcgtgccacggtggggatttcgtgactctataatgattgttactccccctcccttttcaaattccaatgtgaccaattccggatcagggtgtgaggaggctggggctaaggggctcccctgaatatcttctctgctcacttccaccatctaagaggaaaaggtgagttgctcatgctgattaggattgaaatgatttgtttctcttcctaggatgaaaactaaatcaattaattattcaattaggtaagaagatctggttttttggtcaaagggaacatgttcggactggaaacatttctttacatttgcattcctccatttcgccagcacaagtcttgctaaatgtgatactgttgacatcctccagaatggccagaagtgcaattaacctcttaggtggcaaggaggcaggaagtgcctctttagttcttacatttctaatagccttgggtttatttgcaaaggaagcttgaaaaatatgagaaaagttgcttgaagtgcattacaggtgtttgtgaagtcacataatctacggggctagggcgagagaggccagggatttgttcacagatacttgaattaattcatccaaatgtactgaggttaccacacacttgactacggatgtgatcaacactaacaaggaaacaaattcaaggacaacctgtctttgagccagggcaggcctcagacaccctgcctgtggccccgcctccacttcatcctgcccggaatgccagtgctccgagctcagacagaggaagccctgcagaaagttccatcaggctgtttcctaaaggatgtgtgaacgggagatgatgcactgtgttttgaaagttgtcattttaaagcattttagcacagttcatagtccacagttgatgcagcatcctgagattttaaatcctgaagtgtgggtggcgcacacaccaagtagggagctagtcaggcagtttgcttaaggaacttttgttctctgtctcttttccttaaaattgggggtaaggagggaaggaagagggaaagagatgactaactaaaatcatttttacagcaaaaactgctcaaagccatttaaattatatcctcattttaaaagttacatttgcaaatatttctccctatgataatgtagtcgatagtgtgcactctttctctctctctctctctctcacacacacacacacacacacacacacacacacagagacacggcaccattctgcctggggcactggaacacattcctgggggtcaccgatggtcagagtcactagaagttacctgagtatctctgggaggcctcatgtctcctgtgggctttttaccaccactgtgcaggagaacagacagaggaaatgtgtctccctccaaggccccaaagcctcagagaaagggtgtttctggttttgccttagcaatgcatcggtctctgaggtgacactctggagcggttgaagggccacaaggtgcagggttaatactcttgccagttttgaaatatagatgctatggttcagattgtttttaatagaaaactaaaggggcaggggaagtgaaaggaaagatggaggttttgtgcggctcgatggggcatttggaacttctttttaaagtcatctcatggtctccagttttcagttggaactctggtgtttaacacttaagggagacaaaggctgtgtccatttggcaaaacttccttggccacgagactctaggtgatgtgtgaagctgggcagtctgtggtgtggagagcagccatctgtctggccattcagaggattctaaagacatggctggatgcgctgctgaccaacatcagcacttaaataaatgcaaatgcaacatttctccctctgggccttgaaaatccttgcccttatcatttggggtgaaggagacatttctgtccttggcttcccacagccccaacgcagtctgtgtatgattcctgggatccaacgagccctcctattttcacagtgttctgattgctctcacagcccaggcccatcgtctgttctctgaatgcagccctgttctcaacaacagggaggtcatggaacccctctgtggaacccacaaggggagaaatgggtgataaagaatccagttcctcaaaaccttccctggcaggctgggtccctctcctgctgggtggtgctttctcttgcacaccactcccaccacggggggagagccagcaacccaaccagacagctcaggttgtgcatctgatggaaaccactgggctcaaacacgtgctttattctcctgtttatttttgctgttactttgaagcatggaaattcttgtttgggggatcttggggctacagtagtgggtaaacaaatgcccaccggccaagaggccattaacaaatcgtccttgtcctgaggggccccagcttgctcgggcgtggcacagtggggaatccaagggtcacagtatggggagaggtgcaccctgccacctgctaacttctcgctagacacagtgtttctgcccaggtgacctgttcagcagcagaacaagccagggccatggggacgggggaagttttcacttggagatggacaccaagacaatgaagatttgttgtccaaataggtcaataattctgggagactcttggaaaaaactgaatatattcaggaccaactctctccctcccctcatcccacatctcaaagcagacaatgtaaagagagaacatctcacacacccagctcgccatgcctactcattcctgaatttcaggtgccatcactgctctttctttcttctttgtcatttgagaaaggatgcaggaggacaattcccacagataatctgaggaatgcagaaaaaccagggcaggacagttatcgacaatgcattagaacttggtgagcatcctctgtagagggactccacccctgctcaacagcttggcttccaggcaagaccaaccacatctggtctctgccttcggtggcccacacacctaagcgtcatcgtcattgccatagcatcatgatgcaacacatctacgtgtagcactacgacgttatgtttgggtaatgtggggatgaactgcatgaggctctgattaaggatgtggggaagtgggctgcggtcactgtcggccttgcaaggccacctggaggcctgtctgttagccagtggtggaggagcaaggcttcaggaagggccagccacatgccatcttccctgcgatcaggcaaaaaagtggaattaaaaagtcaaacctttatatgcatgtgttatgtccattttgcaggatgaactgagtttaaaagaatttttttttctcttcaagttgctttgtcttttccatcctcatcacaagcccttgtttgagtgtcttatccctgagcaatctttcgatggatggagatgatcattaggtacttttgtttcaacctttattcctgtaaatatttctgtgaaaactaggagaacagagatgagatttgacaaaaaaaaattgaattaaaaataacacagtctttttaaaactaacataggaaagcctttcctattatttctcttcttagcttctccattgtctaaatcaggaaaacaggaaaacacagctttctagcagctgcaaaatggtttaatgccccctacatatttccatcaccttgaacaatagctttagcttgggaatctgagatatgatcccagaaaacatctgtctctacttcggctgcaaaacccatggtttaaatctatatggtttgtgcattttctcaactaaaaatagagatgataatccgaattctccatatattcactaatcaaagacactattttcatactagattcctgagacaaatactcactgaagggcttgtttaaaaataaattgtgttttggtctgttcttgtagataatgcccttctattttaggtagaagctctggaatccctttattgtgctgttgctcttatctgcaaggtggcaagcagttcttttcagcagattttgcccactattcctctgagctgaagttctttgcatagatttggcttaagcttgaattagatccctgcaaaggcttgctctgtgatgtcagatgtaattgtaaatgtcagtaatcacttcatgaacgctaaatgagaatgtaagtatttttaaatgtgtgtatttcaaatttgtttgactaattctggaattacaagatttctatgcaggatttaccttcatcctgtgcatgtttcccaaactgtgaggagggaaggctcagagatcgagcttctcctctgagttctaacaaaatggtgctttgagggtcagcctttaggaaggtgcagctttgttgtcctttgagctttctgttatgtgcctatcctaataaactcttaaacacattgattgtgaaaaag

SEQ ID NO: 313019 - DNA, 5374 bp, Homo sapiens
aaagccctcagcctttgtgtccttctctgcgccggagtggctgcagctcacccctcagctccccttggggcccagctgggagccgagatagaagctcctgtcgccgctgggcttctcgcctcccgcagagggccacacagagaccgggatggccacctccatgggcctgctgctgctgctgctgctgctcctgacccagcccggggcggggacgggagctgacacggaggcggtggtctgcgtggggaccgcctgctacacggcccactcgggcaagctgagcgctgccgaggcccagaaccactgcaaccagaacgggggcaacctggccactgtgaagagcaaggaggaggcccagcacgtccagcgagtactggcccagctcctgaggcgggaggcagccctgacggcgaggatgagcaagttctggattgggctccagcgagagaagggcaagtgcctggaccctagtctgccgctgaagggcttcagctgggtgggcgggggggaggacacgccttactctaactggcacaaggagctccggaactcgtgcatctccaagcgctgtgtgtctctgctgctggacctgtcccagccgctccttcccaaccgcctgcccaagtggtctgagggcccctgtgggagcccaggctcccccggaagtaacattgagggcttcgtgtgcaagttcagcttcaaaggcatgtgccggcctctggccctggggggcccaggtcaggtgacctacaccacccccttccagaccaccagttcctccttggaggctgtgccctttgcctctgcggccaatgtagcctgtggggaaggtgacaaggacgagactcagagtcattatttcctgtgcaaggagaaggcccccgatgtgttcgactggggcagctcgggccccctctgtgtcagccccaagtatggctgcaacttcaacaatgggggctgccaccaggactgctttgaagggggggatggctccttcctctgcggctgccgaccaggattccggctgctggatgacctggtgacctgtgcctctcgaaacccttgcagctccagcccatgtcgtgggggggccacgtgcgtcctgggaccccatgggaaaaactacacgtgccgctgcccccaagggtaccagctggactcgagtcagctggactgtgtggacgtggatgaatgccaggactccccctgtgcccaggagtgtgtcaacacccctgggggcttccgctgcgaatgctgggttggctatgagccgggcggtcctggagagggggcctgtcaggatgtggatgagtgtgctctgggtcgctcgccttgcgcccagggctgcaccaacacagatggctcatttcactgctcctgtgaggagggctacgtcctggccggggaggacgggactcagtgccaggacgtggatgagtgtgtgggcccggggggccccctctgcgacagcttgtgcttcaacacacaagggtccttccactgtggctgcctgccaggctgggtgctggccccaaatggggtctcttgcaccatggggcctgtgtctctgggaccaccatctgggccccccgatgaggaggacaaaggagagaaagaagggagcaccgtgccccgcgctgcaacagccagtcccacaaggggccccgagggcacccccaaggctacacccaccacaagtagaccttcgctgtcatctgacgcccccatcacatctgccccactcaagatgctggcccccagtgggtcctcaggcgtctggagggagcccagcatccatcacgccacagctgcctctggcccccaggagcctgcaggtggggactcctccgtggccacacaaaacaacgatggcactgacgggcaaaagctgcttttattctacatcctaggcaccgtggtggccatcctactcctgctggccctggctctggggctactggtctatcgcaagcggagagcgaagagggaggagaagaaggagaagaagccccagaatgcggcagacagttactcctgggttccagagcgagctgagagcagggccatggagaaccagtacagtccgacacctgggacagactgctgaaagtgaggtggccctagagacactagagtcaccagccaccatcctcagagctttgaactccccattccaaaggggcacccacatttttttgaaagactggactggaatcttagcaaacaattgtaagtctcctccttaaaggccccttggaacatgcaggtattttctacgggtgtttgatgttcctgaagtggaagctgtgtgttggcgtgccacggtggggatttcgtgactctataatgattgttactccccctcccttttcaaattccaatgtgaccaattccggatcagggtgtgaggaggctggggctaaggggctcccctgaatatcttctctgctcacttccaccatctaagaggaaaaggtgagttgctcatgctgattaggattgaaatgatttgtttctcttcctaggatgaaaactaaatcaattaattattcaattaggtaagaagatctggttttttggtcaaagggaacatgttcggactggaaacatttctttacatttgcattcctccatttcgccagcacaagtcttgctaaatgtgatactgttgacatcctccagaatggccagaagtgcaattaacctcttaggtggcaaggaggcaggaagtgcctctttagttcttacatttctaatagccttgggtttatttgcaaaggaagcttgaaaaatatgagaaaagttgcttgaagtgcattacaggtgtttgtgaagtcacataatctacggggctagggcgagagaggccagggatttgttcacagatacttgaattaattcatccaaatgtactgaggttaccacacacttgactacggatgtgatcaacactaacaaggaaacaaattcaaggacaacctgtctttgagccagggcaggcctcagacaccctgcctgtggccccgcctccacttcatcctgcccggaatgccagtgctccgagctcagacagaggaagccctgcagaaagttccatcaggctgtttcctaaaggatgtgtgaacgggagatgatgcactgtgttttgaaagttgtcattttaaagcattttagcacagttcatagtccacagttgatgcagcatcctgagattttaaatcctgaagtgtgggtggcgcacacaccaagtagggagctagtcaggcagtttgcttaaggaacttttgttctctgtctcttttccttaaaattgggggtaaggagggaaggaagagggaaagagatgactaactaaaatcatttttacagcaaaaactgctcaaagccatttaaattatatcctcattttaaaagttacatttgcaaatatttctccctatgataatgtagtcgatagtgtgcactctttctctctctctctctctctcacacacacacacacacagcagaacaagccagggccatggggacgggggaagttttcacttggagatggacaccaagacaatgaagatttgttgtccaaataggtcaataattctgggagactcttggaaaaaactgaatatattcaggaccaactctctccctcccctcatcccacatctcaaagcagacaatgtaaagagagaacatctcacacacccagctcgccatgcctactcattcctgaatttcaggtgccatcactgctctttctttcttctttgtcatttgagaaaggatgcaggaggacaattcccacagataatctgaggaatgcagaaaaaccagggcaggacagttatcgacaatgcattagaacttggtgagcatcctctgtagagggactccacccctgctcaacagcttggcttccaggcaagaccaaccacatctggtctctgccttcggtggcccacacacctaagcgtcatcgtcattgccatagcatcatgatgcaacacatctacgtgtagcactacgacgttatgtttgggtaatgtggggatgaactgcatgaggctctgattaaggatgtggggaagtgggctgcggtcactgtcggccttgcaaggccacctggaggcctgtctgttagccagtggtggaggagcaaggcttcaggaagggccagccacatgccatcttccctgcgatcaggcaaaaaagtggaattaaaaagtcaaacctttatatgcatgtgttatgtccattttgcaggatgaactgagtttaaaagaatttttttttctcttcaagttgctttgtcttttccatcctcatcacaagcccttgtttgagtgtcttatccctgagcaatctttcgatggatggagatgatcattaggtacttttgtttcaacctttattcctgtaaatatttctgtgaaaactaggagaacagagatgagatttgacaaaaaaaaattgaattaaaaataacacagtctttttaaaactaacataggaaagcctttcctattatttctcttcttagcttctccattgtctaaatcaggaaaacaggaaaacacagctttctagcagctgcaaaatggtttaatgccccctacatatttccatcaccttgaacaatagctttagcttgggaatctgagatatgatcccagaaaacatctgtctctacttcggctgcaaaacccatggtttaaatctatatggtttgtgcattttctcaactaaaaatagagatgataatccgaattctccatatattcactaatcaaagacactattttcatactagattcctgagacaaatactcactgaagggcttgtttaaaaataaattgtgttttggtctgttcttgtagataatgcccttctattttaggtagaagctctggaatccctttattgtgctgttgctcttatctgcaaggtggcaagcagttcttttcagcagattttgcccactattcctctgagctgaagttctttgcatagatttggcttaagcttgaattagatccctgcaaaggcttgctctgtgatgtcagatgtaattgtaaatgtcagtaatcacttcatgaacgctaaatgagaatgtaagtatttttaaatgtgtgtatttcaaatttgtttgactaattctggaattacaagatttctatgcaggatttaccttcatcctgtgcatgtttcccaaactgtgaggagggaaggctcagagatcgagcttctcctctgagttctaacaaaatggtgctttgagggtcagcctttaggaaggtgcagctttgttgtcctttgagctttctgttatgtgcctatcctaataaactcttaaacacattgattgtgaaaaag

SEQ ID NO: 313020 - DNA, 208 bp, Homo sapiens
tgtgtgtttgtacttgtttgagtgcccgttttcagttcctctgggtgtatacacctaggaatggaattgcaggctcatacaataattttctgtttagctttctgaggaactgctaagccgttttccagtggctgtatcctgtcataggtccaccagcaatgtgtgagggttcctgtttctccagatcctcagcaatgcttgttttctg

SEQ ID NO: 313021 - DNA, 383 bp, Homo sapiens
  misc_feature (307)..(307): n is a, c, g, or t
gattttgtgttgctttgttaaatcatcttattttcattggaagcaactgttttcagcaccttttatatgtaaggaagtaccaatatactttttaaaatttggttatttttgaagtttgttttctttttatttagcaggacagatttggtgatggtattatactcacttgataactattttcttcagatttcactatatcacacagttttcttctgtcctgaaaaatttttgttgagaatccactggctatctcataagagtattcttgcaaataatatcactttttttttttttttttttgatattntagagatattttagcggagtgaaatcgcgccatttcactccggcctggggaacaacagtgaaactccatctcaaaa

SEQ ID NO: 313022 - DNA, 1375 bp, Homo sapiens
  misc_feature (236)..(236): n is a, c, g, or t
tacgtagtgggcgcggaagtgggaggctctactcggcggtgggcggcccgcgattaagcttgcgtgattagcgatactatttatagcgagagtgtactgggattcacggcgcaaaaatccggccccgaggccgtcgtaagttttcgctcggaaagcagcgtgtccaatcaggcacgcagcttgagcggagaggacggcttccgggatgtggcgggatttgtccgcttctttgtctntggctgccgctggaactccgggtctcgtcttcactgctctgtgtcctctgctcctagaggcccagcctctggtcctgtgacctgcaggtattgggaatccacagctaagacgccgggacaccctggaagcctagaaatggacaacctgaggtatggagtgtatcctgtcaagggggcaagtggataccctggggctgagaggaatcttctggagtactcttattttgaaaaggggccgttgacatttagggatgtggtcatagaattctctcaggaggagtggcaatgcctggacactgctcagcaagatttgtataggaaagtgatgttagagaacttcagaaacctggtgttcttgggtattgatgtctctaagccagatctgatcacctgtctggagcaaggaaaagatccctggaatatgaagagacacagtatggtagccacacccccagatggagtttcactgttgttccccaggccggagtgaaatggcgcgatttcacctcgctgtgtcccaggttcaagcagttctcctacctcagcctcccgagtagctgggattacgggcatatgccaccacacccagctaagtttgtatttttagtagagacagggtttctccatgttggtcaggctagtctcgatctcctgacctcaggtgattcacccacctcagcttcccaaagtgccgggattacaagcttgagctaccgcgcccagccaacacatcacttttatcttgcagctcccgagattctcttttctgtgacttttaaaattgtgcttacatatgtgtttgatataaatatctttgtattctagtttgtttgttcagcttcttcatttttacatcactttttaaaagatttctgttattttttatattttttacctccataatttctgtttttccaatattttaaatatttctgttcttatttccagttttctgattttctgtagttctctgtgttcatattttactcattgagtattcaatttattttgtttttaaaattaatgtatacattttttatttctttctgaaaaatttataataattttgttggtactacattgccctgttttgtatatattctaatcttttattaaaatttgcacattaaaaaaaaaaa

SEQ ID NO: 313023 - DNA, 990 bp, Homo sapiens
  misc_feature (236)..(236): n is a, c, g, or t
tacgtagtgggcgcggaagtgggaggctctactcggcggtgggcggcccgcgattaagcttgcgtgattagcgatactatttatagcgagagtgtactgggattcacggcgcaaaaatccggccccgaggccgtcgtaagttttcgctcggaaagcagcgtgtccaatcaggcacgcagcttgagcggagaggacggcttccgggatgtggcgggatttgtccgcttctttgtctntggctgccgctggaactccgggtctcgtcttcactgctctgtgtcctctgctcctagaggcccagcctctggtcctgtgacctgcaggtattgggaatccacagctaagacgccgggacaccctggaagcctagaaatggacaacctgaggtatggagtgtatcctgtcaagggggcaagtggataccctggggctgagaggaatcttctggagtactcttattttgaaaaggggccgttgacatttagggatgtggtcatagaattctctcaggaggagtggcaatgcctggacactgctcagcaagatttgtataggaaagtgatgttagagaacttcagaaacctggtgttcttgggtattgatgtctctaagccagatctgatcacctgtctggagcaaggaaaagatccctggaatatgaagagacacagtatggtagccacacccccaggcatattctttgtggtacgtgggggattacataaaacctttaagagatacaatgtatttcagtctagttaaaaatgaacttttgttgcatgcaaaaattttttctcattacatatgttctcagatttgttcttgatgttgctaattatatttttatatgtatatttattaacatgtttataatgatttctatgcctttatctttcaaattttggggaataattaaaaatttcttctgtgccattatgataatgctaagaaatgtatttttgtgtatgtgcgtatctttcccagaaaata

SEQ ID NO: 313024 - DNA, 902 bp, Homo sapiens
  misc_feature (236)..(236): n is a, c, g, or t
  misc_feature (898)..(898): n is a, c, g, or t
tacgtagtgggcgcggaagtgggaggctctactcggcggtgggcggcccgcgattaagcttgcgtgattagcgatactatttatagcgagagtgtactgggattcacggcgcaaaaatccggccccgaggccgtcgtaagttttcgctcggaaagcagcgtgtccaatcaggcacgcagcttgagcggagaggacggcttccgggatgtggcgggatttgtccgcttctttgtctntggctgccgctggaactccgggtctcgtcttcactgctctgtgtcctctgctcctagaggcccagcctctggtcctgtgacctgcaggtattgggaatccacagctaagacgccgggacaccctggaagcctagaaatggacaacctgaggtatggagtgtatcctgtcaagggggcaagtggataccctggggctgagaggaatcttctggagtactcttattttgaaaaggggccgttgacatttagggatgtggtcatagaattctctcaggaggagtggcaatgcctggacactgctcagcaagatttgtataggaaagtgatgttagagaacttcagaaacctggtgttcttgggtattgatgtctctaagccagatctgatcacctgtctggagcaaggaaaagatccctggaatatgaagagacacagtatggtagccacacccccagatggagtttcactgttgttccccaggccggagtgaaatggcgcgatttcacctcgctgtgtcccaggttcaagcagttctcctacctcagcctcccagctactcaggaggctgaggcaggagaatcgcttgaacctgggaggtggaagttgcagtgagctgagatcacgccattgcactccagcctgggcaacaagcgaaactctgntctc

SEQ ID NO: 313025 - DNA, 1230 bp, Homo sapiens
  misc_feature (236)..(236): n is a, c, g, or t
  misc_feature (1126)..(1126): n is a, c, g, or t
tacgtagtgggcgcggaagtgggaggctctactcggcggtgggcggcccgcgattaagcttgcgtgattagcgatactatttatagcgagagtgtactgggattcacggcgcaaaaatccggccccgaggccgtcgtaagttttcgctcggaaagcagcgtgtccaatcaggcacgcagcttgagcggagaggacggcttccgggatgtggcgggatttgtccgcttctttgtctntggctgccgctggaactccgggtctcgtcttcactgctctgtgtcctctgctcctagaggcccagcctctggtcctgtgacctgcaggtattgggaatccacagctaagacgccgggacaccctggaagcctagaaatggacaacctgaggtatggagtgtatcctgtcaagggggcaagtggataccctggggctgagaggaatcttctggagtactcttattttgaaaaggggccgttgacatttagggatgtggtcatagaattctctcaggaggagtggcaatgcctggacactgctcagcaagatttgtataggaaagtgatgttagagaacttcagaaacctggtgttcttgggtattgatgtctctaagccagatctgatcacctgtctggagcaaggaaaagatccctggaatatgaagagacacagtatggtagccacacccccagaaagtggggtattgaaatttcctactataattatattgctgtctaggtgtttcttccagtctgtcaatatttgctttatatatttggaaccttagtgtgacatacacacagacacacagacgtgcacacacacacacacacacacaaaatttgtcataggttcccagttaataaatctattattgtttaatgtctttctttgtctctttgcagttttgacttaaagtactttatgtaagatatgacagtttttgacttaagatgtagcttttgtaatactattttgacctcttctgctctcatttgggttaatatttgcatgcaatgtctaaatctatcttgccaccttcagtatgtttttaatcattaggatgtcagctgacccttgtaggaaaggcaaattgggatcttgggtttttaattaattttaaaatnaaatttctttattggaaagtatgtctcttggattgggaaagttttctggaaaccaaaggggacttaccaattttttttgttgttctatttgattcttgcatctt

SEQ ID NO: 313026 - DNA, 821 bp, Homo sapiens
  misc_feature (236)..(236): n is a, c, g, or t
tacgtagtgggcgcggaagtgggaggctctactcggcggtgggcggcccgcgattaagcttgcgtgattagcgatactatttatagcgagagtgtactgggattcacggcgcaaaaatccggccccgaggccgtcgtaagttttcgctcggaaagcagcgtgtccaatcaggcacgcagcttgagcggagaggacggcttccgggatgtggcgggatttgtccgcttctttgtctntggctgccgctggaactccgggtctcgtcttcactgctctgtgtcctctgctcctagaggcccagcctctggtcctgtgacctgcaggtattgggaatccacagctaagacgccgggacaccctggaagcctagaaatggacaacctgaggtatggagtgtatcctgtcaagggggcaagtggataccctggggctgagaggaatcttctggagtactcttattttgaaaagacggagtttcgctcttgttgcccaggctggagtgcaatggcgcgatctcagctcacctcaacctccgcctcccgggttcaagcgattctcctgcctcagcctcccgagtagctgggattacaggcatgcaccaccaccctggctaattttgtatttttagtagagacggggtttctccatgttggtcaggctggtcttgaactcccgacctcaggtgacctacctacctcgacctcccaaaatgctgggattacaggcatgagccaccgtgccaggccaaggctatgtttttaaggtgaagaattgaagatgcattttagaaatgagacaaactatattcctttcaagggctg

SEQ ID NO: 313027 - DNA, 216 bp, Homo sapiens
gcacaaaggttcaatttcaaagcattatttactacagtgttgtttctaggcagttacatggatcacctatgctcactaaattcattataatggtgaacaaaacacctagggacagaatagcaagcccaacttacagtcccccacaaaagctaaaattcatgtcattgactagagtgactgcaacggatcaggagctgaaagaggacaggaaaattt

SEQ ID NO: 313028 - DNA, 297 bp, Homo sapiens
gtgatccacccaccttggcttcccaaagtgctagtattacagacatgaaccactgcacctggccccctgtctgttaaacgggcaattccatgcccacctcctctggctgttatgagaattaaatgaaaataaggacaagtcccagcagacttcgtaaactgtcaagtgctacacagacgccagcactgctctgtgtctgtgaggctcacacgttctaactaagcagaggagtcaaaactccagctcctgtctcgtcaatatcttggtgaaacacagacctggattcaaatcttgcct

SEQ ID NO: 313029 - DNA, 817 bp, Homo sapiens
gtaaagtaattccaaaaattaaataagaatacacattgttcagttgctaagaaaaatgcattctaacagtacaaatgaagtccagagtcagatcttttctcaaaatacttggcatatcaacacattacacataaacaaataaaaaccagtcctgtccctcatgataatgggtttctaatgtgatgtattcttgcaatctgaaacaccttataaagctgtattttcctgattgatgttggaaaaagcattcccaaaatgtgaattattgtttttatgaatagttacggaggatgtgatgacaatatgccagataatctatgtaattctttattcctggatacaagcacatggtggactgttttctcacaaccgattaaaattggatttatttttgcatgagaattgtaagggagccacaaccatgagtagtaacataattaatatacagtgtcaatattttatatttaatgagacatttattctataatcagttcttatttataaagaggcgcaaatcaatttcaacctgtaattacctctgtgctttgtgactcaggcacaatctaaacccagcttaatgaatcaaagagatgtttcttggcaagatattttcattaaagttatttggaaagggcaattaactgcaaaagggacttttttttttttaactgacaagatactatctaaactaatagtttaaaataacattgcttttatgtcaaagcactttggtaacttggcctcacatgctgacagttttggctaaatattacaaatcttgatcccagaagagcaagagagaaagttttactaatat

SEQ ID NO: 313030 - DNA, 2209 bp, Homo sapiens
ccccttcctgtggggttcattggggcatcccctttctgctgcaggaacctctcatcagaccgcctgagggaagcggcgcccggagacccgccccggcccggtccacattctccccaggaagccggactctatggggcgggaccctgggggagcctgagccgagcccggagccagccccgaacccctgaacctccagccaggggcgccccgggagcagccagcccgtgggcgagccgcccgcccgccgagcagccatgagcgagacggtcatctgttccagccgggccactgtgatgctttatgatgatggcaacaagcgatggctccctgctggcacgggtccccaggccttcagccgcgtccagatctaccacaaccccacggccaattcctttcgcgtcgtgggccggaagatgcagcccgaccagcaggtggtcatcaactgtgccatcgtccggggtgtcaagtataaccaggccacccccaacttccatcagtggcgcgacgctcgccaggtctggggcctcaacttcggcagcaaggaggatgcggcccagtttgccgccggcatggccagtgccctagaggcgttggaaggaggtgggccccctccacccccagcacttcccacctggtcggtcccgaacggcccctccccggaggaggtggagcagcagaaaaggcagcagcccggcccgtcggagcacatagagcgccgggtctccaatgcaggaggcccacctgctccccccgctgggggtccacccccaccaccaggacctccccctcctccaggtccccccccacccccaggtttgcccccttcgggggtcccagctgcagcgcacggagcagggggaggaccaccccctgcaccccctctcccggcagcacagggccctggtggtgggggagctggggccccaggcctggccgcagctattgctggagccaaactcaggaaagtcagcaagcaggaggaggcctcaggggggcccacagcccccaaagctgagagtggtcgaagcggaggtgggggactcatggaagagatgaacgccatgctggcccggagaaggaaagccacgcaagttggggagaaaacccccaaggatgaatctgccaatcaggaggagccagaggccagagtcccggcccagagtgaatctgtgcggagaccctgggagaagaacagcacaaccttgccaaggatgaagtcgtcttcttcggtgaccacttccgagacccaaccctgcacgcccagctccagtgattactcggacctacagagggtgaaacaggagcttctggaagaggtgaagaaggaattgcagaaagtgaaagaggaaatcattgaagccttcgtccaggagctgaggaagcggggttctccctgaccacagggacccagaagacccgcttctcctttccgcacacccggcctgtcaccctgctttccctgcctctacttgacttggaattggctgaagactacacaggaatgcatcgttcccactccccatcccacttggaaaactccaagggggtgtggcttccctgctcacacccacactggctgctgattggctggggaggcccccgcccttttctccctttggtccttcccctctgccatccccttggggccggtccctctgctggggatgcaccaatgaaccccacaggaagggggaaggaaggagggaatttcacattcccttgttctagattcactttaacgcttaatgccttcaaagttttggtttttttaagaaaaaaaaatatatatatatttgggttttgggggaaaagggaaatttttttttctctttggttttgataaaatgggatgtgggagtttttaaatgctatagccctgggcttgccccatttggggcagctatttaaggggaggggatgtctcaccgggctgggggtgagacatccccccaccccagggactccccttccctctggctccttccccttttctatgaggaaataagatgctgtaactttttggaacctcagttttttgattttttatttgggtaggttttggggtccaggccattttttttaccccttggaggaaataagatgagggagaaaggaaaaggggaggaaacttctcccctcccaccttcacctttagcttcttgaaaatgggcccctgcagaataaatctgccagtttttataaatgctaa

SEQ ID NO: 313031 - DNA, 3041 bp, Homo sapiens
  misc_feature (2869)..(2870): n is a, c, g, or t
  misc_feature (2877)..(2877): n is a, c, g, or t
  misc_feature (2880)..(2880): n is a, c, g, or t
  misc_feature (2886)..(2886): n is a, c, g, or t
  misc_feature (2888)..(2888): n is a, c, g, or t
tatactcctaacatcaacaatacgtcagtcagagaccagggattaaatcgagcacgaggcctcaccttcccggggcgggcggggtggggtgagaggggttgggccctactcccccgacttccactcccgtgcgggtgggggtctcgcccccttagtaacctctccgaaattgacagaagagaaacgctggggaggggcggtgttccgaagatgggatttcagggagaaaatctgagaccacttgcttaacttgagggtcctcctcgacccccaaaattgagcggagtacgagatggagaagtcgatggggaaagaaatcgcgccccttccgagaccctcctcagaattcccacagtgggagcgaactaggaagcaagggaggtccccttccccttcaccaacttgcccctcaggtgggggtgattcccagggtgcacccctgggctacaacattggggagaggagcgagatcgcggaagccgagggtgcagagttgcccttttaagcgccctccaccccctcgcctggaggcgcacgcggcccctttaaggcgcggggcattgtgggtgcggggagtggaattttggaacgaaatgtaacgaagagaagtacagtagtaagagtaacactgtagccgccaccggcaaggggtgcgcgctggggagcggacgctgcatcccctttctgctgcaggaacctctcatcagaccgcctgagggaagcggcgcccggagacccgccccggcccggtccacattctccccaggaagccggactctatggggcgggaccctgggggagcctgagccgagcccggagccagccccgaacccctgaacctccagccaggggcgccccgggagcagccagcccgtgggcgagccgcccgcccgccgagcagccatgagcgagacggtcatctgttccagccgggccactgtgatgctttatgatgatggcaacaagcgatggctccctgctggcacgggtccccaggccttcagccgcgtccagatctaccacaaccccacggccaattcctttcgcgtcgtgggccggaagatgcagcccgaccagcaggtggtcatcaactgtgccatcgtccggggtgtcaagtataaccaggccacccccaacttccatcagtggcgcgacgctcgccaggtctggggcctcaacttcggcagcaaggaggatgcggcccagtttgccgccggcatggccagtgccctagaggcgttggaaggaggtgggccccctccacccccagcacttcccacctggtcggtcccgaacggcccctccccggaggaggtggagcagcagaaaaggcagcagcccggcccgtcggagcacatagagcgccgggtctccaatgcaggaggcccacctgctccccccgctgggggtccacccccaccaccaggacctccccctcctccaggtccccccccacccccaggtttgcccccttcgggggtcccagctgcagcgcacggagcagggggaggaccaccccctgcaccccctctcccggcagcacagggccctggtggtgggggagctggggccccaggcctggccgcagctattgctggagccaaactcaggaaagtcagcaagcaggaggaggcctcaggggggcccacagcccccaaagctgagagtggtcgaagcggaggtgggggactcatggaagagatgaacgccatgctggcccggagaaggaaagccacgcaagttggggagaaaacccccaaggatgaatctgccaatcaggaggagccagaggccagagtcccggcccagagtgaatctgtgcggagaccctgggagaagaacagcacaaccttgccaaggatgaagtcgtcttcttcggtgaccacttccgagacccaaccctgcacgcccagctccagtgattactcggacctacagagggtgaaacaggagcttctggaagaggtgaagaaggaattgcagaaagtgaaagaggaaatcattgaagccttcgtccaggagctgaggaagcggggttctccctgaccacagggacccagaagacccgcttctcctttccgcacacccggcctgtcaccctgctttccctgcctctacttgacttggaattggctgaagactacacaggaatgcatcgttcccactccccatcccacttggaaaactccaagggggtgtggcttccctgctcacacccacactggctgctgattggctggggaggcccccgcccttttctccctttggtccttcccctctgccatccccttggggccggtccctctgctggggatgcaccaatgaaccccacaggaagggggaaggaaggagggaatttcacattcccttgttctagattcactttaacgcttaatgccttcaaagttttggtttttttaagaaaaaaaaatatatatatatttgggttttgggggaaaagggaaatttttttttctctttggttttgataaaatgggatgtgggagtttttaaatgctatagccctgggcttgccccatttggggcagctatttaaggggaggggatgtctcaccgggctgggggtgagacatccccccaccccagggactccccttccctctggctccttccccttttctatgaggaaataagatgctgtaactttttggaacctcagttttttgattttttatttgggtaggttttggggtccaggccattttttttaccccttggaggaaataagatgagggagaaaggaaaaggggaggaaacttctcccctcccaccttcacctttagcttcttgaaaatgggcccctgcagaataaatctgccagtttttataaatgctaaaaaaaaaaaannacaaaanaanaaaaananaacaacaaaaaaaaacaaaacaaaaaaaaaaaaaaaaaaaaaaaaaagggggggggaaacaaaaaacaataccccagggaagaccacacatacgagaacaagaagaattttagtgaaaaaagggagggccacacaaaagagaagggaataacg

SEQ ID NO: 313032 - DNA, 3077 bp, Homo sapiens
tatactcctaacatcaacaatacgtcagtcagagaccagggattaaatcgagcacgaggcctcaccttcccggggcgggcggggtggggtgagaggggttgggccctactcccccgacttccactcccgtgcgggtgggggtctcgcccccttagtaacctctccgaaattgacagaagagaaacgctggggaggggcggtgttccgaagatgggatttcagggagaaaatctgagaccacttgcttaacttgagggtcctcctcgacccccaaaattgagcggagtacgagatggagaagtcgatggggaaagaaatcgcgccccttccgagaccctcctcagaattcccacagtgggagcgaactaggaagcaagggaggtccccttccccttcaccaacttgcccctcaggtgggggtgattcccagggtgcacccctgggctacaacattggggagaggagcgagatcgcggaagccgagggtgcagagttgcccttttaagcgccctccaccccctcgcctggaggcgcacgcggcccctttaaggcgcggggcattgtgggtgcggggagtggaattttggaacgaaatgtaacgaagagaagtacagtagtaagagtaacactgtagccgccaccggcaaggggtgcgcgctggggagcggacgctgcatcccctttctgctgcaggaacctctcatcagaccgcctgagggaagcggcgcccggagacccgccccggcccggtccacattctccccaggaagccggactctatggggcgggaccctgggggagcctgagccgagcccggagccagccccgaacccctgaacctccagccaggggcgccccgggagcagccagcccgtgggcgagccgcccgcccgccgagcagccatgagcgagacggtcatctgttccagccgggccactgtgatgctttatgatgatggcaacaagcgatggctccctgctggcacgggtccccaggccttcagccgcgtccagatctaccacaaccccacggccaattcctttcgcgtcgtgggccggaagatgcagcccgaccagcaggtggtcatcaactgtgccatcgtccggggtgtcaagtataaccaggccacccccaacttccatcagtggcgcgacgctcgccaggtctggggcctcaacttcggcagcaaggaggatgcggcccagtttgccgccggcatggccagtgccctagaggcgttggaaggaggtgggccccctccacccccagcacttcccacctggtcggtcccgaacggcccctccccggaggaggtggagcagcagaaaaggcagcagcccggcccgtcggagcacatagagcgccgggtctccaatgcaggaggcccacctgctccccccgctgggggtccacccccaccaccaggacctccccctcctccaggtccccccccacccccaggtttgcccccttcgggggtcccagctgcagcgcacggagcagggggaggaccaccccctgcaccccctctcccggcagcacagggccctggtggtgggggagctggggccccaggcctggccgcagctattgctggagccaaactcaggaaagtcagcaagcaggaggaggcctcaggggggcccacagcccccaaagctgagagtggtcgaagcggaggtgggggactcatggaagagatgaacgccatgctggcccggagaaggaaagccacgcaagttggggagaaaacccccaaggatgaatctgccaatcaggaggagccagaggccagagtcccggcccagagtggtgagtagagtgcccagtccagccacaggaactacaaatcccagaatactctgttctcacatgttaagcacccttataggagagtcagggcgaatggtgctggggattgtagtctcctgagatggggctttgatcaggggctgatgaggttgggggagtaagattgattggggggcagtcttttgtccctgatctttctgatttcttgcctatccccagaatctgtgcggagaccctgggagaagaacagcacaaccttgccaaggatgaagtcgtcttcttcggtgaccacttccgagacccaaccctgcacgcccagctccagtgattactcggacctacagagggtgaaacaggagcttctggaagaggtgaagaaggaattgcagaaagtgaaagaggaaatcattgaagccttcgtccaggagctgaggaagcggggttctccctgaccacagggacccagaagacccgcttctcctttccgcacacccggcctgtcaccctgctttccctgcctctacttgacttggaattggctgaagactacacaggaatgcatcgttcccactccccatcccacttggaaaactccaagggggtgtggcttccctgctcacacccacactggctgctgattggctggggaggcccccgcccttttctccctttggtccttcccctctgccatccccttggggccggtccctctgctggggatgcaccaatgaaccccacaggaagggggaaggaaggagggaatttcacattcccttgttctagattcactttaacgcttaatgccttcaaagttttggtttttttaagaaaaaaaaatatatatatatttgggttttgggggaaaagggaaatttttttttctctttggttttgataaaatgggatgtgggagtttttaaatgctatagccctgggcttgccccatttggggcagctatttaaggggaggggatgtctcaccgggctgggggtgagacatccccccaccccagggactccccttccctctggctccttccccttttctatgaggaaataagatgctgtaactttttggaacctcagttttttgattttttatttgggtaggttttggggtccaggccattttttttaccccttggaggaaataagatgagggagaaaggaaaaggggaggaaacttctcccctcccaccttcacctttagcttcttgaaaatgggcccctgcagaataaatctgccagtttttataaatgctaa

SEQ ID NO: 313033 - DNA, 2257 bp, Homo sapiens
ccgctgccagagttccatatgttctggaacccttgactcctagagttcagaacccagccaacttgcagttttcagaatgttcaagaaacttctgacactcagagttgcagaacctcctggtccctgcagattcctggaaatcagaatatggtggttgaaagaatcttgtggctgggcgtggtggctcacgcctgtaatcccagcactctgggaggccgaggcgggcagatcgcctgaggtcaggagtttgagaccagcctggccaacatggcgaaatcccgtctctactgaagataacaaaaattagccggtcatggtggcgcccgtgcctgtaatcccagctcggcaggccgaggcaggagaatcgcttgaacccgggaggcagaggttgcagtgagccaagatcgagccactgcactccagcctgggtgacagagtctcaaaaaaaaaaaagaaaagaaagaatcttgggcattttgtaattcggtgttcctgacagtttagtgactgggatctcgcatcctgatctctccctgtcgctgccctgccctccattccccctactctcacccagcccccttcttggttccctaggggaggaaggcttgggtgagtattaggagccagccaccctggagacctctgagagagaggacggaggtcgctggccccttcgctggccatccttagggccctgattgacggcagctctctcgcctccccccacagggcagcagcccggcccgtcggagcacatagagcgccgggtctccaatgcaggaggcccacctgctccccccgctgggggtccacccccaccaccaggacctccccctcctccaggtccccccccacccccaggtttgcccccttcgggggtcccagctgcagcgcacggagcagggggaggaccaccccctgcaccccctctcccggcagcacagggccctggtggtgggggagctggggccccaggcctggccgcagctattgctggagccaaactcaggaaagtcagcaagcaggaggaggcctcaggggggcccacagcccccaaagctgagagtggtcgaagcggaggtgggggactcatggaagagatgaacgccatgctggcccggagaaggaaagccacgcaagttggggagaaaacccccaaggatgaatctgccaatcaggaggagccagaggccagagtcccggcccagagtgaatctgtgcggagaccctgggagaagaacagcacaaccttgccaaggatgaagtcgtcttcttcggtgaccacttccgagacccaaccctgcacgcccagctccagtgattactcggacctacagagggtgaaacaggagcttctggaagaggtgaagaaggaattgcagaaagtgaaagaggaaatcattgaagccttcgtccaggagctgaggaagcggggttctccctgaccacagggacccagaagacccgcttctcctttccgcacacccggcctgtcaccctgctttccctgcctctacttgacttggaattggctgaagactacacaggaatgcatcgttcccactccccatcccacttggaaaactccaagggggtgtggcttccctgctcacacccacactggctgctgattggctggggaggcccccgcccttttctccctttggtccttcccctctgccatccccttggggccggtccctctgctggggatgcaccaatgaaccccacaggaagggggaaggaaggagggaatttcacattcccttgttctagattcactttaacgcttaatgccttcaaagttttggtttttttaagaaaaaaaaatatatatatatttgggttttgggggaaaagggaaatttttttttctctttggttttgataaaatgggatgtgggagtttttaaatgctatagccctgggcttgccccatttggggcagctatttaaggggaggggatgtctcaccgggctgggggtgagacatccccccaccccagggactccccttccctctggctccttccccttttctatgaggaaataagatgctgtaactttttggaacctcagttttttgattttttatttgggtaggttttggggtccaggccattttttttaccccttggaggaaataagatgagggagaaaggaaaaggggaggaaacttctcccctcccaccttcacctttagcttcttgaaaatgggcccctgcagaataaatctgccagtttttataaatgctaa

SEQ ID NO: 313034 - DNA, 2435 bp, Homo sapiens
tatactcctaacatcaacaatacgtcagtcagagaccagggattaaatcgagcacgaggcctcaccttcccggggcgggcggggtggggtgagaggggttgggccctactcccccgacttccactcccgtgcgggtgggggtctcgcccccttagtaacctctccgaaattgacagaagagaaacgctggggaggggcggtgttccgaagatgggatttcagggagaaaatctgagaccacttgcttaacttgagggtcctcctcgacccccaaaattgagcggagtacgagatggagaagtcgatggggaaagaaatcgcgccccttccgagaccctcctcagaattcccacagtgggagcgaactaggaagcaagggaggtccccttccccttcaccaacttgcccctcaggtgggggtgattcccagggtgcacccctgggctacaacattggggagaggagcgagatcgcggaagccgagggtgcagagttgcccttttaagcgccctccaccccctcgcctggaggcgcacgcggcccctttaaggcgcggggcattgtgggtgcggggagtggaattttggaacgaaatgtaacgaagagaagtacagtagtaagagtaacactgtagccgccaccggcaaggggtgcgcgctggggagcggacgctgcatcccctttctgctgcaggaacctctcatcagaccgcctgagggaagcggcgcccggagacccgccccggcccggtccacattctccccaggaagccggactctatggggcgggaccctgggggagcctgagccgagcccggagccagccccgaacccctgaacctccagccaggggcgccccgggagcagccagcccgtgggcgagccgcccgcccgccgagcagccatgaggcagcagcccggcccgtcggagcacatagagcgccgggtctccaatgcaggaggcccacctgctccccccgctgggggtccacccccaccaccaggacctccccctcctccaggtccccccccacccccaggtttgcccccttcgggggtcccagctgcagcgcacggagcagggggaggaccaccccctgcaccccctctcccggcagcacagggccctggtggtgggggagctggggccccaggcctggccgcagctattgctggagccaaactcaggaaagtcagcaagcaggaggaggcctcaggggggcccacagcccccaaagctgagagtggtcgaagcggaggtgggggactcatggaagagatgaacgccatgctggcccggagaaggaaagccacgcaagttggggagaaaacccccaaggatgaatctgccaatcaggaggagccagaggccagagtcccggcccagagtgaatctgtgcggagaccctgggagaagaacagcacaaccttgccaaggatgaagtcgtcttcttcggtgaccacttccgagacccaaccctgcacgcccagctccagtgattactcggacctacagagggtgaaacaggagcttctggaagaggtgaagaaggaattgcagaaagtgaaagaggaaatcattgaagccttcgtccaggagctgaggaagcggggttctccctgaccacagggacccagaagacccgcttctcctttccgcacacccggcctgtcaccctgctttccctgcctctacttgacttggaattggctgaagactacacaggaatgcatcgttcccactccccatcccacttggaaaactccaagggggtgtggcttccctgctcacacccacactggctgctgattggctggggaggcccccgcccttttctccctttggtccttcccctctgccatccccttggggccggtccctctgctggggatgcaccaatgaaccccacaggaagggggaaggaaggagggaatttcacattcccttgttctagattcactttaacgcttaatgccttcaaagttttggtttttttaagaaaaaaaaatatatatatatttgggttttgggggaaaagggaaatttttttttctctttggttttgataaaatgggatgtgggagtttttaaatgctatagccctgggcttgccccatttggggcagctatttaaggggaggggatgtctcaccgggctgggggtgagacatccccccaccccagggactccccttccctctggctccttccccttttctatgaggaaataagatgctgtaactttttggaacctcagttttttgattttttatttgggtaggttttggggtccaggccattttttttaccccttggaggaaataagatgagggagaaaggaaaaggggaggaaacttctcccctcccaccttcacctttagcttcttgaaaatgggcccctgcagaataaatctgccagtttttataaatgctaa

SEQ ID NO: 313035 - DNA, 2601 bp, Homo sapiens
tatactcctaacatcaacaatacgtcagtcagagaccagggattaaatcgagcacgaggcctcaccttcccggggcgggcggggtggggtgagaggggttgggccctactcccccgacttccactcccgtgcgggtgggggtctcgcccccttagtaacctctccgaaattgacagaagagaaacgctggggaggggcggtgttccgaagatgggatttcagggagaaaatctgagaccacttgcttaacttgagggtcctcctcgacccccaaaattgagcggagtacgagatggagaagtcgatggggaaagaaatcgcgccccttccgagaccctcctcagaattcccacagtgggagcgaactaggaagcaagggaggtccccttccccttcaccaacttgcccctcaggtgggggtgattcccagggtgcacccctgggctacaacattggggagaggagcgagatcgcggaagccgagggtgcagagttgcccttttaagcgccctccaccccctcgcctggaggcgcacgcggcccctttaaggcgcggggcattgtgggtgcggggagtggaattttggaacgaaatgtaacgaagagaagtacagtagtaagagtaacactgtagccgccaccggcaaggggtgcgcgctggggagcggacgctgcatcccctttctgctgcaggaacctctcatcagaccgcctgagggaagcggcgcccggagacccgccccggcccggtccacattctccccaggaagccggactctatggggcgggaccctgggggagcctgagccgagcccggagccagccccgaacccctgaacctccagccaggggcgccccgggagcagccagcccgtgggcgagccgcccgcccgccgagcagccatgagcgagacggtcatctgttccagccgggccactgtgatgctttatgatgatggcaacaagcgatggctccctgctggcacgggtccccaggccttcagccgcgtccagatctaccacaaccccacggccaattcctttcgcgtcgtgggccggaagatgcagcccgaccagcaggtggtcatcaactgtgccatcgtccggggtgtcaagtataaccaggccacccccaacttccatcagtggcgcgacgctcgccaggtctggggcctcaacttcggcagcaaggaggatgcggcccagtttgccgccggcatggccagtgccctagaggcgttggaaggaggtgggccccctccacccccagcacttcccacctggtcggtcccgaacggcccctccccggaggaggtggagcagcagaaaaggcagcagcccggcccgtcggagcacatagagcgccgggtctccaatgcaggaggcccacctgctccccccgctgggggtccacccccaccaccaggacctccccctcctccaggtccccccccacccccaggtttgcccccttcgggggtcccagctgcagcgcacggagcagggggaggaccaccccctgcaccccctctcccggcagcacagggccctggtggtgggggagctggggccccaggcctggccgcagctattgctggagccaaactcaggaaagtcagcaagcaggaggaggcctcaggggggcccacagcccccaaagctgagagtggtcgaagcggaggtgggggactcatggaagagatgaacgccatgctggcccggagaaggaaagccacgcaagttggggagaaaacccccaaggatgaatctgccaatcaggaggagccagaggccagagtcccggcccagagtgaatctgtgcggagaccctgggagaagaacagcacaaccttgccaaggatgaagtcgtcttcttcggtgaccacttccgagacccaaccctgcacgcccagctccagtgattactcggacctacagagggtgaaacaggagcttctggaagaggtgaagaaggaattgcagaaagtgaaagaggaaatcattgaagccttcgtccaggagctgaggaagcggggttctccctgaccacagggacccagaagacccgcttctcctttccgcacacccggcctgtcaccctgctttccctgcctctacttgacttggaattggctgaagactacacaggaatgcatcgttcccactccccatcccacttggaaaactccaagggggtgtggcttccctgctcacacccacactggctgctgattggctggggaggcccccgcccttttctccctttggtccttcccctctgccatccccttggggccggtccctctgctggggatgcaccaatgaaccccacaggaagggggaaggaaggagggaatttcacattcccttgttctagattcactttaacgcttaatgccttcaaagttttggtttttttaagaaaaaaaaatatatatatatttgggttttgggggaaaagggaaatttttttttctctttggttttgataaaatgggatgtgggagttttttttaaatagcttttaagcccctggggctttgcccccaattttgggggcgatgcttatttaaagggggggtggtcattttatcttcacat

SEQ ID NO: 313036 - DNA, 1609 bp, Homo sapiens
tatactcctaacatcaacaatacgtcagtcagagaccagggattaaatcgagcacgaggcctcaccttcccggggcgggcggggtggggtgagaggggttgggccctactcccccgacttccactcccgtgcgggtgggggtctcgcccccttagtaacctctccgaaattgacagaagagaaacgctggggaggggcggtgttccgaagatgggatttcagggagaaaatctgagaccacttgcttaacttgagggtcctcctcgacccccaaaattgagcggagtacgagatggagaagtcgatggggaaagaaatcgcgccccttccgagaccctcctcagaattcccacagtgggagcgaactaggaagcaagggaggtccccttccccttcaccaacttgcccctcaggtgggggtgattcccagggtgcacccctgggctacaacattggggagaggagcgagatcgcggaagccgagggtgcagagttgcccttttaagcgccctccaccccctcgcctggaggcgcacgcggcccctttaaggcgcggggcattgtgggtgcggggagtggaattttggaacgaaatgtaacgaagagaagtgatgaagtcgtcttcttcggtgaccacttccgagacccaaccctgcacgcccagctccagtgattactcggacctacagagggtgaaacaggagcttctggaagaggtgaagaaggaattgcagaaagtgaaagaggaaatcattgaagccttcgtccaggagctgaggaagcggggttctccctgaccacagggacccagaagacccgcttctcctttccgcacacccggcctgtcaccctgctttccctgcctctacttgacttggaattggctgaagactacacaggaatgcatcgttcccactccccatcccacttggaaaactccaagggggtgtggcttccctgctcacacccacactggctgctgattggctggggaggcccccgcccttttctccctttggtccttcccctctgccatccccttggggccggtccctctgctggggatgcaccaatgaaccccacaggaagggggaaggaaggagggaatttcacattcccttgttctagattcactttaacgcttaatgccttcaaagttttggtttttttaagaaaaaaaaatatatatatatttgggttttgggggaaaagggaaatttttttttctctttggttttgataaaatgggatgtgggagtttttaaatgctatagccctgggcttgccccatttggggcagctatttaaggggaggggatgtctcaccgggctgggggtgagacatccccccaccccagggactccccttccctctggctccttccccttttctatgaggaaataagatgctgtaactttttggaacctcagttttttgattttttatttgggtaggttttggggtccaggccattttttttaccccttggaggaaataagatgagggagaaaggaaaaggggaggaaacttctcccctcccaccttcacctttagcttcttgaaaatgggcccctgcagaataaatctgccagtttttataaatgctaa

SEQ ID NO: 313037 - DNA, 1539 bp, Homo sapiens
tatactcctaacatcaacaatacgtcagtcagagaccagggattaaatcgagcacgaggcctcaccttcccggggcgggcggggtggggtgagaggggttgggccctactcccccgacttccactcccgtgcgggtgggggtctcgcccccttagtaacctctccgaaattgacagaagagaaacgctggggaggggcggtgttccgaagatgggatttcagggagaaaatctgagaccacttgcttaacttgagggtcctcctcgacccccaaaattgagcggagtacgagatggagaagtcgatggggaaagaaatcgcgccccttccgagaccctcctcagaattcccacagtgggagcgaactaggaagcaagggaggtccccttccccttcaccaacttgcccctcaggtgggggtgattcccagggtgcacccctgggctacaacattggggagaggagcgagatcgcggaagccgagggtgcagagttgcccttttaagcgccctccaccccctcgcctggaggcgcacgcggcccctttaaggcgcggggcattgtgggtgcggggagtggaattttggaacgaaatgtaacgaagagaagtacagtagtaagagtaacactgtagccgccaccggcaaggggtgcgcgctggggagcggacgctgcatcccctttctgctgcaggaacctctcatcagaccgcctgagggaagcggcgcccggagacccgccccggcccggtccacattctccccaggaagccggactctatggggcgggaccctgggggagcctgagccgagcccggagccagccccgaacccctgaacctccagccaggggcgccccgggagcagccagcccgtgggcgagccgcccgcccgccgagcagccatgagcgagacggtcatctgttccagccgggccactgtgatgctttatgatgatggcaacaagcgatggctccctgctggcacgggtccccaggccttcagccgcgtccagatctaccacaaccccacggccaattcctttcgcgtcgtgggccggaagatgcagcccgaccagcaggtggtcatcaactgtgccatcgtccggggtgtcaagtataaccaggccacccccaacttccatcagtggcgcgacgctcgccaggtctggggcctcaacttcggcagcaaggaggatgcggcccagtttgccgccggcatggccagtgccctagaggcgttggaaggaggtgggccccctccacccccagcacttcccacctggtcggtcccgaacggcccctccccggaggaggtggagcagcagaaaaggcagcagcccggcccgtcggagcacatagagcgccgggtctccaatgcaggaggcccacctgatgcgagcaggtgggaggtccacggaaaggaaagcacgagagagcaaggagctagacgaggaagaacagagcaacagaaaaagaaaaaaaagaaagagagacagggaaaacaaaagaagaaaaaagaacagaaaagaaaaaacaaa

SEQ ID NO: 313038 - DNA, 1844 bp, Homo sapiens
tatactcctaacatcaacaatacgtcagtcagagaccagggattaaatcgagcacgaggcctcaccttcccggggcgggcggggtggggtgagaggggttgggccctactcccccgacttccactcccgtgcgggtgggggtctcgcccccttagtaacctctccgaaattgacagaagagaaacgctggggaggggcggtgttccgaagatgggatttcagggagaaaatctgagaccacttgcttaacttgagggtcctcctcgacccccaaaattgagcggagtacgagatggagaagtcgatggggaaagaaatcgcgccccttccgagaccctcctcagaattcccacagtgggagcgaactaggaagcaagggaggtccccttccccttcaccaacttgcccctcaggtgggggtgattcccagggtgcacccctgggctacaacattggggagaggagcgagatcgcggaagccgagggtgcagagttgcccttttaagcgccctccaccccctcgcctggaggcgcacgcggcccctttaaggcgcggggcattgtgggtgcggggagtggaattttggaacgaaatgtaacgaagagaagtacagtagtaagagtaacactgtagccgccaccggcaaggggtgcgcgctggggagcggacgctgcatcccctttctgctgcaggaacctctcatcagaccgcctgagggaagcggcgcccggagacccgccccggcccggtccacattctccccaggaagccggactctatggggcgggaccctgggggagcctgagccgagcccggagccagccccgaacccctgaacctccagccaggggcgccccgggagcagccagcccgtgggcgagccgcccgcccgccgagcagccatgagcgagacggtcatctgttccagccgggccactgtgatgctttatgatgatggcaacaagcgatggctccctgctggcacgggtccccaggccttcagccgcgtccagatctaccacaaccccacggccaattcctttcgcgtcgtgggccggaagatgcagcccgaccagcaggtggtcatcaactgtgccatcgtccggggtgtcaagtataaccaggccacccccaacttccatcagtggcgcgacgctcgccaggtctggggcctcaacttcggcagcaaggaggatgcggcccagtttgccgccggcatggccagtgccctagaggcgttggaaggaggtgggccccctccacccccagcacttcccacctggtcgcctctgctggggatgcaccaatgaaccccacaggaagggggaaggaaggagggaatttcacattcccttgttctagattcactttaacgcttaatgccttcaaagttttggtttttttaagaaaaaaaaatatatatatatttgggttttgggggaaaagggaaatttttttttctctttggttttgataaaatgggatgtgggagtttttaaatgctatagccctgggcttgccccatttggggcagctatttaaggggaggggatgtctcaccgggctgggggtgagacatccccccaccccagggactccccttccctctggctccttccccttttctatgaggaaataagatgctgtaactttttggaacctcagttttttgattttttatttgggtaggttttggggtccaggccattttttttaccccttggaggaaataagatgagggagaaaggaaaaggggaggaaacttctcccctcccaccttcacctttagcttcttgaaaatgggcccctgcagaataaatctgccagtttttataaatgctaa

SEQ ID NO: 313039 - DNA, 2349 bp, Homo sapiens
tatactcctaacatcaacaatacgtcagtcagagaccagggattaaatcgagcacgaggcctcaccttcccggggcgggcggggtggggtgagaggggttgggccctactcccccgacttccactcccgtgcgggtgggggtctcgcccccttagtaacctctccgaaattgacagaagagaaacgctggggaggggcggtgttccgaagatgggatttcagggagaaaatctgagaccacttgcttaacttgagggtcctcctcgacccccaaaattgagcggagtacgagatggagaagtcgatggggaaagaaatcgcgccccttccgagaccctcctcagaattcccacagtgggagcgaactaggaagcaagggaggtccccttccccttcaccaacttgcccctcaggtgggggtgattcccagggtgcacccctgggctacaacattggggagaggagcgagatcgcggaagccgagggtgcagagttgcccttttaagcgccctccaccccctcgcctggaggcgcacgcggcccctttaaggcgcggggcattgtgggtgcggggagtggaattttggaacgaaatgtaacgaagagaagtacagtagtaagagtaacactgtagccgccaccggcaaggggtgcgcgctggggagcggacgctgcatcccctttctgctgcaggaacctctcatcagaccgcctgagggaagcggcgcccggagacccgccccggcccggtccacattctccccaggaagccggactctatggggcgggaccctgggggagcctgagccgagcccggagccagccccgaacccctgaacctccagccaggggcgccccgggagcagccagcccgtgggcgagccgcccgcccgccgagcagccatgagcgagacggtcatctgttccagccgggccactgtgatgctttatgatgatggcaacaagcgatggctccctgctggcacgggtccccaggccttcagccgcgtccagatctaccacaaccccacggccaattcctttcgcgtcgtgggccggaagatgcagcccgaccagcaggtggtcatcaactgtgccatcgtccggggtgtcaagtataaccaggccacccccaacttccatcagtggcgcgacgctcgccaggtctggggcctcaacttcggcagcaaggaggatgcggcccagtttgccgccggcatggccagtgccctagaggcgttggaaggaggtgggccccctccacccccagcacttcccacctggtcggtcccgaacggcccctccccggaggaggtggagcagcagaaaaggcagcagcccggcccgtcggagcacatagagcgccgggtctccaatgcaggaggcccacctgctccccccgctgggggtccacccccaccaccaggacctccccctcctccaggtccccccccacccccaggtttgcccccttcgggggtcccagctgcagcgcacggagcagggggaggaccaccccctgcaccccctctcccggcagcacagggccctggtggtgggggagctggggccccaggcctggccgcagctattgctggagccaaactcaggaaagtcagcaagcaggaggaggcctcaggggggcccacagcccccaaagctgagagtggtcgaagcggaggtgggggactcatggaagagatgaacgccatgctggcccggagaaggaaagccacgcaagttggggagaaaacccccaaggatgaatctgccaatcaggaggagccagaggccagagtcccggcccagagtggtgagtagagtgcccagtccagccacaggaactacaaatcccagaatactctgttctcacatgttaagcacccttataggagagtcagggcgaatggtgctggggattgtagtctcctgagatggggctttgatcaggggctgatgaggttgggggagtaagattgattggggggcagtcttttgtccctgatctttctgatttcttgcctatccccagaatctgtgcggagaccctgggagaagaacagcacaaccttgccaaggtaggccatcggtcctggggcccttggggaggtaaaggcgggcagatcgcttgagcccaggaggtcaagaccagcctgggcaacatggcgacaccccatctctacaaaaattagccaggcgtggtagcacttacctgtggtcccagctactcaggaggctgaggtgggaggattacttgagcccaggaagttgaggcctcagcgagccatcatcatgcctgcactccagcctgagaaatagaatgtgactgtctcaaaacaaaacacaaca

SEQ ID NO: 313040 - DNA, 2711 bp, Homo sapiens
tatactcctaacatcaacaatacgtcagtcagagaccagggattaaatcgagcacgaggcctcaccttcccggggcgggcggggtggggtgagaggggttgggccctactcccccgacttccactcccgtgcgggtgggggtctcgcccccttagtaacctctccgaaattgacagaagagaaacgctggggaggggcggtgttccgaagatgggatttcagggagaaaatctgagaccacttgcttaacttgagggtcctcctcgacccccaaaattgagcggagtacgagatggagaagtcgatggggaaagaaatcgcgccccttccgagaccctcctcagaattcccacagtgggagcgaactaggaagcaagggaggtccccttccccttcaccaacttgcccctcaggtgggggtgattcccagggtgcacccctgggctacaacattggggagaggagcgagatcgcggaagccgagggtgcagagttgcccttttaagcgccctccaccccctcgcctggaggcgcacgcggcccctttaaggcgcggggcattgtgggtgcggggagtggaattttggaacgaaatgtaacgaagagaagtacagtagtaagagtaacactgtagccgccaccggcaaggggtgcgcgctggggagcggacgctgcatcccctttctgctgcaggaacctctcatcagaccgcctgagggaagcggcgcccggagacccgccccggcccggtccacattctccccaggaagccggactctatggggcgggaccctgggggagcctgagccgagcccggagccagccccgaacccctgaacctccagccaggggcgccccgggagcagccagcccgtgggcgagccgcccgcccgccgagcagccatgagcgagacggtcatctgttccagccgggccactgtgatgctttatgatgatggcaacaagcgatggctccctgctggcacgggtccccaggccttcagccgcgtccagatctaccacaaccccacggccaattcctttcgcgtcgtgggccggaagatgcagcccgaccagcaggtggtcatcaactgtgccatcgtccggggtgtcaagtataaccaggccacccccaacttccatcagtggcgcgacgctcgccaggtctggggcctcaacttcggcagcaaggaggatgcggcccagtttgccgccggcatggccagtgccctagaggcgttggaaggaggtgggccccctccacccccagcacttcccacctggtcggtcccgaacggcccctccccggaggaggtggagcagcagaaaaggcagcagcccggcccgtcggagcacatagagcgccgggtctccaatgcaggaggcccacctgctccccccgctgggggtccacccccaccaccaggacctccccctcctccaggtccccccccacccccaggtttgcccccttcgggggtcccagctgcagcgcacggagcagggggaggaccaccccctgcaccccctctcccggcagcacagggccctggtggtgggggagctggggccccaggcctggccgcagctattgctggagccaaactcaggaaagtcagcaagcaggaggaggcctcaggggggcccacagcccccaaagctgagagtggtcgaagcggaggtgggggactcatggaagagatgaacgccatgctggcccggagaaggaaagccacgcaagttggggagaaaacccccaaggatgaatctgccaatcaggaggagccagaggccagagtcccggcccagagtggtgagtagagtgcccagtccagccacaggaactacaaatcccagaatactctgttctcacatgttaagcacccttataggagagtcagggcgaatggtgctggggattgtagtctcctgagatggggctttgatcaggggctgatgaggttgggggagtaagattgattggggggcagtcttttgtccctgatctttctgatttcttgcctatccccagaatctgtgcggagaccctgggagaagaacagcacaaccttgccaaggatgaagtcgtcttcttcggtgaccacttccgagacccaaccctgcacgcccagctccagtgattactcggacctacagagggtgaaacaggtaacttgggggggaagttggggaccacagcaagagagatctaggtctggcccctgccactggcatgccgtatgatcctagataacatctcagaaaccgagactccacacccccttttctggcacctgtgacagacattattaatctatcaccgcgctcattccagatgagtgccttgaattctttccgcacattgacccagctgtccatcaccaattggagttggcaggaggctggaatgcgcttgccaaccttggtactggatgttctccagtacttttccggctccaaggatccagaattctcccctagaatcctccagtcactctgcgaccttgacagcgatgtcatggtgtcgatgtaggggtaggtctcaaacctactacccctggcttttccatcaacaagaaagaggggactctggcagggcacggtggctcatgtgtgtaatttcagcacattgcgaggctgaggtgggagcattgcttgaggccaggagtttgagaccagcctggggcaacatcgggagacccccatctcta

SEQ ID NO: 313041 - DNA, 1060 bp, Homo sapiens
gggaagttgaggctgcaatgagctgtgatcatgccattgcaccctagcctgggcaacagagcaaggttccttctcaaaaaataaaagaagggggattcattcctgcaagtcccggtaccccctcctgattagttttaccccattaattttaggagcttctggaagaggtgaagaaggaattgcagaaagtgaaagaggaaatcattgaagccttcgtccaggagctgaggaagcggggttctccctgaccacagggacccagaagacccgcttctcctttccgcacacccggcctgtcaccctgctttccctgcctctacttgacttggaattggctgaagactacacaggaatgcatcgttcccactccccatcccacttggaaaactccaagggggtgtggcttccctgctcacacccacactggctgctgattggctggggaggcccccgcccttttctccctttggtccttcccctctgccatccccttggggccggtccctctgctggggatgcaccaatgaaccccacaggaagggggaaggaaggagggaatttcacattcccttgttctagattcactttaacgcttaatgccttcaaagttttggtttttttaagaaaaaaaaatatatatatatttgggttttgggggaaaagggaaatttttttttctctttggttttgataaaatgggatgtgggagtttttaaatgctatagccctgggcttgccccatttggggcagctatttaaggggaggggatgtctcaccgggctgggggtgagacatccccccaccccagggactccccttccctctggctccttccccttttctatgaggaaataagatgctgtaactttttggaacctcagttttttgattttttatttgggtaggttttggggtccaggccattttttttaccccttggaggaaataagatgagggagaaaggaaaaggggaggaaacttctcccctcccaccttcacctttagcttcttgaaaatgggcccctgcagaataaatctgccagtttttataaatgctaa

SEQ ID NO: 313042 - DNA, 1578 bp, Homo sapiens
tatactcctaacatcaacaatacgtcagtcagagaccagggattaaatcgagcacgaggcctcaccttcccggggcgggcggggtggggtgagaggggttgggccctactcccccgacttccactcccgtgcgggtgggggtctcgcccccttagtaacctctccgaaattgacagaagagaaacgctggggaggggcggtgttccgaagatgggatttcagggagaaaatctgagaccacttgcttaacttgagggtcctcctcgacccccaaaattgagcggagtacgagatggagaagtcgatggggaaagaaatcgcgccccttccgagaccctcctcagaattcccacagtgggagcgaactaggaagcaagggaggtccccttccccttcaccaacttgcccctcaggtgggggtgattcccagggtgcacccctgggctacaacattggggagaggagcgagatcgcggaagccgagggtgcagagttgcccttttaagcgccctccaccccctcgcctggaggcgcacgcggcccctttaaggcgcggggcattgtgggtgcggggagtggaattttggaacgaaatgtaacgaagagaagtacagtagtaagagtaacactgtagccgccaccggcaaggggtgcgcgctggggagcggacgctgcatcccctttctgctgcaggaacctctcatcagaccgcctgagggaagcggcgcccggagacccgccccggcccggtccacattctccctgaccacagggacccagaagacccgcttctcctttccgcacacccggcctgtcaccctgctttccctgcctctacttgacttggaattggctgaagactacacaggaatgcatcgttcccactccccatcccacttggaaaactccaagggggtgtggcttccctgctcacacccacactggctgctgattggctggggaggcccccgcccttttctccctttggtccttcccctctgccatccccttggggccggtccctctgctggggatgcaccaatgaaccccacaggaagggggaaggaaggagggaatttcacattcccttgttctagattcactttaacgcttaatgccttcaaagttttggtttttttaagaaaaaaaaatatatatatatttgggttttgggggaaaagggaaatttttttttctctttggttttgataaaatgggatgtgggagtttttaaatgctatagccctgggcttgccccatttggggcagctatttaaggggaggggatgtctcaccgggctgggggtgagacatccccccaccccagggactccccttccctctggctccttccccttttctatgaggaaataagatgctgtaactttttggaacctcagttttttgattttttatttgggtaggttttggggtccaggccattttttttaccccttggaggaaataagatgagggagaaaggaaaaggggaggaaacttctcccctcccaccttcacctttagcttcttgaaaatgggcccctgcagaataaatctgccagtttttataaatgctaa

SEQ ID NO: 313043 - DNA, 769 bp, Homo sapiens
tcctttttccccacccctcccccatctgttcatctgtctgtctgccttcagtctgtctctcctctttgtcaacccgactctccctttcccacctctctctgcgtctgtctcttgcatctcgtttgtgtgtttgcctgtctctcctgatctgattttctctcctgatctgtctcccccgtctccttctgtccacgtggctcctgcctccctctcctctgctggggatgcaccaatgaaccccacaggaagggggaaggaaggagggaatttcacattcccttgttctagattcactttaacgcttaatgccttcaaagttttggtttttttaagaaaaaaaaatatatatatatttgggttttgggggaaaagggaaatttttttttctctttggttttgataaaatgggatgtgggagtttttaaatgctatagccctgggcttgccccatttggggcagctatttaaggggaggggatgtctcaccgggctgggggtgagacatccccccaccccagggactccccttccctctggctccttccccttttctatgaggaaataagatgctgtaactttttggaacctcagttttttgattttttatttgggtaggttttggggtccaggccattttttttaccccttggaggaaataagatgagggagaaaggaaaaggggaggaaacttctcccctcccaccttcacctttagcttcttgaaaatgggcccctgcagaataaatctgccagtttttataaatgctaa

SEQ ID NO: 313044 - DNA, 1294 bp, Homo sapiens
tatactcctaacatcaacaatacgtcagtcagagaccagggattaaatcgagcacgaggcctcaccttcccggggcgggcggggtggggtgagaggggttgggccctactcccccgacttccactcccgtgcgggtgggggtctcgcccccttagtaacctctccgaaattgacagaagagaaacgctggggaggggcggtgttccgaagatgggatttcagggagaaaatctgagaccacttgcttaacttgagggtcctcctcgacccccaaaattgagcggagtacgagatggagaagtcgatggggaaagaaatcgcgccccttccgagaccctcctcagaattcccacagtgggagcgaactaggaagcaagggaggtccccttccccttcaccaacttgcccctcaggtgggggtgattcccagggtgcacccctgggctacaacattggggagaggagcgagatcgcggaagccgagggtgcagagttgcccttttaagcgccctccaccccctcgcctggaggcgcacgcggcccctttaaggcgcggggcattgtgggtgcggggagtggaattttggaacgaaatgtaacgaagagaagtgatgaagtcgtcttcttcggtgaccacttccgagacccaaccctgcacgcccagctccagtgattactcggacctacagagggtgaaacaggtaacttgggggggaagttggggaccacagcaagagagatctaggtctggcccctgccactggcatgccgtatgatcctagataacatctcagaaacctcaggtttccaatctgacaaatggagaaactggattgggtcaaggatgaccgagactccacacccccttttctggcacctgtgacagacattattaatctatcaccgcgctcattccagatgagtgccttgaattctttccgcacattgacccagctgtccatcaccaattggagttggcaggaggctggaatgcgcttgccaaccttggtactggatgttctccagtacttttccggctccaaggatccagaattctcccctagaatcctccagtcactctgcgaccttgacagcgatgtcatggtgtcgatgtaggggtaggtctcaaacctactacccctggcttttccatcaacaagaaagaggggactctggcagggcacggtggctcatgtgtgtaatttcagcacattgcgaggctgaggtgggagcattgcttgaggccaggagtttgagaccagcctggggcaacatcgggagacccccatctcta

SEQ ID NO: 313045 - DNA, 1038 bp, Homo sapiens
acatgacaaataggttttacatcacagcctaactccaatcgattggtagtggctgcctgagcactccgatgagaagaatcctgaagaaatgaatgggatatccattgatggggaatgattaataaacttgggcagatcccacattgtatgatataacgtatctattaaaaacatgccctaatctgccaaggtttggtggctcactcctataattctagcactttgggagactgagttgggaggattacttgcccaatttataaggcagagctcaatgtgatccctggaataggaggcggggaagcaggtcctctctctaatctcattgctgtcccaaaccacaccaactcccccgatgaagtcgtcttcttcggtgaccacttccgagacccaaccctgcacgcccagctccagtgattactcggacctacagagggtgaaacaggtaacttgggggggaagttggggaccacagcaagagagatctaggtctggcccctgccactggcatgccgtatgatcctagataacatctcagaaacctcaggtttccaatctgacaaatggagaaactggattgggtcaaggatgaccgagactccacacccccttttctggcacctgtgacagacattattaatctatcaccgcgctcattccagatgagtgccttgaattctttccgcacattgacccagctgtccatcaccaattggagttggcaggaggctggaatgcgcttgccaaccttggtactggatgttctccagtacttttccggctccaaggatccagaattctcccctagaatcctccagtcactctgcgaccttgacagcgatgtcatggtgtcgatgtaggggtaggtctcaaacctactacccctggcttttccatcaacaagaaagaggggactctggcagggcacggtggctcatgtgtgtaatttcagcacattgcgaggctgaggtgggagcattgcttgaggccaggagtttgagaccagcctggggcaacatcgggagacccccatctcta

SEQ ID NO: 313046 - DNA, 2858 bp, Homo sapiens
tatactcctaacatcaacaatacgtcagtcagagaccagggattaaatcgagcacgaggcctcaccttcccggggcgggcggggtggggtgagaggggttgggccctactcccccgacttccactcccgtgcgggtgggggtctcgcccccttagtaacctctccgaaattgacagaagagaaacgctggggaggggcggtgttccgaagatgggatttcagggagaaaatctgagaccacttgcttaacttgagggtcctcctcgacccccaaaattgagcggagtacgagatggagaagtcgatggggaaagaaatcgcgccccttccgagaccctcctcagaattcccacagtgggagcgaactaggaagcaagggaggtccccttccccttcaccaacttgcccctcaggtgggggtgattcccagggtgcacccctgggctacaacattggggagaggagcgagatcgcggaagccgagggtgcagagttgcccttttaagcgccctccaccccctcgcctggaggcgcacgcggcccctttaaggcgcggggcattgtgggtgcggggagtggaattttggaacgaaatgtaacgaagagaagtacagtagtaagagtaacactgtagccgccaccggcaaggggtgcgcgctggggagcggacgctgcatcccctttctgctgcaggaacctctcatcagaccgcctgagggaagcggcgcccggagacccgccccggcccggtccacattctccccaggaagccggactctatggggcgggaccctgggggagcctgagccgagcccggagccagccccgaacccctgaacctccagccaggggcgccccgggagcagccagcccgtgggcgagccgcccgcccgccgagcagccatgagcgagacggtcatctgttccagccgggccactgtgatgctttatgatgatggcaacaagcgatggctccctgctggcacgggtccccaggccttcagccgcgtccagatctaccacaaccccacggccaattcctttcgcgtcgtgggccggaagatgcagcccgaccagcaggtggtcatcaactgtgccatcgtccggggtgtcaagtataaccaggccacccccaacttccatcagtggcgcgacgctcgccaggtctggggcctcaacttcggcagcaaggaggatgcggcccagtttgccgccggcatggccagtgccctagaggcgttggaaggaggtgggccccctccacccccagcacttcccacctggtcggtcccgaacggcccctccccggaggaggtggagcagcagaaaaggcagcagcccggcccgtcggagcacatagagcgccgggtctccaatgcaggaggcccacctgctccccccgctgggggtccacccccaccaccaggacctccccctcctccaggtccccccccacccccaggtttgcccccttcgggggtcccagctgcagcgcacggagcagggggaggaccaccccctgcaccccctctcccggcagcacagggccctggtggtgggggagctggggccccaggcctggccgcagctattgctggagccaaactcaggaaagtcagcaagcaggaggaggcctcaggggggcccacagcccccaaagctgagagtggtcgaagcggaggtgggggactcatggaagagatgaacgccatgctggcccggagaaggaaagccacgcaagttggggagaaaacccccaaggatgaatctgccaatcaggaggagccagaggccagagtcccggcccagagtgaatctgtgcggagaccctgggagaagaacagcacaaccttgccaaggatgaagtcgtcttcttcggtgaccacttccgagacccaaccctgcacgcccagctccagtgattactcggacctacagagggtgaaacaggagcttctggaagaggtgaagaaggaattgcagaaagtgaaagaggaaatcattgaagccttcgtccaggagctgaggaagcggggttctccctgaccacagggacccagaagacccgcttctcctttccgcacacccggcctgtcaccctgctttccctgcctctacttgacttggaattggctgaagactacacaggaatgcatcgttcccactccccatcccacttggaaaactccaagggggtgtggcttccctgctcacacccacactggctgctgattggctggggaggcccccgcccttttctccctttggtccttcccctctgccatccccttggggccggtccctctgctggggatgcaccaatgaaccccacaggaagggggaaggaaggagggaatttcacattcccttgttctagattcactttaacgcttaatgccttcaaagttttggtttttttaagaaaaaaaaatatatatatatttgggttttgggggaaaagggaaatttttttttctctttggttttgataaaatgggatgtgggagtttttaaatgctatagccctgggcttgccccatttggggcagctatttaaggggaggggatgtctcaccgggctgggggtgagacatccccccaccccagggactccccttccctctggctccttccccttttctatgaggaaataagatgctgtaactttttggaacctcagttttttgattttttatttgggtaggttttggggtccaggccattttttttaccccttggaggaaataagatgagggagaaaggaaaaggggaggaaacttctcccctcccaccttcacctttagcttcttgaaaatgggcccctgcagaataaatctgccagtttttataaatgctaa

SEQ ID NO: 313047 - DNA, 2773 bp, Homo sapiens
tatactcctaacatcaacaatacgtcagtcagagaccagggattaaatcgagcacgaggcctcaccttcccggggcgggcggggtggggtgagaggggttgggccctactcccccgacttccactcccgtgcgggtgggggtctcgcccccttagtaacctctccgaaattgacagaagagaaacgctggggaggggcggtgttccgaagatgggatttcagggagaaaatctgagaccacttgcttaacttgagggtcctcctcgacccccaaaattgagcggagtacgagatggagaagtcgatggggaaagaaatcgcgccccttccgagaccctcctcagaattcccacagtgggagcgaactaggaagcaagggaggtccccttccccttcaccaacttgcccctcaggtgggggtgattcccagggtgcacccctgggctacaacattggggagaggagcgagatcgcggaagccgagggtgcagagttgcccttttaagcgccctccaccccctcgcctggaggcgcacgcggcccctttaaggcgcggggcattgtgggtgcggggagtggaattttggaacgaaatgtaacgaagagaagtacagtagtaagagtaacactgtagccgccaccggcaaggggtgcgcgctggggagcggacgctgcatcccctttctgctgcaggaacctctcatcagaccgcctgagggaagcggcgcccggagacccgccccggcccggtccacattctccccaggaagccggactctatggggcgggaccctgggggagcctgagccgagcccggagccagccccgaacccctgaacctccagccaggggcgccccgggagcagccagcccgtgggcgagccgcccgcccgccgagcagccatgagcgagacggtcatctgttccagccgggccactgtgatgctttatgatgatggcaacaagcgatggctccctgctggcacgggtccccaggccttcagccgcgtccagatctaccacaaccccacggccaattcctttcgcgtcgtgggccggaagatgcagcccgaccagcaggtggtcatcaactgtgccatcgtccggggtgtcaagtataaccaggccacccccaacttccatcagtggcgcgacgctcgccaggtctggggcctcaacttcggcagcaaggaggatgcggcccagtttgccgccggcatggccagtgccctagaggcgttggaaggcagcagcccggcccgtcggagcacatagagcgccgggtctccaatgcaggaggcccacctgctccccccgctgggggtccacccccaccaccaggacctccccctcctccaggtccccccccacccccaggtttgcccccttcgggggtcccagctgcagcgcacggagcagggggaggaccaccccctgcaccccctctcccggcagcacagggccctggtggtgggggagctggggccccaggcctggccgcagctattgctggagccaaactcaggaaagtcagcaagcaggaggaggcctcaggggggcccacagcccccaaagctgagagtggtcgaagcggaggtgggggactcatggaagagatgaacgccatgctggcccggagaaggaaagccacgcaagttggggagaaaacccccaaggatgaatctgccaatcaggaggagccagaggccagagtcccggcccagagtgaatctgtgcggagaccctgggagaagaacagcacaaccttgccaaggatgaagtcgtcttcttcggtgaccacttccgagacccaaccctgcacgcccagctccagtgattactcggacctacagagggtgaaacaggagcttctggaagaggtgaagaaggaattgcagaaagtgaaagaggaaatcattgaagccttcgtccaggagctgaggaagcggggttctccctgaccacagggacccagaagacccgcttctcctttccgcacacccggcctgtcaccctgctttccctgcctctacttgacttggaattggctgaagactacacaggaatgcatcgttcccactccccatcccacttggaaaactccaagggggtgtggcttccctgctcacacccacactggctgctgattggctggggaggcccccgcccttttctccctttggtccttcccctctgccatccccttggggccggtccctctgctggggatgcaccaatgaaccccacaggaagggggaaggaaggagggaatttcacattcccttgttctagattcactttaacgcttaatgccttcaaagttttggtttttttaagaaaaaaaaatatatatatatttgggttttgggggaaaagggaaatttttttttctctttggttttgataaaatgggatgtgggagtttttaaatgctatagccctgggcttgccccatttggggcagctatttaaggggaggggatgtctcaccgggctgggggtgagacatccccccaccccagggactccccttccctctggctccttccccttttctatgaggaaataagatgctgtaactttttggaacctcagttttttgattttttatttgggtaggttttggggtccaggccattttttttaccccttggaggaaataagatgagggagaaaggaaaaggggaggaaacttctcccctcccaccttcacctttagcttcttgaaaatgggcccctgcagaataaatctgccagtttttataaatgctaa

SEQ ID NO: 313048 - DNA, 2545 bp, Homo sapiens
tatactcctaacatcaacaatacgtcagtcagagaccagggattaaatcgagcacgaggcctcaccttcccggggcgggcggggtggggtgagaggggttgggccctactcccccgacttccactcccgtgcgggtgggggtctcgcccccttagtaacctctccgaaattgacagaagagaaacgctggggaggggcggtgttccgaagatgggatttcagggagaaaatctgagaccacttgcttaacttgagggtcctcctcgacccccaaaattgagcggagtacgagatggagaagtcgatggggaaagaaatcgcgccccttccgagaccctcctcagaattcccacagtgggagcgaactaggaagcaagggaggtccccttccccttcaccaacttgcccctcaggtgggggtgattcccagggtgcacccctgggctacaacattggggagaggagcgagatcgcggaagccgagggtgcagagttgcccttttaagcgccctccaccccctcgcctggaggcgcacgcggcccctttaaggcgcggggcattgtgggtgcggggagtggaattttggaacgaaatgtaacgaagagaagtacagtagtaagagtaacactgtagccgccaccggcaaggggtgcgcgctggggagcggacgctgcatcccctttctgctgcaggaacctctcatcagaccgcctgagggaagcggcgcccggagacccgccccggcccggtccacattctccccaggaagccggactctatggggcgggaccctgggggagcctgagccgagcccggagccagccccgaacccctgaacctccagccaggggcgccccgggagcagccagcccgtgggcgagccgcccgcccgccgagcagccatgagcgagacggtcatctgttccagccgggccactgtgatgctttatgatgatggcaacaagcgatggctccctgctggcacgggtccccaggccttcagccgcgtccagatctaccacaaccccacggccaattcctttcgcgtcgtgggccggaagatgcagcccgaccagcaggtggtcatcaactgtgccatcgtccggggtgtcaagtataaccagctccaggtccccccccacccccaggtttgcccccttcgggggtcccagctgcagcgcacggagcagggggaggaccaccccctgcaccccctctcccggcagcacagggccctggtggtgggggagctggggccccaggcctggccgcagctattgctggagccaaactcaggaaagtcagcaagcaggaggaggcctcaggggggcccacagcccccaaagctgagagtggtcgaagcggaggtgggggactcatggaagagatgaacgccatgctggcccggagaaggaaagccacgcaagttggggagaaaacccccaaggatgaatctgccaatcaggaggagccagaggccagagtcccggcccagagtgaatctgtgcggagaccctgggagaagaacagcacaaccttgccaaggatgaagtcgtcttcttcggtgaccacttccgagacccaaccctgcacgcccagctccagtgattactcggacctacagagggtgaaacaggagcttctggaagaggtgaagaaggaattgcagaaagtgaaagaggaaatcattgaagccttcgtccaggagctgaggaagcggggttctccctgaccacagggacccagaagacccgcttctcctttccgcacacccggcctgtcaccctgctttccctgcctctacttgacttggaattggctgaagactacacaggaatgcatcgttcccactccccatcccacttggaaaactccaagggggtgtggcttccctgctcacacccacactggctgctgattggctggggaggcccccgcccttttctccctttggtccttcccctctgccatccccttggggccggtccctctgctggggatgcaccaatgaaccccacaggaagggggaaggaaggagggaatttcacattcccttgttctagattcactttaacgcttaatgccttcaaagttttggtttttttaagaaaaaaaaatatatatatatttgggttttgggggaaaagggaaatttttttttctctttggttttgataaaatgggatgtgggagtttttaaatgctatagccctgggcttgccccatttggggcagctatttaaggggaggggatgtctcaccgggctgggggtgagacatccccccaccccagggactccccttccctctggctccttccccttttctatgaggaaataagatgctgtaactttttggaacctcagttttttgattttttatttgggtaggttttggggtccaggccattttttttaccccttggaggaaataagatgagggagaaaggaaaaggggaggaaacttctcccctcccaccttcacctttagcttcttgaaaatgggcccctgcagaataaatctgccagtttttataaatgctaa

SEQ ID NO: 313049 - DNA, 1584 bp, Homo sapiens
ggctcagcccggagccggcgtgtgggggcgggggctcccgggagggtctcctcacctgcagcagcccggcccgtcggagcacatagagcgccgggtctccaatgcaggaggcccacctgctccccccgctgggggtccacccccaccaccaggacctccccctcctccaggtccccccccacccccaggtttgcccccttcgggggtcccagctgcagcgcacggagcagggggaggaccaccccctgcaccccctctcccggcagcacagggccctggtggtgggggagctggggccccaggcctggccgcagctattgctggagccaaactcaggaaagtcagcaagcaggaggaggcctcaggggggcccacagcccccaaagctgagagtggtcgaagcggaggtgggggactcatggaagagatgaacgccatgctggcccggagaaggaaagccacgcaagttggggagaaaacccccaaggatgaatctgccaatcaggaggagccagaggccagagtcccggcccagagtgaatctgtgcggagaccctgggagaagaacagcacaaccttgccaaggatgaagtcgtcttcttcggtgaccacttccgagacccaaccctgcacgcccagctccagtgattactcggacctacagagggtgaaacaggagcttctggaagaggtgaagaaggaattgcagaaagtgaaagaggaaatcattgaagccttcgtccaggagctgaggaagcggggttctccctgaccacagggacccagaagacccgcttctcctttccgcacacccggcctgtcaccctgctttccctgcctctacttgacttggaattggctgaagactacacaggaatgcatcgttcccactccccatcccacttggaaaactccaagggggtgtggcttccctgctcacacccacactggctgctgattggctggggaggcccccgcccttttctccctttggtccttcccctctgccatccccttggggccggtccctctgctggggatgcaccaatgaaccccacaggaagggggaaggaaggagggaatttcacattcccttgttctagattcactttaacgcttaatgccttcaaagttttggtttttttaagaaaaaaaaatatatatatatttgggttttgggggaaaagggaaatttttttttctctttggttttgataaaatgggatgtgggagtttttaaatgctatagccctgggcttgccccatttggggcagctatttaaggggaggggatgtctcaccgggctgggggtgagacatccccccaccccagggactccccttccctctggctccttccccttttctatgaggaaataagatgctgtaactttttggaacctcagttttttgattttttatttgggtaggttttggggtccaggccattttttttaccccttggaggaaataagatgagggagaaaggaaaaggggaggaaacttctcccctcccaccttcacctttagcttcttgaaaatgggcccctgcagaataaatctgccagtttttataaatgctaa

SEQ ID NO: 313050 - DNA, 2407 bp, Homo sapiens
tatactcctaacatcaacaatacgtcagtcagagaccagggattaaatcgagcacgaggcctcaccttcccggggcgggcggggtggggtgagaggggttgggccctactcccccgacttccactcccgtgcgggtgggggtctcgcccccttagtaacctctccgaaattgacagaagagaaacgctggggaggggcggtgttccgaagatgggatttcagggagaaaatctgagaccacttgcttaacttgagggtcctcctcgacccccaaaattgagcggagtacgagatggagaagtcgatggggaaagaaatcgcgccccttccgagaccctcctcagaattcccacagtgggagcgaactaggaagcaagggaggtccccttccccttcaccaacttgcccctcaggtgggggtgattcccagggtgcacccctgggctacaacattggggagaggagcgagatcgcggaagccgagggtgcagagttgcccttttaagcgccctccaccccctcgcctggaggcgcacgcggcccctttaaggcgcggggcattgtgggtgcggggagtggaattttggaacgaaatgtaacgaagagaagtacagtagtaagagtaacactgtagccgccaccggcaaggggtgcgcgctggggagcggacgctgcatcccctttctgctgcaggaacctctcatcagaccgcctgagggaagcggcgcccggagacccgccccggcccggtccacattctccccaggaagccggactctatggggcgggaccctgggggagcctgagccgagcccggagccagccccgaacccctgaacctccagccaggggcgccccgggagcagccagcccgtgggcgagccgcccgcccgccgagcagccatgagcgagacggtcatctgttccagccgggccactgtgatgctttatgatgatggcaacaagcgatggctccctgctggcacgggtccccaggccttcagccgcgtccagatctaccacaaccccacggccaattcctttcgcgtcgtgggccggaagatgcagcccgaccagcaggtggtcatcaactgtgccatcgtccggggtgtcaagtataaccaggcctggccgcagctattgctggagccaaactcaggaaagtcagcaagcaggaggaggcctcaggggggcccacagcccccaaagctgagagtggtcgaagcggaggtgggggactcatggaagagatgaacgccatgctggcccggagaaggaaagccacgcaagttggggagaaaacccccaaggatgaatctgccaatcaggaggagccagaggccagagtcccggcccagagtgaatctgtgcggagaccctgggagaagaacagcacaaccttgccaaggatgaagtcgtcttcttcggtgaccacttccgagacccaaccctgcacgcccagctccagtgattactcggacctacagagggtgaaacaggagcttctggaagaggtgaagaaggaattgcagaaagtgaaagaggaaatcattgaagccttcgtccaggagctgaggaagcggggttctccctgaccacagggacccagaagacccgcttctcctttccgcacacccggcctgtcaccctgctttccctgcctctacttgacttggaattggctgaagactacacaggaatgcatcgttcccactccccatcccacttggaaaactccaagggggtgtggcttccctgctcacacccacactggctgctgattggctggggaggcccccgcccttttctccctttggtccttcccctctgccatccccttggggccggtccctctgctggggatgcaccaatgaaccccacaggaagggggaaggaaggagggaatttcacattcccttgttctagattcactttaacgcttaatgccttcaaagttttggtttttttaagaaaaaaaaatatatatatatttgggttttgggggaaaagggaaatttttttttctctttggttttgataaaatgggatgtgggagtttttaaatgctatagccctgggcttgccccatttggggcagctatttaaggggaggggatgtctcaccgggctgggggtgagacatccccccaccccagggactccccttccctctggctccttccccttttctatgaggaaataagatgctgtaactttttggaacctcagttttttgattttttatttgggtaggttttggggtccaggccattttttttaccccttggaggaaataagatgagggagaaaggaaaaggggaggaaacttctcccctcccaccttcacctttagcttcttgaaaatgggcccctgcagaataaatctgccagtttttataaatgctaa

SEQ ID NO: 313051 - DNA, 2300 bp, Homo sapiens
tatactcctaacatcaacaatacgtcagtcagagaccagggattaaatcgagcacgaggcctcaccttcccggggcgggcggggtggggtgagaggggttgggccctactcccccgacttccactcccgtgcgggtgggggtctcgcccccttagtaacctctccgaaattgacagaagagaaacgctggggaggggcggtgttccgaagatgggatttcagggagaaaatctgagaccacttgcttaacttgagggtcctcctcgacccccaaaattgagcggagtacgagatggagaagtcgatggggaaagaaatcgcgccccttccgagaccctcctcagaattcccacagtgggagcgaactaggaagcaagggaggtccccttccccttcaccaacttgcccctcaggtgggggtgattcccagggtgcacccctgggctacaacattggggagaggagcgagatcgcggaagccgagggtgcagagttgcccttttaagcgccctccaccccctcgcctggaggcgcacgcggcccctttaaggcgcggggcattgtgggtgcggggagtggaattttggaacgaaatgtaacgaagagaagtacagtagtaagagtaacactgtagccgccaccggcaaggggtgcgcgctggggagcggacgctgcatcccctttctgctgcaggaacctctcatcagaccgcctgagggaagcggcgcccggagacccgccccggcccggtccacattctccccaggaagccggactctatggggcgggaccctgggggagcctgagccgagcccggagccagccccgaacccctgaacctccagccaggggcgccccgggagcagccagcccgtgggcgagccgcccgcccgccgagcagccatgagcgagacggtcatctgttccagccgggccactgtgatgctttatgatgatggcaacaagcgatggctccctgctggcacgggtccccaggccttcagccgcgtccagatctaccacaaccccacggccaattcctttcgcgtcgtgggccggaagatgcagcccgaccagcaggtggtcatcaactgtgccatcgtccggggtgtcaagtataaccaggccacccccaacttccatcagtggcgcgacgctcgccaggtctggggcctcaacttcggcagcaaggaggatgcggcccagtttgccgccggcatggccagtgccctagaggcgttggaaggaggtgggccccctccacccccagcacttcccacctggtcggtcccgaacggcccctccccggaggaggtggagcagcagaaaaggcagcagcccggcccgtcggagcacatagagcgccgggtctccaatgcaggaggcccacctgctccccccgctgggggtccacccccaccaccaggacctccccctcctccaggtccccccccacccccaggtttgcccccttcgggggtcccagctgcagcgcacggagcagggggaggaccaccccctgcaccccctctcccggcagcacagggccctggtggtgggggagctggggccccaggcctggccgcagctattgctggagccaaactcaggaaagtcagcaagcaggaggaggcctcaggggggcccacagcccccaaagctgagagtggtcgaagcggaggtgggggactcatggaagagatgaacgccatgctggcccggagaaggaaagccacgcaagttggggagaaaacccccaaggatgaatctgccaatcaggaggagccagaggccagagtcccggcccagagtgaatctgtgcggagaccctgggagaagaacagcacaaccttgccaaggatgaagtcgtcttcttcggtgaccacttccgagacccaaccctgcacgcccagctccagtgattactcggacctacagagggtgaaacaggagcttctggaagaggtgaagaaggaattgcagaaagtgaaagaggaaatcattgaagccttcgtccaggagctgaggaagcggggttctccctgaccacagggacccagaagacccgcttctcctttccgcacacccggcctgtcaccctgctttccctgcctctacttgacttggaattggctgaagactacacaggaatgcatcgttcccactccccatcccacttggaggaaataagatgagggagaaaggaaaaggggaggaaacttctcccctcccaccttcacctttagcttcttgaaaatgggcccctgcagaataaatctgccagtttttataaatgctaa

SEQ ID NO: 313052 - DNA, 1440 bp, Homo sapiens
tatactcctaacatcaacaatacgtcagtcagagaccagggattaaatcgagcacgaggcctcaccttcccggggcgggcggggtggggtgagaggggttgggccctactcccccgacttccactcccgtgcgggtgggggtctcgcccccttagtaacctctccgaaattgacagaagagaaacgctggggaggggcggtgttccgaagatgggatttcagggagaaaatctgagaccacttgcttaacttgagggtcctcctcgacccccaaaattgagcggagtacgagatggagaagtcgatggggaaagaaatcgcgccccttccgagaccctcctcagaattcccacagtgggagcgaactaggaagcaagggaggtccccttccccttcaccaacttgcccctcaggtgggggtgattcccagggtgcacccctgggctacaacattggggagaggagcgagatcgcggaagccgagggtgcagagttgcccttttaagcgccctccaccccctcgcctggaggcgcacgcggcccctttaaggcgcggggcattgtgggtgcggggagtggaattttggaacgaaatgtaacgaagagaagtacagtagtaagagtaacactgtagccgccaccggcaaggggtgcgcgctggggagcggacgctgcatcccctttctgctgcaggaacctctcatcagaccgcctgagggaagcggcgcccggagacccgccccggcccggtccacattctccccaggaagccggactctatggggcgggaccctgggggagcctgagccgagcccggagccagccccgaacccctgaacctccagccaggggcgccccgggagcagccagcccgtgggcgagccgcccgcccgccgagcagccatgagcgagacggtcatctgttccagccgggccactgtgatgctttatgatgatggcaacaagcgatggctccctgctggcacgggtccccaggccttcagccgcgtccagatctaccacaaccccacggccaattcctttcgcgtcgtgggccggaagatgcagcccgaccagcaggtggtcatcaactgtgccatcgtccggggtgtcaagtataaccaggccacccccaacttccatcagtggcgcgacgctcgccaggtctggggcctcaacttcggcagcaaggaggatgcggcccagtttgccgccggcatggccagtgccctagaggcgttggaaggaggtgggccccctccacccccagcacttcccacctggtcggtcccgaacggcccctccccggaggaggtggagcagcagaaaaggcagcagcccggcccgtcggagcacatagagcgccgggtctccaatgcaggaggcccacctgctccccccgatgggggtccaggcgggggagcggggggggtggagggg

SEQ ID NO: 313053 - DNA, 2762 bp, Homo sapiens
tatactcctaacatcaacaatacgtcagtcagagaccagggattaaatcgagcacgaggcctcaccttcccggggcgggcggggtggggtgagaggggttgggccctactcccccgacttccactcccgtgcgggtgggggtctcgcccccttagtaacctctccgaaattgacagaagagaaacgctggggaggggcggtgttccgaagatgggatttcagggagaaaatctgagaccacttgcttaacttgagggtcctcctcgacccccaaaattgagcggagtacgagatggagaagtcgatggggaaagaaatcgcgccccttccgagaccctcctcagaattcccacagtgggagcgaactaggaagcaagggaggtccccttccccttcaccaacttgcccctcaggtgggggtgattcccagggtgcacccctgggctacaacattggggagaggagcgagatcgcggaagccgagggtgcagagttgcccttttaagcgccctccaccccctcgcctggaggcgcacgcggcccctttaaggcgcggggcattgtgggtgcggggagtggaattttggaacgaaatgtaacgaagagaagtacagtagtaagagtaacactgtagccgccaccggcaaggggtgcgcgctggggagcggacgctgcatcccctttctgctgcaggaacctctcatcagaccgcctgagggaagcggcgcccggagacccgccccggcccggtccacattctccccaggaagccggactctatggggcgggaccctgggggagcctgagccgagcccggagccagccccgaacccctgaacctccagccaggggcgccccgggagcagccagcccgtgggcgagccgcccgcccgccgagcagccatgagcgagacggtcatctgttccagccgggccactgtgatgctttatgatgatggcaacaagcgatggctccctgctggcacgggtccccaggccttcagccgcgtccagatctaccacaaccccacggccaattcctttcgcgtcgtgggccggaagatgcagcccgaccagcaggtggtcatcaactgtgccatcgtccggggtgtcaagtataaccaggccacccccaacttccatcagtggcgcgacgctcgccaggtctggggcctcaacttcggcagcaaggaggatgcggcccagtttgccgccggcatggccagtgccctagaggcgttggaaggaggtgggccccctccacccccagcacttcccacctggtcggtcccgaacggcccctccccggaggaggtggagcagcagaaaaggcagcagcccggcccgtcggagcacatagagcgccgggtctccaatgcaggaggcccacctgctccccccgctgggggtccacccccaccaccaggacctccccctcctccaggtccccccccacccccaggtttgcccccttcgggggtcccagctgcagcgcacggagcagggggaggaccaccccctgcaccccctctcccggcagcacagggccctggtggtgggggagctggggccccaggcctggccgcagctattgctggagccaaactcaggaaagtcagcaagcaggaggaggcctcaggggggcccacagcccccaaagctgagagtggtcgaagcggaggtgggggactcatggaagagatgaacgccatgctggcccggagaaggaaagccacgcaagttggggagaaaacccccaaggatgaatctgccaatcaggaggagccagaggccagagtcccggcccagagtggtgagtagagtgcccagtccagccacaggaactacaaatcccagaatactctgttctcacatgttaagcacccttataggagagtcagggcgaatggtgctggggattgtagtctcctgagatggggctttgatcaggggctgatgaggttgggggagtaagattgattggggggcagtcttttgtccctgatctttctgatttcttgcctatccccagaatctgtgcggagaccctgggagaagaacagcacaaccttgccaaggatgaagtcgtcttcttcggtgaccacttccgagacccaaccctgcacgcccagctccagtgattactcggacctacagagggtgaaacaggtaacttgggggggaagttggggaccacagcaagagagatctaggtctggcccctgccactggcatgccgtatgatcctagataacatctcagaaacctcaggtttccaatctgacaaatggagaaactggattgggtcaaggatgaccgagactccacacccccttttctggcacctgtgacagacattattaatctatcaccgcgctcattccagatgagtgccttgaattctttccgcacattgacccagctgtccatcaccaattggagttggcaggaggctggaatgcgcttgccaaccttggtactggatgttctccagtacttttccggctccaaggatccagaattctcccctagaatcctccagtcactctgcgaccttgacagcgatgtcatggtgtcgatgtaggggtaggtctcaaacctactacccctggcttttccatcaacaagaaagaggggactctggcagggcacggtggctcatgtgtgtaatttcagcacattgcgaggctgaggtgggagcattgcttgaggccaggagtttgagaccagcctggggcaacatcgggagacccccatctcta

SEQ ID NO: 313054 - DNA, 1484 bp, Homo sapiens
  misc_feature (1340)..(1340): n is a, c, g, or t
tatactcctaacatcaacaatacgtcagtcagagaccagggattaaatcgagcacgaggcctcaccttcccggggcgggcggggtggggtgagaggggttgggccctactcccccgacttccactcccgtgcgggtgggggtctcgcccccttagtaacctctccgaaattgacagaagagaaacgctggggaggggcggtgttccgaagatgggatttcagggagaaaatctgagaccacttgcttaacttgagggtcctcctcgacccccaaaattgagcggagtacgagatggagaagtcgatggggaaagaaatcgcgccccttccgagaccctcctcagaattcccacagtgggagcgaactaggaagcaagggaggtccccttccccttcaccaacttgcccctcaggtgggggtgattcccagggtgcacccctgggctacaacattggggagaggagcgagatcgcggaagccgagggtgcagagttgcccttttaagcgccctccaccccctcgcctggaggcgcacgcggcccctttaaggcgcggggcattgtgggtgcggggagtggaattttggaacgaaatgtaacgaagagaagtacagtagtaagagtaacactgtagccgccaccggcaaggggtgcgcgctggggagcggacgctgcatcccctttctgctgcaggaacctctcatcagaccgcctgagggaagcggcgcccggagacccgccccggcccggtccacattctccccaggaagccggactctatggggcgggaccctgggggagcctgagccgagcccggagccagccccgaacccctgaacctccagccaggggcgccccgggagcagccagcccgtgggcgagccgcccgcccgccgagcagccatgagcgagacggtcatctgttccagccgggccactgtgatgctttatgatgatggcaacaagcgatggctccctgctggcacgggtccccaggccttcagccgcgtccagatctaccacaaccccacggccaattcctttcgcgtcgtgggccggaagatgcagcccgaccagcaggtggtcatcaactgtgccatcgtccggggtgtcaagtataaccaggccacccccaacttccatcagtggcgcgacgctcgccaggtctggggcctcaacttcggcagcaaggaggatgcggcccagtttgccgccggcatggccagtgccctagaggcgttggaaggaggtgggccccctccacccccagcacttcccacctggtcggtcccgaacggcccctccccggaggaggtggagcagcagaaaagcagagccgnccgtgaacactagagcgcggtcttcatggacggaggccaacttgtcacgcgaggacagaccacaaaccacgtcaaccgacacagaacacgcaagaacatcaaccaacaaccgcgcacgacaacaacacaagcacacacttaaca

SEQ ID NO: 313055 - DNA, 2567 bp, Homo sapiens
atagcggctcgccgaggcgctggtgcacgggggcagcgcgcagcaggccggcgggcaggcgggcgggctggctggcaggcaggactgggatcgaggcccagaaaacggagcagcgggcaccagggaggcctggaacggggcgagcgccatgagcaacaaatgcgacgtggtcgtggtggggggcggcatctcaggtatggcagcagccaaacttctgcatgactctggactgaatgtggttgttctggaagcccgggaccgtgtgggaggcaggacttacactcttaggaaccaaaaggttaaatatgtggaccttggaggatcctatgttggaccaacccagaatcgtatcttgagattagccaaggagctaggattggagacctacaaagtgaatgaggttgagcgtctgatccaccatgtaaagggcaaatcataccccttcagggggccattcccacctgtatggaatccaattacctacttagatcataacaacttttggaggacaatggatgacatggggcgagagattccgagtgatgccccatggaaggctccccttgcagaagagtgggacaacatgacaatgaaggagctactggacaagctctgctggactgaatctgcaaagcagcttgccactctctttgtgaacctgtgtgtcactgcagagacccatgaggtctctgctctctggttcctgtggtatgtgaagcagtgtggaggcacaacaagaatcatctcgacaacaaatggaggacaggagaggaaatttgtgggcggatctggtcaagtgagtgagcggataatggacctccttggagaccgagtgaagctggagaggcctgtgatctacattgaccagacaagagaaaatgtccttgtggagaccctaaaccatgagatgtatgaggctaaatatgtgattagtgctattcctcctactctgggcatgaagattcacttcaatccccctctgccaatgatgagaaaccagatgatcactcgtgtgcctttgggttcagtcatcaagtgtatagtttattataaagagcctttctggaggaaaaaggattactgtggaaccatgattattgatggagaagaagctccagttgcctacacgttggatgataccaaacctgaaggcaactatgctgccataatgggatttatcctggcccacaaagccagaaaactggcacgtcttaccaaagaggaaaggttgaagaaactttgtgaactctatgccaaggttctgggttccctagaagctctggagccagtgcattatgaagaaaagaactggtgtgaggagcagtactctgggggctgctacacaacttatttcccccctgggatcctgactcaatatggaagggttctacgccagccagtggacaggatttactttgcaggcaccgagactgccacacactggagcggctacatggagggggctgtagaggccggggagagagcagcccgagagatcctgcatgccatggggaagattccagaggatgaaatctggcagtcagaaccagagtctgtggatgtccctgcacagcccatcaccaccacctttttggagagacatttgccctccgtgccaggcctgctcaggctgattggattgaccaccatcttttcagcaacggctcttggcttcctggcccacaaaagggggctacttgtgagagtctaaagagagagggtgtctgtaatcacactctcttcttactgtatttgggatatgagtttggggaaagagttgcagtaaagttccatgaagacaaatagtgtggagtgaggcggggagcatgaagataaatccaactctgactgtaaaatacatggtatctctttctccgttgtggcccctgcttagtgtcccttacctggcttagcgttctgtttcaccagtttccaagtttattgccctcaaaatctttagaatagttaaattggcttgtttaaggttcttgctgccccacaacacaccttgcccatgcacaaggaatgaattttttcctaccattatggctttgtgcttgttcttcctcttacctgtaatagcctcaccttccctagttctttgcattcgtccttagaatactgtattgttacagctgaaagacagtaaagaccatttagtcctcaccttctgttttagagttgagcaaactgaagcccacagaggtggaacttaattacctaagagccacaataagccactggtatctgggggactagaacacaaatccaacgcttttcccacctctttggatgttttccccaattatcctccttcactccctgtcatagttaccgatggtgtcccgttgtgtgggtttactctgtgctaagttgtcttacacttctcaaatgctactcagtatatagccttaagtcttactgttttgtgcggtgtgtctccagctgattttaacttttttgatggtagaaattttatctcttcttccttttgtatcctccattgtatcttcatacaaaggacagtacacacttgggtaattaaaaataaaagttgattgaccata

SEQ ID NO: 313056 - DNA, 652 bp, Homo sapiens
agtgtccctacctgggtaacggtcggcacaagttccaaagttattggctcaaaatcttagaataggttaaattgctgaaggtccttctgccccccaaacaccttgggcatgccaaaagaataattccccccacaaaggggtgtgggggttgtccctcctacccggaaaaaccccccctttcaatgttttgcaattggcccttaatactgtattgttacagctgaaagacagtaaagaccatttagtcctcaccttctgttttagagttgagcaaactgaagcccacagaggtggaacttaattacctaagagccacaataagccactggtatctgggggactagaacacaaatccaacgcttttcccacctctttggatgttttccccaattatcctccttcactccctgtcatagttaccgatggtgtcccgttgtgtgggtttactctgtgctaagttgtcttacacttctcaaatgctactcagtatatagccttaagtcttactgttttgtgcggtgtgtctccagctgattttaacttttttgatggtagaaattttatctcttcttccttttgtatcctccattgtatcttcatacaaaggacagtacacacttgggtaattaaaaataaaagttgattgaccata

SEQ ID NO: 313057 - DNA, 469 bp, Homo sapiens
atagcggctcgccgaggcgctggtgcacgggggcagcgcgcagcaggccggcgggcaggcgggcgggctggctggcaggcaggactgggatcgaggcccagaaaacggagcagcgggcaccagggaggcctggaacggggcgagcgccatgagcaacaaatgcgacgtggtcgtggtggggggcggcatctcagggccccagccgattggattggatggtgcccactacattgagagccggttttcctctcccagtctgccaactcccatgccagtttcttctggaaacaccctcacagggacacccagaaacaatgcttcacctgccatctagaaacatcagactctgggcctctattgacaaaccgtatccacttgtaagttgaatgtaacaataggcggtgcacgtgagccagcatggacttttctcattggctgttagcatgaggagcttgtctggcatccttgt

SEQ ID NO: 313058 - DNA, 3162 bp, Homo sapiens
atagcggctcgccgaggcgctggtgcacgggggcagcgcgcagcaggccggcgggcaggcgggcgggctggctggcaggcaggactgggatcgaggcccagaaaacggagcagcgggcaccagggaggcctggaacggggcgagcgccatgagcaacaaatgcgacgtggtcgtggtggggggcggcatctcaggtatggcagcagccaaacttctgcatgactctggactgaatgtggttgttctggaagcccgggaccgtgtgggaggcaggacttacactcttaggaaccaaaaggttaaatatgtggaccttggaggatcctatgttggaccaacccagaatcgtatcttgagattagccaaggagctaggattggagacctacaaagtgaatgaggttgagcgtctgatccaccatgtaaagggcaaatcataccccttcagggggccattcccacctgtatggaatccaattacctacttagatcataacaacttttggaggacaatggatgacatggggcgagagattccgagtgatgccccatggaaggctccccttgcagaagagtgggacaacatgacaatgaaggagctactggacaagctctgctggactgaatctgcaaagcagcttgccactctctttgtgaacctgtgtgtcactgcagagacccatgaggtctctgctctctggttcctgtggtatgtgaagcagtgtggaggcacaacaagaatcatctcgacaacaaatggaggacaggagaggaaatttgtgggcggatctggtcaagtgagtgagcggataatggacctccttggagaccgagtgaagctggagaggcctgtgatctacattgaccagacaagagaaaatgtccttgtggagaccctaaaccatgagatgtatgaggctaaatatgtgattagtgctattcctcctactctgggcatgaagattcacttcaatccccctctgccaatgatgagaaaccagatgatcactcgtgtgcctttgggttcagtcatcaagtgtatagtttattataaagagcctttctggaggaaaaaggattactgtggaaccatgattattgatggagaagaagctccagttgcctacacgttggatgataccaaacctgaaggcaactatgctgccataatgggatttatcctggcccacaaagccagaaaactggcacgtcttaccaaagaggaaaggttgaagaaactttgtgaactctatgccaaggttctgggttccctagaagctctggagccagtgcattatgaagaaaagaactggtgtgaggagcagtactctgggggctgctacacaacttatttcccccctgggatcctgactcaatatggaagggttctacgccagccagtggacaggatttactttgcaggcaccgagactgccacacactggagcggctacatggagggggctgtagaggccggggagagagcagcccgagagatcctgcatgccatggggaagattccagaggatgaaatctggcagtcagaaccagagtctgtggatgtccctgcacagcccatcaccaccacctttttggagagacatttgccctccgtgccaggcctgctcaggctgattggattgaccaccatcttttcagcaacggctcttggcttcctggcccacaaaagggggctacttgtgagagtctaaagagagagggtgtctgtaatcacactctcttcttactgtatttgggatatgagtttggggaaagagttgcagtaaagttccatgaagacaaatagtgtggagtgaggcggggagcatgaagataaatccaactctgactgtaaaatacatggtatctctttctccgttgtggcccctgcttagtgtcccttacctggcttagcgttctgtttcaccagtttccaagtttattgccctcaaaatctttagaatagttaaattggcttgtttaaggttcttgctgccccacaacacaccttgcccatgcacaaggaatgaattttttcctaccattatggctttgtgcttgttcttcctcttacctgtaatagcctcaccttccctagttctttgcattcgtccttagaatactgtattgttacagctgaaagacagtaaagaccatttagtcctcaccttctgttttagagttgagcaaactgaagcccacagaggtggaacttaattacctaagagccacaataagccactggtatctgggggactagaacacaaatccaacgcttttcccacctctttggatgttttccccaattatcctccttcactccctgtcatagttaccgatggtgtcccgttgtgtgggtttactctgtgctaagttgtcttacacttctcaaatgctactcagtatatagccttaagtcttactgttttgtgcggtgtgtctccagctgattttaacttttttgatggtagaaattttatctcttcttccttttgtatcctccattgtatcttcatacaaaggacagtacacacttgggtaattaaaaataaaagttgattgaccataaaaaaaaaaaaaaaaaaaaaaaaaaaaaaaaaaaaaaaaaaaaaaaaaaaaaaaaaaaaaaaaaaaaagggggggggcggcgagacgacaaagacctcccacgaggggagggggagcaccagaagataggaagccgccacaccgtcgttattagataccacaaggagggcgacgacaaaagaaggaggagagatacatataacaagagcaagcgcgagcagggcggcgaagagaaaacaaaaagccatcagagagagaaaacaacacgtgacaccaaaaggagaaataaagcgaaggagggacgaaacaacaacacaggggagggaggagaaagcacacacaaaatacaggagggagaaacacacaacagcagacaaaaaagaagcataaaataccgcacccacacgaggggggaacaaaaactaacaacacaaagagcagaagaagagtgaacaactgggagacgacaacaaacacacacacgacgagacgtcaatcgaaagaaggacggacgagaaagaaagagaaaagtacatagctgccgaaagcgaagaaagaaatcagtacacaaaagaaaaaaacttataccaaccgg

SEQ ID NO: 313059 - DNA, 2757 bp, Homo sapiens
atagcggctcgccgaggcgctggtgcacgggggcagcgcgcagcaggccggcgggcaggcgggcgggctggctggcaggcaggactgggatcgaggcccagaaaacggagcagcgggcaccagggaggcctggaacggggcgagcgccatgagcaacaaatgcgacgtggtcgtggtggggggcggcatctcagggccccagccgattggattggatggtgcccactacattgagagccggttttcctctcccagtctgccaactcccatgccagtttcttctggaaacaccctcacagggacacccagaaacaatgcttcacctgccatctaggtatcccaccatccagtcaagttgacacctaaaattaaccatcacaatgggtatggcagcagccaaacttctgcatgactctggactgaatgtggttgttctggaagcccgggaccgtgtgggaggcaggacttacactcttaggaaccaaaaggttaaatatgtggaccttggaggatcctatgttggaccaacccagaatcgtatcttgagattagccaaggagctaggattggagacctacaaagtgaatgaggttgagcgtctgatccaccatgtaaagggcaaatcataccccttcagggggccattcccacctgtatggaatccaattacctacttagatcataacaacttttggaggacaatggatgacatggggcgagagattccgagtgatgccccatggaaggctccccttgcagaagagtgggacaacatgacaatgaaggagctactggacaagctctgctggactgaatctgcaaagcagcttgccactctctttgtgaacctgtgtgtcactgcagagacccatgaggtctctgctctctggttcctgtggtatgtgaagcagtgtggaggcacaacaagaatcatctcgacaacaaatggaggacaggagaggaaatttgtgggcggatctggtcaagtgagtgagcggataatggacctccttggagaccgagtgaagctggagaggcctgtgatctacattgaccagacaagagaaaatgtccttgtggagaccctaaaccatgagatgtatgaggctaaatatgtgattagtgctattcctcctactctgggcatgaagattcacttcaatccccctctgccaatgatgagaaaccagatgatcactcgtgtgcctttgggttcagtcatcaagtgtatagtttattataaagagcctttctggaggaaaaaggattactgtggaaccatgattattgatggagaagaagctccagttgcctacacgttggatgataccaaacctgaaggcaactatgctgccataatgggatttatcctggcccacaaagccagaaaactggcacgtcttaccaaagaggaaaggttgaagaaactttgtgaactctatgccaaggttctgggttccctagaagctctggagccagtgcattatgaagaaaagaactggtgtgaggagcagtactctgggggctgctacacaacttatttcccccctgggatcctgactcaatatggaagggttctacgccagccagtggacaggatttactttgcaggcaccgagactgccacacactggagcggctacatggagggggctgtagaggccggggagagagcagcccgagagatcctgcatgccatggggaagattccagaggatgaaatctggcagtcagaaccagagtctgtggatgtccctgcacagcccatcaccaccacctttttggagagacatttgccctccgtgccaggcctgctcaggctgattggattgaccaccatcttttcagcaacggctcttggcttcctggcccacaaaagggggctacttgtgagagtctaaagagagagggtgtctgtaatcacactctcttcttactgtatttgggatatgagtttggggaaagagttgcagtaaagttccatgaagacaaatagtgtggagtgaggcggggagcatgaagataaatccaactctgactgtaaaatacatggtatctctttctccgttgtggcccctgcttagtgtcccttacctggcttagcgttctgtttcaccagtttccaagtttattgccctcaaaatctttagaatagttaaattggcttgtttaaggttcttgctgccccacaacacaccttgcccatgcacaaggaatgaattttttcctaccattatggctttgtgcttgttcttcctcttacctgtaatagcctcaccttccctagttctttgcattcgtccttagaatactgtattgttacagctgaaagacagtaaagaccatttagtcctcaccttctgttttagagttgagcaaactgaagcccacagaggtggaacttaattacctaagagccacaataagccactggtatctgggggactagaacacaaatccaacgcttttcccacctctttggatgttttccccaattatcctccttcactccctgtcatagttaccgatggtgtcccgttgtgtgggtttactctgtgctaagttgtcttacacttctcaaatgctactcagtatatagccttaagtcttactgttttgtgcggtgtgtctccagctgattttaacttttttgatggtagaaattttatctcttcttccttttgtatcctccattgtatcttcatacaaaggacagtacacacttgggtaattaaaaataaaagttgattgaccata

SEQ ID NO: 313060 - DNA, 2096 bp, Homo sapiens
atagcggctcgccgaggcgctggtgcacgggggcagcgcgcagcaggccggcgggcaggcgggcgggctggctggcaggcaggactgggatcgaggcccagaaaacggagcagcgggcaccagggaggcctggaacggggcgagcgccatgagcaacaaatgcgacgtggtcgtggtggggggcggcatctcaggtatggcagcagccaaacttctgcatgactctggactgaatgtggttgttctggaagcccgggaccgtgtgggaggcaggacttacactcttaggaaccaaaaggttaaatatgtggaccttggaggatcctatgttggaccaacccagaatcgtatcttgagattagccaaggagctaggattggagacctacaaagtgaatgaggttgagcgtctgatccaccatgtaaagggcaaatcataccccttcagggggccattcccacctgtatggaatccaattacctacttagatcataacaacttttggaggacaatggatgacatggggcgagagattccgagtgatgccccatggaaggctccccttgcagaagagtgggacaacatgacaatgaaggagctactggacaagctctgctggactgaatctgcaaagcagcttgccactctctttgtgaacctgtgtgtcactgcagagacccatgaggtctctgctctctggttcctgtggtatgtgaagcagtgtggaggcacaacaagaatcatctcgacaacaaatggaggacaggagaggaaatttgtgggcggatctggtcaagtgagtgagcggataatggacctccttggagaccgagtgaagctggagaggcctgtgatctacattgaccagacaagagaaaatgtccttgtggagaccctaaaccatgagatgtatgaggctaaatatgtgattagtgctattcctcctactctgggcatgaagattcacttcaatccccctctgccaatgatgagaaaccagatgatcactcgtgtgcctttgggttcagtcatcaagtgtatagtttattataaagagcctttctggaggaaaaaggattactgtggaaccatgattattgatggagaagaagctccagttgcctacacgttggatgataccaaacctgaaggcaactatgctgccataatgggatttatcctggcccacaaagccagaaaactggcacgtcttaccaaagaggaaaggttgaagaaactttgtgaactctatgccaaggttctgggttccctagaagctctggagccagtgcattatgaagaaaagaactggtgtgaggagcagtactctgggggctgctacacaacttatttcccccctgggatcctgactcaatatggaagggttctacgccagccagtggacaggatttactttgcaggcaccgagactgccacacactggagcggctacatggagggggctgtagaggccggggagagagcagcccgagagatcctgcatgccatggggaagattccagaggatgaaatctggcagtcagaaccagagtctgtggatgtccctgcacagcccatcaccaccacctttttggagagacatttgccctccgtgccaggcctgctcaggctgattggattgaccaccatcttttcagcaacggctcttggcttcctggcccacaaaagggggctacttgtgagagtctaaagagagagggtgtctgtaatcacactctcttcttactgtatttgggatatgagtttggggaaagagttgcagtaaagttccatgaagacaaatagtgtggagtgaggcggggagcatgaagataaatccaactctgactgtaaaatacatggtatctctttctccgttgtgtgggtttactctgtgctaagttgtcttacacttctcaaatgctactcagtatatagccttaagtcttactgttttgtgcggtgtgtctccagctgattttaacttttttgatggtagaaattttatctcttcttccttttgtatcctccattgtatcttcatacaaaggacagtacacacttgggtaattaaaaataaaagttgattgaccata

SEQ ID NO: 313061 - DNA, 1001 bp, Homo sapiens
atagcggctcgccgaggcgctggtgcacgggggcagcgcgcagcaggccggcgggcaggcgggcgggctggctggcaggcaggactgggatcgaggcccagaaaacggagcagcgggcaccagggaggcctggaacggggcgagcgccatgagcaacaaatgcgacgtggtcgtggtggggggcggcatctcaggtatggcagcagccaaacttctgcatgactctggactgaatgtggttgttctggaagcccgggaccgtgtgggaggcaggacttacactcttaggaaccaaaaggttaaatatgtggaccttggaggatcctatgttggaccaacccagaatcgtatcttgagattagccaaggagctaggattggagacctacaaagtgaatgaggttgagcgtctgatccaccatgtaaagggcaaatcataccccttcagggggccattcccacctgtatggaatccaattacctacttagatcataacaacttttggaggacaatggatgacatggggcgagagattccgagtgatgccccatggaaggctccccttgcagaagagtgggacaacatgacaatgaaggagctactggacaagctctgctggactgaatctgcaaagcagcttgccactctctttgtgaacctgtgtgtcactgcagagacccatgaggtctctgctctctggttcctgtggtatgtgaagcagtgtggaggcacaacaagaatcatctccttcactccctgtcatagttaccgatggtgtcccgttgtgtgggtttactctgtgctaagttgtcttacacttctcaaatgctactcagtatatagccttaagtcttactgttttgtgcggtgtgtctccagctgattttaacttttttgatggtagaaattttatctcttcttccttttgtatcctccattgtatcttcatacaaaggacagtacacacttgggtaattaaaaataaaagttgattgaccata

SEQ ID NO: 313062 - DNA, 2513 bp, Homo sapiens
atagcggctcgccgaggcgctggtgcacgggggcagcgcgcagcaggccggcgggcaggcgggcgggctggctggcaggcaggactgggatcgaggcccagaaaacggagcagcgggcaccagggaggcctggaacggggcgagcgccatgagcaacaaatgcgacgtggtcgtggtggggggcggcatctcaggtatggcagcagccaaacttctgcatgactctggactgaatgtggttgttctggaagcccgggaccgtgtgggaggcaggacttacactcttaggaaccaaaaggttaaatatgtggaccttggaggatcctatgttggaccaacccagaatcgtatcttgagattagccaaggagctaggattggagacctacaaagtgaatgaggttgagcgtctgatccaccatgtaaagggcaaatcataccccttcagggggccattcccacctgtatggaatccaattacctacttagatcataacaacttttggaggacaatggatgacatggggcgagagattccgagtgatgccccatggaaggctccccttgcagaagagtgggacaacatgacaatgaaggagctactggacaagctctgctggactgaatctgcaaagcagcttgccactctctttgtgaacctgtgtgtcactgcagagacccatgaggtctctgctctctggttcctgtggtatgtgaagcagtgtggaggcacaacaagaatcatctcgacaacaaatggaggacaggagaggaaatttgtgggcggatctggtcaagtgagtgagcggataatggacctccttggagaccgagtgaagctggagaggcctgtgatctacattgaccagacaagagaaaatgtccttgtggagaccctaaaccatgagatgtatgaggctaaatatgtgattagtgctattcctcctactctgggcatgaagattcacttcaatccccctctgccaatgatgagaaaccagatgatcactcgtgtgcctttgggttcagtcatcaagtgtatagtttattataaagagcctttctggaggaaaaaggattactgtggaaccatgattattgatggagaagaagctccagttgcctacacgttggatgataccaaacctgaaggcaactatgctgccataatgggatttatcctggcccacaaagccagaaaactggcacgtcttaccaaagaggaaaggttgaagaaactttgtgaactctatgccaaggttctgggttccctagaagctctggagccagtgcattatgaagcccctgggatcctgactcaatatggaagggttctacgccagccagtggacaggatttactttgcaggcaccgagactgccacacactggagcggctacatggagggggctgtagaggccggggagagagcagcccgagagatcctgcatgccatggggaagattccagaggatgaaatctggcagtcagaaccagagtctgtggatgtccctgcacagcccatcaccaccacctttttggagagacatttgccctccgtgccaggcctgctcaggctgattggattgaccaccatcttttcagcaacggctcttggcttcctggcccacaaaagggggctacttgtgagagtctaaagagagagggtgtctgtaatcacactctcttcttactgtatttgggatatgagtttggggaaagagttgcagtaaagttccatgaagacaaatagtgtggagtgaggcggggagcatgaagataaatccaactctgactgtaaaatacatggtatctctttctccgttgtggcccctgcttagtgtcccttacctggcttagcgttctgtttcaccagtttccaagtttattgccctcaaaatctttagaatagttaaattggcttgtttaaggttcttgctgccccacaacacaccttgcccatgcacaaggaatgaattttttcctaccattatggctttgtgcttgttcttcctcttacctgtaatagcctcaccttccctagttctttgcattcgtccttagaatactgtattgttacagctgaaagacagtaaagaccatttagtcctcaccttctgttttagagttgagcaaactgaagcccacagaggtggaacttaattacctaagagccacaataagccactggtatctgggggactagaacacaaatccaacgcttttcccacctctttggatgttttccccaattatcctccttcactccctgtcatagttaccgatggtgtcccgttgtgtgggtttactctgtgctaagttgtcttacacttctcaaatgctactcagtatatagccttaagtcttactgttttgtgcggtgtgtctccagctgattttaacttttttgatggtagaaattttatctcttcttccttttgtatcctccattgtatcttcatacaaaggacagtacacacttgggtaattaaaaataaaagttgattgaccata

SEQ ID NO: 313063 - DNA, 2429 bp, Homo sapiens
atagcggctcgccgaggcgctggtgcacgggggcagcgcgcagcaggccggcgggcaggcgggcgggctggctggcaggcaggactgggatcgaggcccagaaaacggagcagcgggcaccagggaggcctggaacggggcgagcgccatgagcaacaaatgcgacgtggtcgtggtggggggcggcatctcaggtatggcagcagccaaacttctgcatgactctggactgaatgtggttgttctggaagcccgggaccgtgtgggaggcaggacttacactcttaggggcaaatcataccccttcagggggccattcccacctgtatggaatccaattacctacttagatcataacaacttttggaggacaatggatgacatggggcgagagattccgagtgatgccccatggaaggctccccttgcagaagagtgggacaacatgacaatgaaggagctactggacaagctctgctggactgaatctgcaaagcagcttgccactctctttgtgaacctgtgtgtcactgcagagacccatgaggtctctgctctctggttcctgtggtatgtgaagcagtgtggaggcacaacaagaatcatctcgacaacaaatggaggacaggagaggaaatttgtgggcggatctggtcaagtgagtgagcggataatggacctccttggagaccgagtgaagctggagaggcctgtgatctacattgaccagacaagagaaaatgtccttgtggagaccctaaaccatgagatgtatgaggctaaatatgtgattagtgctattcctcctactctgggcatgaagattcacttcaatccccctctgccaatgatgagaaaccagatgatcactcgtgtgcctttgggttcagtcatcaagtgtatagtttattataaagagcctttctggaggaaaaaggattactgtggaaccatgattattgatggagaagaagctccagttgcctacacgttggatgataccaaacctgaaggcaactatgctgccataatgggatttatcctggcccacaaagccagaaaactggcacgtcttaccaaagaggaaaggttgaagaaactttgtgaactctatgccaaggttctgggttccctagaagctctggagccagtgcattatgaagaaaagaactggtgtgaggagcagtactctgggggctgctacacaacttatttcccccctgggatcctgactcaatatggaagggttctacgccagccagtggacaggatttactttgcaggcaccgagactgccacacactggagcggctacatggagggggctgtagaggccggggagagagcagcccgagagatcctgcatgccatggggaagattccagaggatgaaatctggcagtcagaaccagagtctgtggatgtccctgcacagcccatcaccaccacctttttggagagacatttgccctccgtgccaggcctgctcaggctgattggattgaccaccatcttttcagcaacggctcttggcttcctggcccacaaaagggggctacttgtgagagtctaaagagagagggtgtctgtaatcacactctcttcttactgtatttgggatatgagtttggggaaagagttgcagtaaagttccatgaagacaaatagtgtggagtgaggcggggagcatgaagataaatccaactctgactgtaaaatacatggtatctctttctccgttgtggcccctgcttagtgtcccttacctggcttagcgttctgtttcaccagtttccaagtttattgccctcaaaatctttagaatagttaaattggcttgtttaaggttcttgctgccccacaacacaccttgcccatgcacaaggaatgaattttttcctaccattatggctttgtgcttgttcttcctcttacctgtaatagcctcaccttccctagttctttgcattcgtccttagaatactgtattgttacagctgaaagacagtaaagaccatttagtcctcaccttctgttttagagttgagcaaactgaagcccacagaggtggaacttaattacctaagagccacaataagccactggtatctgggggactagaacacaaatccaacgcttttcccacctctttggatgttttccccaattatcctccttcactccctgtcatagttaccgatggtgtcccgttgtgtgggtttactctgtgctaagttgtcttacacttctcaaatgctactcagtatatagccttaagtcttactgttttgtgcggtgtgtctccagctgattttaacttttttgatggtagaaattttatctcttcttccttttgtatcctccattgtatcttcatacaaaggacagtacacacttgggtaattaaaaataaaagttgattgaccata

SEQ ID NO: 313064 - DNA, 2037 bp, Homo sapiens
atagcggctcgccgaggcgctggtgcacgggggcagcgcgcagcaggccggcgggcaggcgggcgggctggctggcaggcaggactgggatcgaggcccagaaaacggagcagcgggcaccagggaggcctggaacggggcgagcgccatgagcaacaaatgcgacgtggtcgtggtggggggcggcatctcaggtatggcagcagccaaacttctgcatgactctggactgaatgtggttgttctggaagcccgggaccgtgtgggaggcaggacttacactcttaggaaccaaaaggttaaatatgtggaccttggaggatcctatgttggaccaacccagaatcgtatcttgagattagccaaggagctaggattggagacctacaaagtgaatgaggttgagcgtctgatccaccatgtaaagggcaaatcataccccttcagggggccattcccacctgtatggaatccaattacctacttagatcataacaacttttggaggacaatggatgacatggggcgagagattccgagtgatgccccatggaaggctccccttgcagaagagtgggacaacatgacaatgaaggagctactggacaagctctgctggactgaatctgcaaagcagcttgccactctctttgtgaacctgtgtgtcactgcagagacccatgaggtctctgctctctggttcctgtggtatgtgaagcagtgtggaggcacaacaagaatcatctcgacaacaaatggaggacaggagaggaaatttgtgggcggatctggtcaagtgagtgagcggataatggacctccttggagaccgagtgaagctggagaggcctgtgatctacattgaccagacaagagaaaatgtccttgtggagaccctaaaccatgagatgtatgaggctaaatatgtgattagtgctattcctcctactctgggcatgaagattcacttcaatccccctctgccaatgatgagaaaccagatgatcactcgtgtgcctttgggttcagtcatcaagtgtatagtttattataaagagcctttctggaggaaaaaggattactgtggaaccatgattattgatggagaagaagctccagttgcctacacgttggatgataccaaacctgaaggcaactatgctgccataatgggatttatcctggcccacaaagccagaaaactggcacgtcttaccaaagaggaaaggttgaagaaactttgtgaactctatgccaaggttctgggttccctagaagctctggagccagtgcattatgaagaaaagaactggtgtgaggagcagtactctgggggctgctacacaacttatttcccccctgggatcctgactcaatatggaagggttctacgccagccagtggacaggatttactttgcaggcaccgagactgccacacactggagcggctacatggagggggctgtagaggccggggagagagcagcccgagagatcctgcatgccatggggaagattccagaggatgaaatctggcagtcagaaccagagtctgtggatgtccctgcacagcccatcaccaccacctttttggagagacatttgccctccgtgccaggcctgctcaggctgattggattgaccaccatcttttcagcaacggctcttggcttcctggcccacaaaagggggctacttgtgagagtctccgtcgaactagttcgacggagactctccccagggggcctagctctggatcttgtatagaccaattaaccatcaaaatggactatggggaagaactaaggagccctattacaagcctgacccctggggagagcaaaaccacctctccatcatctccagaggaggatgtcatgctaggatccctcaccttctcagtggactataacttcccgaaaaaagccctggtggtgacaatccaggaggcccacgggctgtcagtgatggatgccagacccaggtatctgaccctaaatcaaatgacatccttctgacaacggatcgggtgagac

SEQ ID NO: 313065 - DNA, 3252 bp, Homo sapiens
cggtggtagcggcggcggctgctgaggaggaggagggggagcggagggaggtgtttctgtcagttccggctgtttgttcgggaagtggatccgccgctgccggagcagcccgaagggagctgcggatcgcgaggccagtaccgaccccgcccgcccgcgcgcaccgcccccgcccgccatggcccgggactacgaccacctcttcaagctgctcatcatcggcgacagcggtgtgggcaagagcagtttactgttgcgttttgcagacaacactttctcaggcagctacatcaccacgatcggagtggatttcaagatccggaccgtggagatcaacggggagaaggtgaagctgcagatctgggacacagcggggcaggagcgcttccgcaccatcacctccacgtattatcgggggacccacggggtcattgtggtttacgacgtcaccagtgccgagtcctttgtcaacgtcaagcggtggcttcacgaaatcaaccagaactgtgatgatgtgtgccgaatattagtgggtaataagaatgacgaccctgagcggaaggtggtggagacggaagatgcctacaaattcgccgggcagatgggcatccagttgttcgagaccagcgccaaggagaatgtcaacgtggaagagatgttcaactgcatcacggagctggtcctccgagcaaagaaagacaacctggcaaaacagcagcagcaacaacagaacgatgtggtgaagctcacgaagaacagtaaacgaaagaaacgctgctgctaatggcacccagtccactgcagagactgcactgcggtccctcccccagcccgaggcccacggaggttcctcgggggacagtctcagtttcgtgccgttatttaaagaattctctccatgtttttgtatcgggaggtgccatcggcacttcctcccccgccctcctcgagtgccaagaaggtgttggaccagcccgcccttccctactggtgccccctcctccccggccaaggcgcctggacctggcgaggacgctgcccgccgagcggactgattcgcagagtctgtacatagtgtatattgctctacccggccgcacaccacgtcctgctctggcttttgccttcttgatgccagcctgctgcaacagaccctccccgcgcccctccccagcccatcttactgcaagcagcgtcctgaggagacagcggcacgttctagctgcgtctgcggccagcccgtgccagtggagtgggctccgcgttgctcattctctccgacaggttgtcagcctctgtccccgctgcacagggtcttgccccttctccggggcctgtgccagctcccttccctccccgttgtcctgtccccacagccattctgggagctggggaacctggtctcaaggcaggccctgcagttccacagaggtggcaggtcttgccctttggccaacagatttcttgtcctgccttctagatgcctctgagctccaaacccagggcagccatggcttctcatttacaccaacaggtttcagttccaacagaaaggtcggggtaggttcgtgcagagatggggctggcaggggggctatgggaggattattttaacagatcaagaaaatgaagccaaatcaagtgaattaaattcctcacaattattttctttccctgaggtttgattggcacagcagcaaaagttgaggccaccccacttgtgtccactgtttttagaaaaaaatgaatggcttcctgccattgtggggctggactcttgggctttcttggtgggagcggagaaggggcctcccacccttgtccgagttgcctcccactggaggtcaggagtctacactgcagcctcgggcactgtggggagtgcatgcctggggcctctgggtggggaccatggacaggccctggtcactgtcctaacctttgtcaggacaaaggtagcaagaggatttcctggcgggtgggaaggaatggctggggcggccagttttgacacgccccagtgccctggagaacaaccagggtcatctgcacttgatgactgctccccgacccccagcccggacacctcattcccctcccactacagggatcaagtgacctgggaagaaccgagtttaacaccaggatgtgtttccttagatttcctttcctaggcgatttccagggagagccctgattggacaatcacatcacagatcacactgcagtttccatgttagcactgtggatgggtttttaatcaataaaaactgggggtttcttctcaccgactctccacttgcccaaactgccaaaagctggtgattctgggacaggccttcactttggagccacgggatggggtgggggagccccatgggcctgggaaggagggtgctgtggagggggctgcagggctgaccagcaggcagcctcatctggtcgggggcgggggcggcaggagcagaagcggggtctccgtccttgggactgtcctggttggccacgggccctgaggatgcacggtgcctggggctcctgtgccggtgggcggggggcatgctggcctctgagcgatcaggcgaggccagcgagggtgtgcttgcaaattcaagcaataagaggggggttcctgggggcttccagcccaggctagaagcccccatggcttctggcagctggacatcagccccaggtattggggtgattttggtcatgacagtgtgcctgtcccactgttacacgcatgaatgggggttatggggtgggggtggggactcagggctggaccgacgtcctagtggacctgatgtgaaattcctgtcaaacaaacaccacttttcaatggtttgctaggagtatttctgtattgaaagtttctaattatgctttttaaaaaaatactaaaaataaaggttcaagctgccaaaaaaagatagaatgaagaaaaaaaagaaagggggggggcgcggctagagagatacacacagcagagggcgccaaaaaatcgacgcgcacagaaggttttgggacaagggggggcccccaaaagggaggacggacaatatacacagtaggacgggcgccgggcgttaaaagacggtcggagcggggaacaccggcagcgggcgactgtgggagagacccttactctgtgggtggcacacattgtggacacacccacgagaattcagccagggacaaagactacggtgatggcaacccgcaatctgtgcagaatggagggcatag

SEQ ID NO: 313066 - DNA, 2725 bp, Homo sapiens
cggtggtagcggcggcggctgctgaggaggaggagggggagcggagggaggtgtttctgtcagttccggctgtttgttcgggaagtggatccgccgctgccggagcagcccgaagggagctgcggatcgcgaggccagtaccgaccccgcccgcccgcgcgcaccgcccccgcccgccatggcccgggactacgaccacctcttcaagctgctcatcatcggcgacagcggtgtgggcaagagcagtttactgttgcgttttgcagacaacactttctcaggcagctacatcaccacgatcggagtggatttcaagatccggaccgtggagatcaacggggagaaggtgaagctgcagatctgggacacagcggggcaggagcgcttccgcaccatcacctccacgtattatcgggggacccacggggtcattgtggtttacgacgtcaccagtgccgagtcctttgtcaacgtcaagcggtggcttcacgaaatcaaccagaactgtgatgatgtgtgccgaatattagtgggtaataagaatgacgaccctgagcggaaggtggtggagacggaagatgcctacaaattcgccgggcagatgggcatccagttgttcgagaccagcgccaaggagaatgtcaacgtggaagagatgttcaactgcatcacggagctggtcctccgagcaaagaaagacaacctggcaaaacagcagcagcaacaacagaacgatgtggtgaagctcacgaagaacagtaaacgaaagaaacgctgctgctaatggcacccagtccactgcagagactgcactgcggtccctcccccagcccgaggcccacggaggttcctcgggggacagtctcagtttcgtgccgttatttaaagaattctctccatgtttttgtatcgggaggtgccatcggcacttcctcccccgccctcctcgagtgccaagaaggtgttggaccagcccgcccttccctactggtgccccctcctccccggccaaggcgcctggacctggcgaggacgctgcccgccgagcggactgattcgcagagtctgtacatagtgtatattgctctacccggccgcacaccacgtcctgctctggcttttgccttcttgatgccagcctgctgcaacagaccctccccgcgcccctccccagcccatcttactgcaagcagcgtcctgaggagacagcggcacgttctagctgcgtctgcggccagcccgtgccagtggagtgggctccgcgttgctcattctatgcctctgagctccaaacccagggcagccatggcttctcatttacaccaacaggtttcagttccaacagaaaggtcggggtaggttcgtgcagagatggggctggcaggggggctatgggaggattattttaacagatcaagaaaatgaagccaaatcaagtgaattaaattcctcacaattattttctttccctgaggtttgattggcacagcagcaaaagttgaggccaccccacttgtgtccactgtttttagaaaaaaatgaatggcttcctgccattgtggggctggactcttgggctttcttggtgggagcggagaaggggcctcccacccttgtccgagttgcctcccactggaggtcaggagtctacactgcagcctcgggcactgtggggagtgcatgcctggggcctctgggtggggaccatggacaggccctggtcactgtcctaacctttgtcaggacaaaggtagcaagaggatttcctggcgggtgggaaggaatggctggggcggccagttttgacacgccccagtgccctggagaacaaccagggtcatctgcacttgatgactgctccccgacccccagcccggacacctcattcccctcccactacagggatcaagtgacctgggaagaaccgagtttaacaccaggatgtgtttccttagatttcctttcctaggcgatttccagggagagccctgattggacaatcacatcacagatcacactgcagtttccatgttagcactgtggatgggtttttaatcaataaaaactgggggtttcttctcaccgactctccacttgcccaaactgccaaaagctggtgattctgggacaggccttcactttggagccacgggatggggtgggggagccccatgggcctgggaaggagggtgctgtggagggggctgcagggctgaccagcaggcagcctcatctggtcgggggcgggggcggcaggagcagaagcggggtctccgtccttgggactgtcctggttggccacgggccctgaggatgcacggtgcctggggctcctgtgccggtgggcggggggcatgctggcctctgagcgatcaggcgaggccagcgagggtgtgcttgcaaattcaagcaataagaggggggttcctgggggcttccagcccaggctagaagcccccatggcttctggcagctggacatcagccccaggtattggggtgattttggtcatgacagtgtgcctgtcccactgttacacgcatgaatgggggttatggggtgggggtggggactcagggctggaccgacgtcctagtggacctgatgtgaaattcctgtcaaacaaacaccacttttcaatggtttgctaggagtatttctgtattgaaagtttctaattatgctttttaaaaaaatactaaaaataaaggttcaagctgccaaa

SEQ ID NO: 313067 - DNA, 2785 bp, Homo sapiens
  misc_feature (2718)..(2718): n is a, c, g, or t
cggtggtagcggcggcggctgctgaggaggaggagggggagcggagggaggtgtttctgtcagttccggctgtttgttcgggaagtggatccgccgctgccggagcagcccgaagggagctgcggatcgcgaggccagtaccgaccccgcccgcccgcgcgcaccgcccccgcccgccatggcccgggactacgaccacctcttcaagctgctcatcatcggcgacagcggtgtgggcaagagcagtttactgttgcgttttgcagacaacactttctcaggcagctacatcaccacgatcggagtggatttcaagatccggaccgtggagatcaacggggagaaggtgaagctgcagatctgggacacagcggggcaggagcgcttccgcaccatcacctccacgtattatcgggggacccacggggtcattgtggtttacgacgtcaccagtgccgagtcctttgtcaacgtcaagcggtggcttcacgaaatcaaccagaactgtgatgatgtgtgccgaatattagtgggtaataagaatgacgaccctgagcggaaggtggtggagacggaagatgcctacaaattcgccgggcagatgggcatccagttgttcgagaccagcgccaaggagaatgtcaacgtggaagagatgttcaactgcatcacggagctggtcctccgagcaaagaaagacaacctggcaaaacagcagcagcaacaacagaacgatgtggtgaagctcacgaagaacagtaaacgaaagaaacgctgctgctaatggcacccagtccactgcagagactgcactgcggtccctcccccagcccgaggcccacggaggttcctcgggggacagtctcagtttcgtgccgttatttaaagaattctctccatgtttttgtatcgggaggtgccatcggcacttcctcccccgccctcctcgagtgccaagaaggtgttggaccagcccgcccttccctactggtgccccctcctccccggccaaggcgcctggacctggcgaggacgctgcccgccgagcggactgattcgcagagtctgtacatagtgtatattgctctacccggccgcacaccacgtcctgctctggcttttgccttcttgatgccagcctgctgcaacagaccctccccgcgcccctccccagcccatcttactgcaagcagcgtcctgaggagacagcggcacgttctagctgcgtctgcggccagcccgtgccagtggagtgggctccgcgttgctcattctctccgacaggttgtcagcctctgtccccgctgcacagggtcttgccccttctccggggcctgtgccagctcccttccctccccgttgtcctgtccccacagccattctgggagctggggaacctggtctcaaggcaggccctgcagttccacagaggtggcaggtcttgccctttggccaacagatttcttgtcctgccttctagatgcctctgagctccaaacccagggcagccatggcttctcatttacaccaacaggtttcagttccaacagaaaggtcggggtaggttcgtgcagagatggggctggcaggggggctatgggaggattattttaacagatcaagaaaatgaagccaaatcaagtgaattaaattcctcacaattattttctttccctgaggtttgattggcacagcagcaaaagttgaggccaccccacttgtgtccactgtttttagaaaaaaatgaatggcttcctgccattgtggggctggactcttgggctttcttggtgggagcggagaaggggcctcccacccttgtccgagttgcctcccactggaggtcaggagtctacactgcagcctcgggcactgtggggagtgcatgcctggggcctctgggtggggaccatggacaggccctggtcactgtcctaacctttgtcaggacaaaggtagcaagaggatttcctggcgggtgggaaggaatggctggggcggccagttttgacacgccccagtgccctggagaacaaccagggtcatctgcacttgatgactgctccccgacccccagcccggacacctcattcccctcccactacagggatcaagtgacctgggaagaaccgagtttaacaccaggatgtgtttccttagatttcctttcctaggcgatttccagggagagccctgattggacaatcacatcacagatcacactgcagtttccatgttagcactgtggatgggtttttaatcaataaaaactgggggtttcttctcaccgactctccacttgcccaaactgccaaaagctggtgattctgggacaggccttcactttggagccacgggatggggtgggggagccccatgggcctgggaaggagggtgctgtggagggggctgcagggctgaccagcaggcagcctcatctggtcgggggcgggggcggcaggagcagaagcggggtctccgtccttgggactgtcctggttggccacgggccctgaggatgcacggtgcctggggctcctgtgccggtgggcggggggcatgctggcctctgagcgatcaggcgaggccagcgagggtgtgcttgcaaattcaagcaataagaggggggttcctggcttctcctccccctattcttcccccattctcttccctcccctctcgtcccactcctccctttcctccctctcttcttccctncccttcctcattctcctcaccctcctccccgccctttctttttctgccccctcctccccctcccccc

SEQ ID NO: 313068 - DNA, 2578 bp, Homo sapiens
cggtggtagcggcggcggctgctgaggaggaggagggggagcggagggaggtgtttctgtcagttccggctgtttgttcgggaagtggatccgccgctgccggagcagcccgaagggagctgcggatcgcgaggccagtaccgaccccgcccgcccgcgcgcaccgcccccgcccgccatggcccgggactacgaccacctcttcaagctgctcatcatcggcgacagcggtgtgggcaagagcagtttactgttgcgttttgcagacaacactttctcaggcagctacatcaccacgatcggagtggatttcaagatccggaccgtggagatcaacggggagaaggtgaagctgcagatctgggacacagcggggcaggagcgcttccgcaccatcacctccacgtattatcgggggacccacggggtcattgtggtttacgacgtcaccagtgccgagtcctttgtcaacgtcaagcggtggcttcacgaaatcaaccagaactgtgatgatgtgtgccgaatattagtgggtaataagaatgacgaccctgagcggaaggtggtggagacggaagatgcctacaaattcgccgggcagatgggcatccagttgttcgagaccagcgccaaggagaatgtcaacgtggaagagatgttcaactgcatcacggagctggtcctccgagcaaagaaagacaacctggcaaaacagcagcagcaacaacagaacgatgtggtgaagctcacgaagaacagtaaacgaaagaaacgctgctgctaatggcacccagtccactgcagagactgcactgcggtccctcccccagcccgaggcccacggaggttcctcgggggacagtctcagtttcgtgccgttatttaaagaattctctccatgtttttgtatcgggaggtgccatcggcacttcctcccccgccctcctcgagtgccaagaaggtgttggaccagcccgcccttccctactggtgccccctcctccccggccaaggcgcctggacctggcgaggacgctgcccgccgagcggactgattcgcagagtctgtacatagtgtatattgctctacccggccgcacaccacgtcctgctctggcttttgccttcttgatgccagcctgctgcaacagaccctccccgcgcccctccccagcccatcttactgcaagcagcgtcctgaggagacagcggcacgttctagctgcgtctgcggccagcccgtgccagtggagtgggctccgcgttgctcattctctccgacaggttgtcagcctctgtccccgctgcacagggtcttgccccttctccggggcctgtgccagctcccttccctccccgttgtcctgtccccacagccattctgggagctggggaacctggtctcaaggcaggccctgcagttccacagaggtggcaggtcttgccctttggccaacagatttcttgtcctgccttctagatgcctctgagctccaaacccagggcagccatggcttctcatttacaccaacaggtttcagttccaacagaaaggtcggggtaggttcgtgcagagatggggctggcaggggggctatgggaggattattttaacagatcaagaaaatgaagccaaatcaagtgaattaaattcctcacaattattttctttccctgaggtttgattggcacagcagcaaaagttgaggccaccccacttgtgtccactgtttttagaaaaaaatgaatggcttcctgccattgtggggctggactcttgggctttcttggtgggagcggagaaggggcctcccacccttgtccgagttgcctcccactggaggtcaggagtctacactgcagcctcgggcactgtggggagtgcatgcctggggcctctgggtggggaccatggacaggccctggtcactgtcctaacctttgtcaggacaaaggtagcaagaggatttcctggcgggtgggaaggaatggctggggcggccagttttgacacgccccagtgccctggagaacaaccagggtcatctgcacttgatgactgctccccgacccccagcccggacacctcattcccctcccactacagggatcaagtgacctgggaagaaccgagtttaacaccaggatgtgtttccttagatttcctttcctaggcgatttccagggagagccctgattggacaatcacatcacagatcacactgcagtttccatgttagcactgtggatgggtttttaatcaataaaaactgggggtttcttctcaccgactctccacttgcccaaactgccaaaagctggtgatttggacatcagccccaggtattggggtgattttggtcatgacagtgtgcctgtcccactgttacacgcatgaatgggggttatggggtgggggtggggactcagggctggaccgacgtcctagtggacctgatgtgaaattcctgtcaaacaaacaccacttttcaatggtttgctaggagtatttctgtattgaaagtttctaattatgctttttaaaaaaatactaaaaataaaggttcaagctgccaaa

SEQ ID NO: 313069 - DNA, 2314 bp, Homo sapiens
  misc_feature (7)..(7): n is a, c, g, or t
  misc_feature (36)..(37): n is a, c, g, or t
cggagcntaagacgcacaaggaggttcaacgtggannagatgttcaactgcatcacggagctggtcctccgagcaaagaaagacaacctggcaaaacagcagcagcaacaacagaacgatgtggtgaagctcacgaagaacagtaaacgaaagaaacgctgctgctaatggcacccagtccactgcagagactgcactgcggtccctcccccagcccgaggcccacggaggttcctcgggggacagtctcagtttcgtgccgttatttaaagaattctctccatgtttttgtatcgggaggtgccatcggcacttcctcccccgccctcctcgagtgccaagaaggtgttggaccagcccgcccttccctactggtgccccctcctccccggccaaggcgcctggacctggcgaggacgctgcccgccgagcggactgattcgcagagtctgtacatagtgtatattgctctacccggccgcacaccacgtcctgctctggcttttgccttcttgatgccagcctgctgcaacagaccctccccgcgcccctccccagcccatcttactgcaagcagcgtcctgaggagacagcggcacgttctagctgcgtctgcggccagcccgtgccagtggagtgggctccgcgttgctcattctctccgacaggttgtcagcctctgtccccgctgcacagggtcttgccccttctccggggcctgtgccagctcccttccctccccgttgtcctgtccccacagccattctgggagctggggaacctggtctcaaggcaggccctgcagttccacagaggtggcaggtcttgccctttggccaacagatttcttgtcctgccttctagatgcctctgagctccaaacccagggcagccatggcttctcatttacaccaacaggtttcagttccaacagaaaggtcggggtaggttcgtgcagagatggggctggcaggggggctatgggaggattattttaacagatcaagaaaatgaagccaaatcaagtgaattaaattcctcacaattattttctttccctgaggtttgattggcacagcagcaaaagttgaggccaccccacttgtgtccactgtttttagaaaaaaatgaatggcttcctgccattgtggggctggactcttgggctttcttggtgggagcggagaaggggcctcccacccttgtccgagttgcctcccactggaggtcaggagtctacactgcagcctcgggcactgtggggagtgcatgcctggggcctctgggtggggaccatggacaggccctggtcactgtcctaacctttgtcaggacaaaggtagcaagaggatttcctggcgggtgggaaggaatggctggggcggccagttttgacacgccccagtgccctggagaacaaccagggtcatctgcacttgatgactgctccccgacccccagcccggacacctcattcccctcccactacagggatcaagtgacctgggaagaaccgagtttaacaccaggatgtgtttccttagatttcctttcctaggcgatttccagggagagccctgattggacaatcacatcacagatcacactgcagtttccatgttagcactgtggatgggtttttaatcaataaaaactgggggtttcttctcaccgactctccacttgcccaaactgccaaaagctggtgattctgggacaggccttcactttggagccacgggatggggtgggggagccccatgggcctgggaaggagggtgctgtggagggggctgcagggctgaccagcaggcagcctcatctggtcgggggcgggggcggcaggagcagaagcggggtctccgtccttgggactgtcctggttggccacgggccctgaggatgcacggtgcctggggctcctgtgccggtgggcggggggcatgctggcctctgagcgatcaggcgaggccagcgagggtgtgcttgcaaattcaagcaataagaggggggttcctgggggcttccagcccaggctagaagcccccatggcttctggcagctggacatcagccccaggtattggggtgattttggtcatgacagtgtgcctgtcccactgttacacgcatgaatgggggttatggggtgggggtggggactcagggctggaccgacgtcctagtggacctgatgtgaaattcctgtcaaacaaacaccacttttcaatggtttgctaggagtatttctgtattgaaagtttctaattatgctttttaaaaaaatactaaaaataaaggttcaagctgccaaa

SEQ ID NO: 313070 - DNA, 2675 bp, Homo sapiens
cggtggtagcggcggcggctgctgaggaggaggagggggagcggagggaggtgtttctgtcagttccggctgtttgttcgggaagtggatccgccgctgccggagcagcccgaagggagctgcggatcgcgaggccagtaccgaccccgcccgcccgcgcgcaccgcccccgcccgccatggcccgggactacgaccacctcttcaagctgctcatcatcggcgacagcggtgtgggcaagagcagtttactgttgcgttttgcagacaacactttctcaggcagctacatcaccacgatcggagtggatttcaagatccggaccgtggagatcaacggggagaaggtgaagctgcagatctgggacacagcggggcaggagcgcttccgcaccatcacctccacgtattatcgggggacccacggggtcattgtggtttacgacgtcaccagtgccgagtcctttgtcaacgtcaagcggtggcttcacgaaatcaaccagaactgtgatgatgtgtgccgaatattagtgggtaataagaatgacgaccctgagcggaaggtggtggagacggaagatgcctacaaattcgccgggcagatgggcatccagttgttcgagaccagcgccaaggagaatgtcaacgtggaagagatgttcaactgcatcacggagctggtcctccgagcaaagaaagacaacctggcaaaacagcagcagcaacaacagaacgatgtggtgaagctcacgaagaacagtaaacgaaagaaacgctgctgctaatggcacccagtccactgcagagactgcactgcggtccctcccccagcccgaggcccacggaggttcctcgggggacagtctcagtttcgtgccgttatttaaagaattctctccatgtttttgtatcgggaggtgccatcggcacttcctcccccgccctcctcgagtgccaagaaggtgttggaccagcccgcccttccctactggtgccccctcctccccggccaaggcgcctggacctggcgaggacgctgcccgccgagcggactgattcgcagagtctgtacatagtgtatattgctctacccggccgcacaccacgtcctgctctggcttttgccttcttgatgccagcctgctgcaacagaccctccccgcgcccctccccagcccatcttactgcaagcagcgtcctgaggagacagcggcacgttctagctgcgtctgcggccagcccgtgccagtggagtgggctccgcgttgctcattctctccgacaggttgtcagcctctgtccccgctgcacagggtcttgccccttctccggggcctgtgccagctcccttccctccccgttgtcctgtccccacagccattctgggagctggggaacctggtctcaaggcaggccctgcagttccacagaggtggcaggtcttgccctttggccaacagatttcttgtcctgccttctagatgcctctgagctccaaacccagggcagccatggcttctcatttacaccaacaggtttcagttccaacagaaaggtcggggtaggttcgtgcagagatggggctggcaggggggctatgggaggattattttaacagatcaagaaaatgaagccaaatcaagtgaattaaattcctcacaattattttctttccctgaggtttgattggcacagcagcaaaagttgaggccaccccacttgtgtccactgtttttagaaaaaaatgaatggcttcctgccattgtggggctggactcttgggctttcttggtgggagcggagaaggggcctcccacccttgtccgagttgcctcccactggaggtcaggagtctacactgcagcctcgggcactgtggggagtgcatgcctggggcctctgggtggggaccatggacaggccctggtcactgtcctaacctttgtcaggacaaaggtagcaagaggatttcctggcgggtgggaaggaatggctggggcggccagttttgacacgccccagtgccctggagaacaaccagggtcatctgcacttgatgactgctccccgacccccagcccggacacctcattcccctcccactacagggatcaagtgacctgggaagaaccgagtttaacaccaggatgtgtttccttagatttcctttcctaggcgatttccagggagagccctgattggacaatcacatcacagatcacactgcagtttccatgttagcactgtggatgggtttttaatcaataaaaactgggggtttctaaaaaaaaaaaaaacaaaaaaaaaaaaaaaaaaaaaaaaaacaaaaaaaagggggggggcggaaaaaaaaacccccggggggcccccattttgctacccccgtttttttggtaacgaaggtggtccccacaagagaggggaggagttataaaaaacagagggcgcaggaggggggtgtttaaacaaagagtgttgtgagtgtgggaacaagcggtgtagtggggactcatgtgggggaggaggacgcattcacttgtgggggggtgggaacatttgtggacacactaactgagcagatatgaaggctcgagggaaaattacaatttggaggtttatgagtgtaacaccagtgaatgtgtgcgcgcgaaattgttacgggtaattggaaattgc

SEQ ID NO: 313071 - DNA, 1550 bp, Homo sapiens
cggtggtagcggcggcggctgctgaggaggaggagggggagcggagggaggtgtttctgtcagttccggctgtttgttcgggaagtggatccgccgctgccggagcagcccgaagggagctgcggatcgcgaggccagtaccgaccccgcccgcccgcgcgcaccgcccccgcccgccatggcccgggactacgaccacctcttcaagctgctcatcatcggcgacagcggtgtgggcaagagcagtttactgttgcgttttgcagacaacactttctcaggcagctacatcaccacgatcggagtggatttcaagatccggaccgtggagatcaacggggagaaggtgaagctgcagatctgggacacagcggggcaggagcgcttccgcaccatcacctccacgtattatcgggggacccacggggtcattgtggtttacgacgtcaccagtgccgagtcctttgtcaacgtcaagcggtggcttcacgaaatcaaccagaactgtgatgatgtgtgccgaatattagtgggtaataagaatgacgaccctgagcggaaggtggtggagacggaagatgcctacaaattcgccgggcagatgggcatccagttgttcgagaccagcgccaaggagaatgtcaacgtggaagagatgttcaactgcatcacggagctggtcctccgagcaaagaaagacaacctggcaaaacagcagcagcaacaacagaacgatgtggtgaagctcacgaagaacagtaaacgaaagaaacgctgctgctaatggcacccagtccactgcagagactgcactgcggtccctcccccagcccgaggcccacggaggttcctcgggggacagtctcagtttcgtgccgttatttaaagaattctctccatgtttttgtatcgggaggtgccatcggcacttcctcccccgccctcctcgagtgccaagaaggtgttggaccagcccgcccttccctactggtgccccctcctccccggccaaggcgcctggacctggcgaggacgctgcccgccgagcggactgattcgcagagtctgtacatagtgtatattgctctacccggccgcacaccacgtcctgctctggcttttgccttcttgatgccagcctgctgcaacagaccctccctgtgccggtgggcggggggcatgctggcctctgagcgatcaggcgaggccagcgagggtgtgcttgcaaattcaagcaataagaggggggttcctgggggcttccagcccaggctagaagcccccatggcttctggcagctggacatcagccccaggtattggggtgattttggtcatgacagtgtgcctgtcccactgttacacgcatgaatgggggttatggggtgggggtggggactcagggctggaccgacgtcctagtggacctgatgtgaaattcctgtcaaacaaacaccacttttcaatggtttgctaggagtatttctgtattgaaagtttctaattatgctttttaaaaaaatactaaaaataaaggttcaagctgccaaa

SEQ ID NO: 313072 - DNA, 1664 bp, Homo sapiens
cggtggtagcggcggcggctgctgaggaggaggagggggagcggagggaggtgtttctgtcagttccggctgtttgttcgggaagtggatccgccgctgccggagcagcccgaagggagctgcggatcgcgaggccagtaccgaccccgcccgcccgcgcgcaccgcccccgcccgccatggcccgggactacgaccacctcttcaagctgctcatcatcggcgacagcggtgtgggcaagagcagtttactgttgcgttttgcagacaacactttctcaggcagctacatcaccacgatcggagtggatttcaagatccggaccgtggagatcaacggggagaaggtgaagctgcagatctgggacacagcggggcaggagcgcttccgcaccatcacctccacgtattatcgggggacccacggggtcattgtggtttacgacgtcaccagtgccgagtcctttgtcaacgtcaagcggtggcttcacgaaatcaaccagaactgtgatgatgtgtgccgaatattagtgggtaataagaatgacgaccctgagcggaaggtggtggagacggaagatgcctacaaattcgccgggcagatgggcatccagttgttcgagaccagcgccaaggagaatgtcaacgtggaagagatgttcaactgcatcacggagctggtcctccgagcaaagaaagacaacctggcaaaacagcagcagcaacaacagaacgatgtggtgaagctcacgaagaacagtaaacgaaagaaacgctgctgctaatggcacccagtccactgcagagactgcactgcggtccctcccccagcccgaggcccacggaggttcctcgggggacagtctcagtttcgtgccgttatttaaagaattctctccatgtttttgtatcgggaggtgccatcggcacttcctcccccgccctcctcgagtgccaagaaggtgttggaccagcccgcccttccctactggtgccccctcctccccggccaaggcgcctggacctggcgaggacgctgcccgccgagcggactgattcgcagagtctgtacatagtgtatattgctctacccggccgcacaccacgtcctgctctggcttttgccttcttgatgccagcctgctgcaacagaccctccccgcgcccctccccagcccatcttactgcaagcagcgtcctgaggagacagcggcacgttctagctgcgtctgcggccagcccgtgccagtggagtgggctccgcgttgctcattctctccgacaggttgtcagcctctgtccccgctgcacagggtcttgccccttctccggggcctgtgccagctcccttccctccccgttgtcctgtccccacagccattctgggagctggggaacctggtctcaaggcaggccctgcagttccacagaggtggcaggtcttgccctttggccaacagatttcttgtcctgccttctagatgcctctgagctccaaacccagggcagccatggcttctcatttacaccaacaggtttcagttccaacagaaaggtcggggtaggttcgtgcagagatggggctggcaggggggctatgggaggattattttaacagatcaagaaaatgaagccaaatcaagtgaattaaattcctcacaatta

SEQ ID NO: 313073 - DNA, 2930 bp, Homo sapiens
cggtggtagcggcggcggctgctgaggaggaggagggggagcggagggaggtgtttctgtcagttccggctgtttgttcgggaagtggatccgccgctgccggagcagcccgaagggagctgcggatcgcgaggccagtaccgaccccgcccgcccgcgcgcaccgcccccgcccgccatggcccgggactacgaccacctcttcaagctgctcatcatcggcgacagcggtgtgggcaagagcagtttactgttgcgttttgcagacaacactttctcaggcagctacatcaccacgatcggagtggatttcaagatccggaccgtggagatcaacggggagaaggtgaagctgcagatctgggacacagcggggcaggagcgcttccgcaccatcacctccacgtattatcgggggacccacggggtcattgtggtttacgacgtcaccagtgccgagtcctttgtcaacgtcaagcggtggcttcacgaaatcaaccagaactgtgatgatgtgtgccgaatattagtgggtaataagaatgacgaccctgagcggaaggtggtggagacggaagatgcctacaaattcgccgggcagatgggcatccagttgttcgagaccagcgccaaggagaatgtcaacgtggaagagatgttcaactgcatcacggagctggtcctccgagcaaagaaagacaacctggcaaaacagcagcagcaacaacagaacgatgtggtgaagctcacgaagaacagtaaacgaaagaaacgctgctgctaatggcacccagtccactgcagagactgcactgcggtccctcccccagcccgaggcccacggaggttcctcgggggacagtctcagtttcgtgccgttatttaaagaattctctccatgtttttgtatcgggaggtgccatcggcacttcctcccccgccctcctcgagtgccaagaaggtgttggaccagcccgcccttccctactggtgccccctcctccccggccaaggcgcctggacctggcgaggacgctgcccgccgagcggactgattcgcagagtctgtacatagtgtatattgctctacccggccgcacaccacgtcctgctctggcttttgccttcttgatgccagcctgctgcaacagaccctccccgcgcccctccccagcccatcttactgcaagcagcgtcctgaggagacagcggcacgttctagctgcgtctgcggccagcccgtgccagtggagtgggctccgcgttgctcattctctccgacaggttgtcagcctctgtccccgctgcacagggtcttgccccttctccggggcctgtgccagctcccttccctccccgttgtcctgtccccacagccattctgggagctggggaacctggtctcaaggcaggccctgcagttccacagaggtggcaggtcttgccctttggccaacagatttcttgtcctgccttctagatgcctctgagctccaaacccagggcagccatggcttctcatttacaccaacaggtttcagttccaacagaaaggtcggggtaggttcgtgcagagatggggctggcaggggggctatgggaggattattttaacagatcaagaaaatgaagccaaatcaagtgaattaaattcctcacaattattttctttccctgaggtttgattggcacagcagcaaaagttgaggccaccccacttgtgtccactgtttttagaaaaaaatgaatggcttcctgccattgtggggctggactcttgggctttcttggtgggagcggagaaggggcctcccacccttgtccgagttgcctcccactggaggtcaggagtctacactgcagcctcgggcactgtggggagtgcatgcctggggcctctgggtggggaccatggacaggccctggtcactgtcctaacctttgtcaggacaaaggtagcaagaggatttcctggcgggtgggaaggaatggctggggcggccagttttgacacgccccagtgccctggagaacaaccagggtcatctgcacttgatgactgctccccgacccccagcccggacacctcattcccctcccactacagggatcaagtgacctgggaagaaccgagtttaacaccaggatgtgtttccttagatttcctttcctaggcgatttccagggagagccctgattggacaatcacatcacagatcacactgcagtttccatgttagcactgtggatgggtttttaatcaataaaaactgggggtttcttctcaccgactctccacttgcccaaactgccaaaagctggtgattctgggacaggccttcactttggagccacgggatggggtgggggagccccatgggcctgggaaggagggtgctgtggagggggctgcagggctgaccagcaggcagcctcatctggtcgggggcgggggcggcaggagcagaagcggggtctccgtccttgggactgtcctggttggccacgggccctgaggatgcacggtgcctggggctcctgtgccggtgggcggggggcatgctggcctctgagcgatcaggcgaggccagcgagggtgtgcttgcaaattcaagcaataagaggggggttcctgggggcttccagcccaggctagaagcccccatggcttctggcagctggacatcagccccaggtattggggtgattttggtcatgacagtgtgcctgtcccactgttacacgcatgaatgggggttatggggtgggggtggggactcagggctggaccgacgtcctagtggacctgatgtgaaattcctgtcaaacaaacaccacttttcaatggtttgctaggagtatttctgtattgaaagtttctaattatgctttttaaaaaaatactaaaaataaaggttcaagctgccaaa

SEQ ID NO: 313074 - DNA, 2536 bp, Homo sapiens
cggtggtagcggcggcggctgctgaggaggaggagggggagcggagggaggtgtttctgtcagttccggctgtttgttcgggaagtggatccgccgctgccggagcagcccgaagggagctgcggatcgcgaggccagtaccgaccccgcccgcccgcgcgcaccgcccccgcccgccatggcccgggactacgaccacctcttcaagctgctcatcatcggcgacagcggtgtgggcaagagcagtttactgttgcgttttgcagacaacactttctcaggcagctacatcaccacgatcggagtggatttcaagatccggaccgtggagatcaacggggagaaggtgaagctgcagatctgggacacagcggggcaggagcgcttccgcaccatcacctccactgcagagactgcactgcggtccctcccccagcccgaggcccacggaggttcctcgggggacagtctcagtttcgtgccgttatttaaagaattctctccatgtttttgtatcgggaggtgccatcggcacttcctcccccgccctcctcgagtgccaagaaggtgttggaccagcccgcccttccctactggtgccccctcctccccggccaaggcgcctggacctggcgaggacgctgcccgccgagcggactgattcgcagagtctgtacatagtgtatattgctctacccggccgcacaccacgtcctgctctggcttttgccttcttgatgccagcctgctgcaacagaccctccccgcgcccctccccagcccatcttactgcaagcagcgtcctgaggagacagcggcacgttctagctgcgtctgcggccagcccgtgccagtggagtgggctccgcgttgctcattctctccgacaggttgtcagcctctgtccccgctgcacagggtcttgccccttctccggggcctgtgccagctcccttccctccccgttgtcctgtccccacagccattctgggagctggggaacctggtctcaaggcaggccctgcagttccacagaggtggcaggtcttgccctttggccaacagatttcttgtcctgccttctagatgcctctgagctccaaacccagggcagccatggcttctcatttacaccaacaggtttcagttccaacagaaaggtcggggtaggttcgtgcagagatggggctggcaggggggctatgggaggattattttaacagatcaagaaaatgaagccaaatcaagtgaattaaattcctcacaattattttctttccctgaggtttgattggcacagcagcaaaagttgaggccaccccacttgtgtccactgtttttagaaaaaaatgaatggcttcctgccattgtggggctggactcttgggctttcttggtgggagcggagaaggggcctcccacccttgtccgagttgcctcccactggaggtcaggagtctacactgcagcctcgggcactgtggggagtgcatgcctggggcctctgggtggggaccatggacaggccctggtcactgtcctaacctttgtcaggacaaaggtagcaagaggatttcctggcgggtgggaaggaatggctggggcggccagttttgacacgccccagtgccctggagaacaaccagggtcatctgcacttgatgactgctccccgacccccagcccggacacctcattcccctcccactacagggatcaagtgacctgggaagaaccgagtttaacaccaggatgtgtttccttagatttcctttcctaggcgatttccagggagagccctgattggacaatcacatcacagatcacactgcagtttccatgttagcactgtggatgggtttttaatcaataaaaactgggggtttcttctcaccgactctccacttgcccaaactgccaaaagctggtgattctgggacaggccttcactttggagccacgggatggggtgggggagccccatgggcctgggaaggagggtgctgtggagggggctgcagggctgaccagcaggcagcctcatctggtcgggggcgggggcggcaggagcagaagcggggtctccgtccttgggactgtcctggttggccacgggccctgaggatgcacggtgcctggggctcctgtgccggtgggcggggggcatgctggcctctgagcgatcaggcgaggccagcgagggtgtgcttgcaaattcaagcaataagaggggggttcctgggggcttccagcccaggctagaagcccccatggcttctggcagctggacatcagccccaggtattggggtgattttggtcatgacagtgtgcctgtcccactgttacacgcatgaatgggggttatggggtgggggtggggactcagggctggaccgacgtcctagtggacctgatgtgaaattcctgtcaaacaaacaccacttttcaatggtttgctaggagtatttctgtattgaaagtttctaattatgctttttaaaaaaatactaaaaataaaggttcaagctgccaaa

SEQ ID NO: 313075 - DNA, 1866 bp, Homo sapiens
cggtggtagcggcggcggctgctgaggaggaggagggggagcggagggaggtgtttctgtcagttccggctgtttgttcgggaagtggatccgccgctgccggagcagcccgaagggagctgcggatcgcgaggccagtaccgaccccgcccgcccgcgcgcaccgcccccgcccgccatggcccgggactacgaccacctcttcaagctgctccgacaggttgtcagcctctgtccccgctgcacagggtcttgccccttctccggggcctgtgccagctcccttccctccccgttgtcctgtccccacagccattctgggagctggggaacctggtctcaaggcaggccctgcagttccacagaggtggcaggtcttgccctttggccaacagatttcttgtcctgccttctagatgcctctgagctccaaacccagggcagccatggcttctcatttacaccaacaggtttcagttccaacagaaaggtcggggtaggttcgtgcagagatggggctggcaggggggctatgggaggattattttaacagatcaagaaaatgaagccaaatcaagtgaattaaattcctcacaattattttctttccctgaggtttgattggcacagcagcaaaagttgaggccaccccacttgtgtccactgtttttagaaaaaaatgaatggcttcctgccattgtggggctggactcttgggctttcttggtgggagcggagaaggggcctcccacccttgtccgagttgcctcccactggaggtcaggagtctacactgcagcctcgggcactgtggggagtgcatgcctggggcctctgggtggggaccatggacaggccctggtcactgtcctaacctttgtcaggacaaaggtagcaagaggatttcctggcgggtgggaaggaatggctggggcggccagttttgacacgccccagtgccctggagaacaaccagggtcatctgcacttgatgactgctccccgacccccagcccggacacctcattcccctcccactacagggatcaagtgacctgggaagaaccgagtttaacaccaggatgtgtttccttagatttcctttcctaggcgatttccagggagagccctgattggacaatcacatcacagatcacactgcagtttccatgttagcactgtggatgggtttttaatcaataaaaactgggggtttcttctcaccgactctccacttgcccaaactgccaaaagctggtgattctgggacaggccttcactttggagccacgggatggggtgggggagccccatgggcctgggaaggagggtgctgtggagggggctgcagggctgaccagcaggcagcctcatctggtcgggggcgggggcggcaggagcagaagcggggtctccgtccttgggactgtcctggttggccacgggccctgaggatgcacggtgcctggggctcctgtgccggtgggcggggggcatgctggcctctgagcgatcaggcgaggccagcgagggtgtgcttgcaaattcaagcaataagaggggggttcctgggggcttccagcccaggctagaagcccccatggcttctggcagctggacatcagccccaggtattggggtgattttggtcatgacagtgtgcctgtcccactgttacacgcatgaatgggggttatggggtgggggtggggactcagggctggaccgacgtcctagtggacctgatgtgaaattcctgtcaaacaaacaccacttttcaatggtttgctaggagtatttctgtattgaaagtttctaattatgctttttaaaaaaatactaaaaataaaggttcaagctgccaaa

SEQ ID NO: 313076 - DNA, 787 bp, Homo sapiens
gataaggttttctgaagaccatttgtaaattgtccatttaaccatttttcagcttgctttgaaacaaaagtcacacctactatttttctatgaattagggaatgagggggagatcattcagttttacttttctttttgttgaaattttgtacccggattgcagttggcacttttcctaaaacagaattgtttcccacttaggtgtcagaatgtacctttgaacttccctaagaagcagcaggatctttttaactctctctggtctgtttagactttgaagtcccttctgtagaaaagtctcataactgagaaggctctgttttgggccgggtgggtctgctggcctccactcactgtgctgtttcctttgagtggcacacttgggaagctccggggcatgtgaaggagctgcaaacatgagaactaatgaaccaaggcggctgccaccaggaaggaacagaacgcaggcattcaaccatgacgtctgcacagtgttagtaacatgtcattgtggtttcgttctcactgtggtaaaatttatttctgagcacttaaactgtgttgcatacccctaattttttttttttctgtatcttccttgccctcaaataccctgaggtgataaactgttccagttgtagccaactaccactgctaggcctcaatgtaaattcagttgaaatttgcaattctatcagcaatttaatgtattgaattcagatcatcatttgtcattttaaccgacaaccacccaataaatttactctgcagttctgaactcagcatt

SEQ ID NO: 313077 - DNA, 2999 bp, Homo sapiens
gataaggttttctgaagaccatttgtaaattgtccatttaaccatttttcagcttgctttgaaacaaaagtcacacctactatttttctatgaattagggaatgagggggagatcattcagttttacttttctttttgttgaaattttgtacccggattgcagttggcacttttcctaaaacagaattgtttcccacttaggtgtcagaatgtacctttgaacttccctaagaagcagcaggatctttttaactctctctggtctgtttagactttgaagtcccttctgtagaaaagtctcataactgagaaggctctgttttgggccgggtgggtctgctggcctccactcactgtgctgtttcctttgagtggcacacttgggaagctccggggcatgtgaaggagctgcaaacatgagaactaatgaaccaaggcggctgccaccaggaaggaacagaacgcaggcattcaaccatgacgtctgcacagtgttagtaacatgtcattgtggtttcgttctcactgtggtaaaatttatttctgagcacttaaactgtgttgcatacccctaattttttttttttctgtatcttccttgccctcaaataccctgaggtgataaactgttccagttgtagccaactaccactgcgcccggccttaaataaaatattgtagtcattaatggtgtgtttgaattgaagagataccaggagatagaggtgaagtgcagtacttttattctttaagaatatagtctttagccaggtgcagtggtgtgtgcctgtagtctcagctatttgagaggctgaggtgagaggatcacttgagttcaggagttcaagaccagcctgggcaacatagcaagtccctggctcaaaaaaaaaaaagtttcccattcatattaactccatcttttaaaaatgtcatgattacaaagtgaaaagatttggctttcttagaggctcaatcacagaggtgaaagtgaccttggaaatcatatactctatccccatgttacacagattagaaaaactgaggttatggcactgacttaggcacccccagcaaggcaacccagggactacaactggcaatcccaactcctgggctagggctttttctacctttttttgcattggcctcttaaagaggcaatgaatactaattcctggcatcagaaaaaaaaaaaggcatgaggtgggaggattcttttttccctgatgggaaacagtgaataagaaaaatctcatcattcgatggaagaggtgacttaataattttattaatgaatttgatgtcccatgttttgtagttttgttatcattgaaccattggggctggaatctgcctaaataattttatcttggtagccagcaattatgttggtattttatgtgggccttcccagattttcatattaatgaaatgactaatagtcgtacttaagaggtaactctactaaagcagaatgagatctaatatgttgtggaaataaaagagtttgcagtggaatgatactctcactccgtgcttgtaaaattgagttctattcaagacggaactgctatgactggcctattcaaggcttcatatttttatacagactatttcacagaccatagatttattttaaaagggaaaatctcacacataattaagcagtggaaaatgtgctcaatgctatggtgcgtcaggccctctgtctaccaggtttctcccctttctgcagagctgtggaccctgtacgtaccaaacaggtgaacttggtccatctttccttcttcctttttttgcacatttgcatttatatcttcctgtactaaaagaaacaaattatttataattggggtgacaatataaaggaacaaaagatggggcaatagttgcttcctagctggagctgtaagtccatgttacagaaactcactatttaaaaagttttaaaagatttatgaaccttgtcctacaattcgctgaatacttatttgtcttttaaactcccctcggtgtatggatcatcttcgtcagaatgccgttgtttcattgtgaatcaggggaaaatgttaatcatttggagactgttttcttattaccaaatgtacaatccataagacaactgaaagcaacaactgctgggttcactgacaaagattataaaaatcatcacgttcaaagtagagtttttagccaaggtcaagaactaacctggggctgagtcagcgtctctacccacttaaataacagcgtaaagatctttcactaaattcgttatgtggtctgtctggatgtaaacctatatatttccttttgaaacagaatcatatcctgcagactcttggcactcctgcatagctttgaccgaatgttcactctcatcgtaatggaagatttctatctatgcagataatacatgtttttaaatactgttttctgtttagtcctcaatcttcctaactcaaattggggactgaggagagagaaaggtggttacccctgttaccgtgccatattcttcttgctgcttttcaaccccacgtgattgttgattgacggttctgctataatgtgcgtgcccttcaagtttcagaaaactttcccaatcatttcacttcaatcttaattgaacccaagagtcaaagttattattttctccgaacgtgtttgtgatcttctgttatattttggggcatgttacctttatggtatataagctgtagtgcatactctttgtattgcaaaaaactggtcagtaatttatgtacatgtattccacattttagtgtgcttgaagtgacaatccatagtttgtagtagtttgttatttgtcaactttaccctgtgttttaaggacatctaaacattccttgtcctatcaagatgacaaaagcagaatgtaatttttttttggaagcttcgtgattacctgtaacaagttctgtttttaaaacgaatacaaataaagttagtaactatttttaaatcaaaaacattga

SEQ ID NO: 313078 - DNA, 2187 bp, Homo sapiens
gataaggttttctgaagaccatttgtaaattgtccatttaaccatttttcagcttgctttgaaacaaaagtcacacctactatttttctatgaattagggaatgagggggagatcattcagttttacttttctttttgttgaaattttgtacccggattgcagttggcacttttcctaaaacagaattgtttcccacttaggtgtcagaatgtacctttgaacttccctaagaagcagcaggatctttttaactctctctggtctgtttagactttgaagtcccttctgtagaaaagtctcataactgagaaggctctgttttgggccgggtgggtctgctggcctccactcactgtgctgtttcctttgagtggcacacttgggaagctccggggcatgtgaaggagctgcaaacatgagaactaatgaaccaaggcggctgccaccaggaaggaacagaacgcaggcattcaaccatgacgtctgcacagtgttagtaacatgtcattgtggtttcgttctcactgtggtaaaatttatttctgagcacttaaactgtgttgcatacccctaattttttttttttctgtatcttccttgccctcaaataccctgaggtgataaactgttccagttgtagccaactaccactgcgcccggccttaaataaaatattgtagtcattaatggtgtgtttgaattgaagagataccaggagatagaggtgaagtgcagtacttttattctttaagaatatagtctttagccaggtgcagtggtgtgtgcctgtagtctcagctatttgagaggctgaggtgagaggatcacttgagttcaggagttcaagaccagcctgggcaacatagcaagtccctggctcaaaaaaaaaaaagtttcccattcatattaactccatcttttaaaaatgtcatgattacaaagtgaaaagatttggctttcttagaggctcaatcacagaggtgaaagtgaccttggaaatcatatactctatccccatgttacacagattagaaaaactgaggttatggcactgacttaggcacccccagcaaggcaacccagggactacaactggcaatcccaactcctgggctagggctttttctacctttttttgcattggcctcttaaagaggcaatgaatactaattcctggcatcagaaaaaaaaaaaggcatgaggtgggaggattcttttttccctgatgggaaacagtgaataagaaaaatctcatcattcgatggaagaggtgacttaataattttattaatgaatttgatgtcccatgttttgtagttttgttatcattgaaccattggggctggaatctgcctaaataattttatcttggtagccagcaattatgttggtattttatgtgggccttcccagattttcatattaatgaaatgactaatagtcgtacttaagaggtaactctactaaagcagaatgagatctaatatgttgtggaaataaaagagtttgcagtggaatgatactctcactccgtgcttgtaaaattgagttctattcaagacggaactgctatgactggcctattcaaggcttcatatttttatacagactatttcacagaccatagatttattttaaaagggaaaatctcacacataattaagcagtggaaaatgtgctcaatgctatggtgcgtcaggccctctgtctaccaggtttctcccctttctgcagagctgtggaccctgtacgtaccaaacaggtgaacttggtccatctttccttcttcctttttttgcacatttgcatttatatcttcctgtacgtggaactggatgaggcctcagagacaaggccgtccaacccgtcatttcacagatgagaaaacagaggcccggggagatcaggtggctcgcaaggagattagacccctgaccctgcccccgtcattctcttgtcttctcatcctccatcgccagatgctcctgggtgtgtttgtgaggccctttccctctctttaccccgcggaggagtccgacctggaagcctcctgctggacttctctactggactgagtgcccgggagtgccagagccagtcccaaaaaggacccaggagcggggacaccacggggaggcgccgccactccagtgtgcgggaccctggcacccccggcgcgttctccg

SEQ ID NO: 313079 - DNA, 1599 bp, Homo sapiens
  misc_feature (1529)..(1529): n is a, c, g, or t
  misc_feature (1533)..(1533): n is a, c, g, or t
  misc_feature (1542)..(1542): n is a, c, g, or t
  misc_feature (1579)..(1579): n is a, c, g, or t
  misc_feature (1586)..(1586): n is a, c, g, or t
gataaggttttctgaagaccatttgtaaattgtccatttaaccatttttcagcttgctttgaaacaaaagtcacacctactatttttctatgaattagggaatgagggggagatcattcagttttacttttctttttgttgaaattttgtacccggattgcagttggcacttttcctaaaacagaattgtttcccacttaggtgtcagaatgtacctttgaacttccctaagaagcagcaggatctttttaactctctctggtctgtttagactttgaagtcccttctgtagaaaagtctcataactgagaaggctctgttttgggccgggtgggtctgctggcctccactcactgtgctgtttcctttgagtggcacacttgggaagctccggggcatgtgaaggagctgcaaacatgagaactaatgaaccaaggcggctgccaccaggaaggaacagaacgcaggcattcaaccatgacgtctgcacagtgttagtaacatgtcattgtggtttcgttctcactgtggtaaaatttatttctgagcacttaaactgtgttgcatacccctaattttttttttttctgtatcttccttgccctcaaataccctgaggtgataaactgttccagttgtagccaactaccactgcgcccggccttaaataaaatattgtagtcattaatggtgtgtttgaattgaagagataccaggagatagaggtgaagtgcagtacttttattctttaagaatatagtctttagccaggtgcagtggtgtgtgcctgtagtctcagctatttgagaggctgaggtgagaggatcacttgagttcaggagttcaagaccagcctgggcaacatagcaagtccctggctcaaaaaaaaaaaagtttcccattcatattaactccatcttttaaaaatgtcatgattacaaagtgaaaagatttggctttcttagaggctcaatcacagaggtgaaagtgaccttggaaatcatatactctatccccatgttacacagattagaaaaactgaggttatggcactgacttaggcacccccagcaaggcaacccagggactacaactggcaatcccaactcctgggctagggctttttctacctttttttgcattggcctcttaaagaggcaatgaatactaattcctggcatcagaaaaaaaaaaaggcatgaggtgggaggattcttttttccctgatgggaaacagtgaataagaaaaatctcatcattcgatggaagaggtgacttaataattttattaatgaatttgatgtcccatgttttgtagttttgttatcattgaaccattggggctggaatctgcctaaataattttatcttggtagccagcaattatgttggtattttatgtgggccttcccagattttcatattaatgaaatgactaatagtcgtacttaagaggtaactctactaaagcagaatgagatctaatatgttgtggaaataaaagagtttgcagtggaatgatacccccnaacncccggggcnttgaaaaaattgggggcccaattccaaggccgggggnctgccantggcctgggccaa

SEQ ID NO: 313080 - DNA, 1694 bp, Homo sapiens
cgcagggctgtttggaggcgcttggggcgcacaatctggggcaggcggaaccttagtcctcagcctcgcgtttcccgcgactccgctctcaccgctacactaccacacaaacggcctccttcccccacccccgggggcccatcccggtggcgggctccggagctcgggactgctaatttcagcgaaacgattaaaagacgcccctacagctgacggcactttctctcctccggcagggaaggacgtccagcgtagcgtcgcccgcgcttccccgccggcgcagagcaggcctcacagaatcgcacgccgctggcacgcacgccgccccgcccccacggcccagcgccagccgcgccccgcgctcgcacgcatcccggcctcactgcccctcgactcctgttccgttggaggggcctgaggcgagcctgagcgcgctgttggccggagggaagccggaggagaccgggtcgactgggcagagcggcagagggtcgaggagcctgctctgcacgcccagggagtagaagtgggcagggagcagggtcacgtgagggagcgcgccgcgactgagcttgggtccgactggagctcaggctcgcgacccagactggtgggccaggcctccaagccggccttacacccaatccaaggaggacagaccggacacagagggacggagcgagcaaggagacatggcttcatcattcctgcccgcgggggccatcaccggcgacagcggtggagagctgagctcaggggacgactccggggaggtggagttcccccatagccctgagatcgaggagaccagttgcctggccgagctgtttgagaaggctgccgcgcacctgcaaggcctgattcaggtggccagcagggagcagctcttgtacctgtatgccaggtacaaacaggtcaaagttggaaattgtaatactcctaaaccaagcttctttgattttgaaggaaagcaaaaatgggaagcttggaaagcacttggtgattcaagccccagccaagcaatgcaggaatatatcgcagtagttaaaaaactagatccaggttggaatcctcagataccagagaagaaaggaaaagaagcaaatacaggttttggtgggccagttattagttctctatatcatgaagaaaccatcagggaagaagacaaaaatatatttgattactgcagggaaaacaacattgaccatataaccaaagccatcaaatcgaaaaatgtggatgtgaatgtgaaagatgaagagggtagggctctacttcactgggcctgtgatcgaggacataaggaactagtcacagtgttgctgcaacatagagctgacattaactgtcaggacaatgaaggccaaacagctctacattatgcctctgcctgtgagtttctggatattgtagagctgctgctccagtctggtgctgaccccactctccgagaccaggatggctgcctgccagaggaggtgacaggctgcaaaacagtttctttggtgctgcagcggcacacaactggcaaggcttaatcaaaagactggaaaactgcagtctgtaatagcataaggcttccattatgaaagaaaactacaaaaataatacttcttttccacccgtctttatgcacgatggctatatcgtcgtgcgggggggcgcggggggggggggggggggggggaggg

SEQ ID NO: 313081 - DNA, 1714 bp, Homo sapiens
cgcagggctgtttggaggcgcttggggcgcacaatctggggcaggcggaaccttagtcctcagcctcgcgtttcccgcgactccgctctcaccgctacactaccacacaaacggcctccttcccccacccccgggggcccatcccggtggcgggctccggagctcgggactgctaatttcagcgaaacgattaaaagacgcccctacagctgacggcactttctctcctccggcagggaaggacgtccagcgtagcgtcgcccgcgcttccccgccggcgcagagcaggcctcacagaatcgcacgccgctggcacgcacgccgccccgcccccacggcccagcgccagccgcgccccgcgctcgcacgcatcccggcctcactgcccctcgactcctgttccgttggaggggcctgaggcgagcctgagcgcgctgttggccggagggaagccggaggagaccgggtcgactgggcagagcggcagagggtcgaggagcctgctctgcacgcccagggagtagaagtgggcagggagcagggtcacgtgagggagcgcgccgcgactgagcttgggtccgactggagctcaggctcgcgacccagactggtgggccaggcctccaagccggccttacacccaatccaaggaggacagaccggacacagagggacggagcgagcaaggagacatggcttcatcattcctgcccgcgggggccatcaccggcgacagcggtggagagctgagctcaggggacgactccggggaggtggagttcccccatagccctgagatcgaggagaccagttgcctggccgagctgtttgagaaggctgccgcgcacctgcaaggcctgattcaggtggccagcagggagcagctcttgtacctgtatgccaggtacaaacaggtcaaagttggaaattgtaatactcctaaaccaagcttctttgattttgaaggaaagcaaaaatgggaagcttggaaagcacttggtgattcaagccccagccaagcaatgcaggaatatatcgcagtagttaaaaaactagatccaggttggaatcctcagataccagagaagaaaggaaaagaagcaaatacaggttttggtgggccagttattagttctctatatcatgaagaaaccatcagggaagaagacaaaaatatatttgattactgcagggaaaacaacattgaccatataaccaaagccatcaaatcgaaaaatgtggatgtgaatgtgaaagatgaagagggtagggctctacttcactgggcctgtgatcgaggacataaggaactagtcacagtgttgctgcaacatagagctgacattaactgtcaggacaatgaaggccaaacagctctacattatgcctctgcctgtgagtttctggatattgtagagctgctgctccagtctggtgctgaccccactctccgagaccaggatggctgcctgccagaggaggtgacaggctgcaaaacagtttctttggtgctgcagcggcacacaactggcaaggcttaatcaaaagactggaaaactgcagtctgtaatagcataaggcttccattatgaaagaaaactacaaaaataatacttcttttccacccgtctttctgagtagaatcctgggcccaaggggaaaggacaggaaagcaatggaacaccgactgcggagcttccatttgttctcctga

SEQ ID NO: 313082 - DNA, 2701 bp, Homo sapiens
cgcagggctgtttggaggcgcttggggcgcacaatctggggcaggcggaaccttagtcctcagcctcgcgtttcccgcgactccgctctcaccgctacactaccacacaaacggcctccttcccccacccccgggggcccatcccggtggcgggctccggagctcgggactgctaatttcagcgaaacgattaaaagacgcccctacagctgacggcactttctctcctccggcagggaaggacgtccagcgtagcgtcgcccgcgcttccccgccggcgcagagcaggcctcacagaatcgcacgccgctggcacgcacgccgccccgcccccacggcccagcgccagccgcgccccgcgctcgcacgcatcccggcctcactgcccctcgactcctgttccgttggaggggcctgaggcgagcctgagcgcgctgttggccggagggaagccggaggagaccgggtcgactgggcagagcggcagagggtcgaggagcctgctctgcacgcccagggagtagaagtgggcagggagcagggtcacgtgagggagcgcgccgcgactgagcttgggtccgactggagctcaggctcgcgacccagactggtgggccaggcctccaagccggccttacacccaatccaaggaggacagaccggacacagagggacggagcgagcaaggagacatggcttcatcattcctgcccgcgggggccatcaccggcgacagcggtggagagctgagctcaggggacgactccggggaggtggagttcccccatagccctgagatcgaggagaccagttgcctggccgagctgtttgagaaggctgccgcgcacctgcaaggcctgattcaggtggccagcagggagcagctcttgtacctgtatgccaggtacaaacaggtcaaagttggaaattgtaatactcctaaaccaagcttctttgattttgaaggaaagcaaaaatgggaagcttggaaagcacttggtgattcaagccccagccaagcaatgcaggaatatatcgcagtagttaaaaaactagatccaggttggaatcctcagataccagagaagaaaggaaaagaagcaaatacaggttttggtgggccagttattagttctctatatcatgaagaaaccatcagggaagaagacaaaaatatatttgattactgcagggaaaacaacattgaccatataaccaaagccatcaaatcgaaaaatgtggatgtgaatgtgaaagatgaagaggacaatgaaggccaaacagctctacattatgcctctgcctgtgagtttctggatattgtagagctgctgctccagtctggtgctgaccccactctccgagaccaggatggctgcctgccagaggaggtgacaggctgcaaaacagtttctttggtgctgcagcggcacacaactggcaaggcttaatcaaaagactggaaaactgcagtctgtaatagcataaggcttccattatgaaagaaaactacaaaaataatacttcttttccacccgtctttggtctcgctatgtcacccaggctgaagtgcagtggtatgatcatggttcactacagcctcaacctcctgggctcaaggaatcctcccacctcagcctcctgtgtagctgagatagctgggactacaggtgcgtgccaccacaccccactaatttttgtatcttttgtacagatagggtctctctgtgttcctcaggtggtctcaaactcctggcctcaagcagttttcaggcctcttaaagtgctgagattacaggtgtgagccactgtgcccagccaggtatgccactcttgaaactggctcccaacattttccctgtaagccccaaaagctccatctggggaattcactgacttttactattatataaggaaagtagatagttgacataggaagagaaatgaaataaaaaatgagttgagatgcaaagataaccacttaaaagataatttttctaacaggtgttactattaaaataatgagtaataaacttgcttagtatagtcctcaacggtgaagaagattttcattagcatgaactaacctgttctttggaataagcccctctataacagaaatgaggcatattagtgctgtttattttgtgatttttctatcttaacttcttattttctgagatataaaccaaaatcattcaccaagatgattcatttttgaaataatttaattaatctgtggaagtgatatgcatattagtacatactgaaatgctgtaattctagtagagcattctcttcactgtctgttctttcacaatccttgctacattgcaacctgctgtttagcttaagtctttcacattccacactaattgaatgtgttttaagaaacatacattagttatagtgaagtcaccaggatgatgccttcagtttttaattggtattactttgtgcattttttaagacattagcaaatcaaaaaccatttattcatttttaatttacagggtatttgagcaagaagctattaaggaactccttttttcatctctttagcagttcgaacttgatatttcttagacaagttttttattacctgttttgccgcatctaaaactgtatagattttaagcaaagaatataacttatcttttattttattttaaaggtttcaaatttatattcaaagctatca

SEQ ID NO: 313083 - DNA, 1041 bp, Homo sapiens
cgcagggctgtttggaggcgcttggggcgcacaatctggggcaggcggaaccttagtcctcagcctcgcgtttcccgcgactccgctctcaccgctacactaccacacaaacggcctccttcccccacccccgggggcccatcccggtggcgggctccggagctcgggactgctaatttcagcgaaacgattaaaagacgcccctacagctgacggcactttctctcctccggcagggaaggacgtccagcgtagcgtcgcccgcgcttccccgccggcgcagagcaggcctcacagaatcgcacgccgctggcacgcacgccgccccgcccccacggcccagcgccagccgcgccccgcgctcgcacgcatcccggcctcactgcccctcgactcctgttccgttggaggggcctgaggcgagcctgagcgcgctgttggccggagggaagccggaggagaccgggtcgactgggcagagcggcagagggtcgaggagcctgctctgcacgcccagggagtagaagtgggcagggagcagggtcacgtgagggagcgcgccgcgactgagcttgggtccgactggagctcaggctcgcgacccagactggtgggccaggcctccaagccggccttacacccaatccaaggaggacagaccggacacagagggacggagcgagcaaggagacatggcttcatcattcctgcccgcgggggccatcaccggcgacagcggtggagagctgagctcaggggacgactccggggaggtggagttcccccatagccctgagatcgaggagaccagttgcctggccgagctgtttgagaaggctgccgcgcacctgcaaggcctgattcaggtggccagcagggagcagctcttgtacctgtatgccaggtacaaacagtcaaattggaaattgtatactcctaaccaagcttcttgatttgaagaaacaaaatggaacttgaacactgtgatcaacccaccaactatcagatattccatagtaaactgatcagtggacctagatc

SEQ ID NO: 313084 - DNA, 1100 bp, Homo sapiens
cgcagggctgtttggaggcgcttggggcgcacaatctggggcaggcggaaccttagtcctcagcctcgcgtttcccgcgactccgctctcaccgctacactaccacacaaacggcctccttcccccacccccgggggcccatcccggtggcgggctccggagctcgggactgctaatttcagcgaaacgattaaaagacgcccctacagctgacggcactttctctcctccggcagggaaggacgtccagcgtagcgtcgcccgcgcttccccgccggcgcagagcaggcctcacagaatcgcacgccgctggcacgcacgccgccccgcccccacggcccagcgccagccgcgccccgcgctcgcacgcatcccggcctcactgcccctcgactcctgttccgttggaggggcctgaggcgagcctgagcgcgctgttggccggagggaagccggaggagaccgggtcgactgggcagagcggcagagggtcgaggagcctgctctgcacgcccagggagtagaagtgggcagggagcagggtcacgtgagggagcgcgccgcgactgagcttgggtccgactggagctcaggctcgcgacccagactggtgggccaggcctccaagccggccttacacccaatccaaggaggacagaccggacacagagggacggagcgagcaaggagacatggcttcatcattcctgcccgcgggggccatcaccggcgacagcggtggagagctgagctcaggggacgactccggggaggtggagttcccccatagccctgagatcgaggagaccagttgcctggccgagctgtttgagaaggctgccgcgcacctgcaaggcctgattcaggtggccagcagggagcagctcttgtacctgtatgccaggtacaaacagagggtctgggtttcaccacatttcccaggctggtcttgaactcctgagctcagacgatccacctgcccaaagtgctgggattacaggcatgagccactgcacctggctgacacttttttttttttttttttgagatggagttttgctcctgttgcccaggctggagtgcagtggctggatcttagc

SEQ ID NO: 313085 - DNA, 309 bp, Homo sapiens
ctagtcacagtgttgctgcaacatagagctgacattaactgtcaggtaagagtgataaagaagagcttttattttttaaattgaagtataattcgcataacataaaatttaccagattaactcttttgaaatgtgcaattcagtggcgtttagtacatttcacaatgttgtgtaatcattgctactatatagttccgtaatactgttgtcaccgcaaaagaaaaccctgttcccactaagcagtcactttttaacattttttttatttctccccttgccccagaccttggcaaccactaatctgctttc

SEQ ID NO: 313086 - DNA, 1180 bp, Homo sapiens
ggcacgagggatttttgtccttagaagcactgaaggaacctgcaataaggtgaggaggtagacgcgccgcgactgagcttgggtccgactggagctcaggctcgcgacccagactggtgggccaggcctccaagccggccttacacccaatccaaggaggacagaccggacacagagggacggagcgagcaaggagacatggcttcatcattcctgcccgcgggggccatcaccggcgacagcggtggagagctgagctcaggggacgactccggggaggtggagttcccccatagccctgagatcgaggagaccagttgcctggccgagctgtttgagaaggctgccgcgcacctgcaaggcctgattcaggtggccagcagggagcagctcttgtacctgtatgccaggtacaaacaggtcaaagttggaaattgtaatactcctaaaccaagcttctttgattttgaaggaaagcaaaaatgggaagcttggaaagcacttggtgattcaagccccagccaagcaatgcaggaatatatcgcagtagttaaaaaactagatccaggttggaatcctcagataccagagaagaaaggaaaagaagcaaatacaggttttggtgggccagttattagttctctatatcatgaagaaaccatcagggaagaagacaaaaatatatttgattactgcagggaaaacaacattgaccatataaccaaagccatcaaatcgaaaaatgtggatgtgaatgtgaaagatgaagagggtagggctctacttcactgggcctgtgatcgaggacataaggaactagtcacagtgttgctgcaacatagagctgacattaactgtcaggacaatgaaggccaaacagctctacattatgcctctgcctgtgagtttctggatattgtagagctgctgctccagtctggtgctgaccccactctccgagaccaggatggctgcctgccagaggaggtgacaggctgcaaaacagtttctttggtgctgcagcggcacacaactggcaaggcttaatcaaaagactggaaaactgcagtctgtaatagcataaggcttccattatgaaagaaaactacaaaaataatacttcttttccacccgtctttggtatgtattggctaataaaatcagttctgtggaactggga

SEQ ID NO: 313087 - DNA, 1674 bp, Homo sapiens
cgcagggctgtttggaggcgcttggggcgcacaatctggggcaggcggaaccttagtcctcagcctcgcgtttcccgcgactccgctctcaccgctacactaccacacaaacggcctccttcccccacccccgggggcccatcccggtggcgggctccggagctcgggactgctaatttcagcgaaacgattaaaagacgcccctacagctgacggcactttctctcctccggcagggaaggacgtccagcgtagcgtcgcccgcgcttccccgccggcgcagagcaggcctcacagaatcgcacgccgctggcacgcacgccgccccgcccccacggcccagcgccagccgcgccccgcgctcgcacgcatcccggcctcactgcccctcgactcctgttccgttggaggggcctgaggcgagcctgagcgcgctgttggccggagggaagccggaggagaccgggtcgactgggcagagcggcagagggtcgaggagcctgctctgcacgcccagggagtagaagtgggcagggagcagggtcacgtgagggagcgcgccgcgactgagcttgggtccgactggagctcaggctcgcgacccagactggtgggccaggcctccaagccggccttacacccaatccaaggaggacagaccggacacagagggacggagcgagcaaggagacatggcttcatcattcctgcccgcgggggccatcaccggcgacagcggtggagagctgagctcaggggacgactccggggaggtggagttcccccatagccctgagatcgaggagaccagttgcctggccgagctgtttgagaaggctgccgcgcacctgcaaggcctgattcaggtggccagcagggagcagctcttgtacctgtatgccaggtacaaacaggtcaaagttggaaattgtaatactcctaaaccaagcttctttgattttgaaggaaagcaaaaatgggaagcttggaaagcacttggtgattcaagccccagccaagcaatgcaggaatatatcgcagtagttaaaaaactagatccaggttggaatcctcagataccagagaagaaaggaaaagaagcaaatacaggttttggtgggccagttattagttctctatatcatgaagaaaccatcagggaagaagacaaaaatatatttgattactgcagggaaaacaacattgaccatataaccaaagccatcaaatcgaaaaatgtggatgtgaatgtgaaagatgaagagggtagggctctacttcactgggcctgtgatcgaggacataaggaactagtcacagtgttgctgcaacatagagctgacattaactgtcaggacaatgaaggccaaacagctctacattatgcctctgcctgtgagtttctggatattgtagagctgctgctccagtctggtgctgaccccactctccgagaccaggatggctgcctgccagaggaggtgacaggctgcaaaacagtttctttggtgctgcagcggcacacaactggcaaggcttaatcaaaagactggaaaactgcagtctgtaatagcataaggcttccattatgaaagaaaactacaaaaataatacttcttttccacccgtctttggtatgtattggctaataaaatcagttctgtggaactggga

SEQ ID NO: 313088 - DNA, 2083 bp, Homo sapiens
cgcagggctgtttggaggcgcttggggcgcacaatctggggcaggcggaaccttagtcctcagcctcgcgtttcccgcgactccgctctcaccgctacactaccacacaaacggcctccttcccccacccccgggggcccatcccggtggcgggctccggagctcgggactgctaatttcagcgaaacgattaaaagacgcccctacagctgacggcactttctctcctccggcagggaaggacgtccagcgtagcgtcgcccgcgcttccccgccggcgcagagcaggcctcacagaatcgcacgccgctggcacgcacgccgccccgcccccacggcccagcgccagccgcgccccgcgctcgcacgcatcccggcctcactgcccctcgactcctgttccgttggaggggcctgaggcgagcctgagcgcgctgttggccggagggaagccggaggagaccgggtcgactgggcagagcggcagagggtcgaggagcctgctctgcacgcccagggagtagaagtgggcagggagcagggtcacgtgagggagcgcgccgcgactgagcttgggtccgactggagctcaggctcgcgacccagactggtgggccaggcctccaagccggccttacacccaatccaaggaggacagaccggacacagagggacggagcgagcaaggagacatggcttcatcattcctgcccgcgggggccatcaccggcgacagcggtggagagctgagctcaggggacgactccggggaggtggagttcccccatagccctgagatcgaggagaccagttgcctggccgagctgtttgagaaggctgccgcgcacctgcaaggcctgattcaggtggccagcagggagcagctcttgtacctgtatgccaggtacaaacaggtcaaagttggaaattgtaatactcctaaaccaagcttctttgattttgaaggaaagcaaaaatgggaagcttggaaagcacttggtgattcaagccccagccaagcaatgcaggaatatatcgcagtagttaaaaaactagatccaggttggaatcctcagataccagagaagaaaggaaaagaagcaaatacaggttttggtgggccagttattagttctctatatcatgaagaaaccatcagggaagaagacaaaaatatatttgattactgcagggaaaacaacattgaccatataaccaaagccatcaaatcgaaaaatgtggatgtgaatgtgaaagatgaagagggtagggctctacttcactgggcctgtgatcgaggacataaggaactagtcacagtgttgctgcaacatagagctgacattaactgtcaggacaatgaaggccaaacagctctacattatgcctctgcctgtgagtttctggatattgtagagctgctgctccagtctggtgctgaccccactctccgagaccaggatggctgcctgccagaggaggtgacaggctgcaaaacagtttctttggtgctgcagcggcacacaactggcaaggcttaatcaaaagactggaaaactgcagtctgtaatagcataaggcttccattatgaaagaaaactacaaaaataatacttcttttccacccgtctttggtatgtattggctaataaaatcagttctgtggaactgggaaaaaaaaaaaaaaaaaaaaaaaaaaaaaaaaaaaaaaaaaaaagaaaaaaaaaaaaaaaaaaaaaaaaaaaaaaaaaaaaaaaaaaaaaaaaaaaaaaaaaaaaaaaaaaaaaaaaaaagaaaaaacaaggggggggccgcggatgaaaacgacgcgaggggaacgaacaaaccataagagcaacccacaactaaatagataaaagggagaggccgcaccacatgaagcaggaaaactaaaaaaacagataccgacagacatgccgacataaaaaacaacacagcgggaaggcgaaaacaaccaaatccaaaccggactgcggacagaggaaggaaacacaccacaacacgagatggggggagacacacagacgaacaacacacaaccaggaaacaaacaccagccaac

SEQ ID NO: 313089 - DNA, 2791 bp, Homo sapiens
cgcagggctgtttggaggcgcttggggcgcacaatctggggcaggcggaaccttagtcctcagcctcgcgtttcccgcgactccgctctcaccgctacactaccacacaaacggcctccttcccccacccccgggggcccatcccggtggcgggctccggagctcgggactgctaatttcagcgaaacgattaaaagacgcccctacagctgacggcactttctctcctccggcagggaaggacgtccagcgtagcgtcgcccgcgcttccccgccggcgcagagcaggcctcacagaatcgcacgccgctggcacgcacgccgccccgcccccacggcccagcgccagccgcgccccgcgctcgcacgcatcccggcctcactgcccctcgactcctgttccgttggaggggcctgaggcgagcctgagcgcgctgttggccggagggaagccggaggagaccgggtcgactgggcagagcggcagagggtcgaggagcctgctctgcacgcccagggagtagaagtgggcagggagcagggtcacgtgagggagcgcgccgcgactgagcttgggtccgactggagctcaggctcgcgacccagactggtgggccaggcctccaagccggccttacacccaatccaaggaggacagaccggacacagagggacggagcgagcaaggagacatggcttcatcattcctgcccgcgggggccatcaccggcgacagcggtggagagctgagctcaggggacgactccggggaggtggagttcccccatagccctgagatcgaggagaccagttgcctggccgagctgtttgagaaggctgccgcgcacctgcaaggcctgattcaggtggccagcagggagcagctcttgtacctgtatgccaggtacaaacaggtcaaagttggaaattgtaatactcctaaaccaagcttctttgattttgaaggaaagcaaaaatgggaagcttggaaagcacttggtgattcaagccccagccaagcaatgcaggaatatatcgcagtagttaaaaaactagatccaggttggaatcctcagataccagagaagaaaggaaaagaagcaaatacaggttttggtgggccagttattagttctctatatcatgaagaaaccatcagggaagaagacaaaaatatatttgattactgcagggaaaacaacattgaccatataaccaaagccatcaaatcgaaaaatgtggatgtgaatgtgaaagatgaagagggtagggctctacttcactgggcctgtgatcgaggacataaggaactagtcacagtgttgctgcaacatagagctgacattaactgtcaggacaatgaaggccaaacagctctacattatgcctctgcctgtgagtttctggatattgtagagctgctgctccagtctggtgctgaccccactctccgagaccaggatggctgcctgccagaggaggtgacaggctgcaaaacagtttctttggtgctgcagcggcacacaactggcaaggcttaatcaaaagactggaaaactgcagtctgtaatagcataaggcttccattatgaaagaaaactacaaaaataatacttcttttccacccgtctttggtctcgctatgtcacccaggctgaagtgcagtggtatgatcatggttcactacagcctcaacctcctgggctcaaggaatcctcccacctcagcctcctgtgtagctgagatagctgggactacaggtgcgtgccaccacaccccactaatttttgtatcttttgtacagatagggtctctctgtgttcctcaggtggtctcaaactcctggcctcaagcagttttcaggcctcttaaagtgctgagattacaggtgtgagccactgtgcccagccaggtatgccactcttgaaactggctcccaacattttccctgtaagccccaaaagctccatctggggaattcactgacttttactattatataaggaaagtagatagttgacataggaagagaaatgaaataaaaaatgagttgagatgcaaagataaccacttaaaagataatttttctaacaggtgttactattaaaataatgagtaataaacttgcttagtatagtcctcaacggtgaagaagattttcattagcatgaactaacctgttctttggaataagcccctctataacagaaatgaggcatattagtgctgtttattttgtgatttttctatcttaacttcttattttctgagatataaaccaaaatcattcaccaagatgattcatttttgaaataatttaattaatctgtggaagtgatatgcatattagtacatactgaaatgctgtaattctagtagagcattctcttcactgtctgttctttcacaatccttgctacattgcaacctgctgtttagcttaagtctttcacattccacactaattgaatgtgttttaagaaacatacattagttatagtgaagtcaccaggatgatgccttcagtttttaattggtattactttgtgcattttttaagacattagcaaatcaaaaaccatttattcatttttaatttacagggtatttgagcaagaagctattaaggaactccttttttcatctctttagcagttcgaacttgatatttcttagacaagttttttattacctgttttgccgcatctaaaactgtatagattttaagcaaagaatataacttatcttttattttattttaaaggtttcaaatttatattcaaagctatca

SEQ ID NO: 313090 - DNA, 2943 bp, Homo sapiens
cgcagggctgtttggaggcgcttggggcgcacaatctggggcaggcggaaccttagtcctcagcctcgcgtttcccgcgactccgctctcaccgctacactaccacacaaacggcctccttcccccacccccgggggcccatcccggtggcgggctccggagctcgggactgctaatttcagcgaaacgattaaaagacgcccctacagctgacggcactttctctcctccggcagggaaggacgtccagcgtagcgtcgcccgcgcttccccgccggcgcagagcaggcctcacagaatcgcacgccgctggcacgcacgccgccccgcccccacggcccagcgccagccgcgccccgcgctcgcacgcatcccggcctcactgcccctcgactcctgttccgttggaggggcctgaggcgagcctgagcgcgctgttggccggagggaagccggaggagaccgggtcgactgggcagagcggcagagggtcgaggagcctgctctgcacgcccagggagtagaagtgggcagggagcagggtcacgtgagggagcgcgccgcgactgagcttgggtccgactggagctcaggctcgcgacccagactggtgggccaggcctccaagccggccttacacccaatccaaggaggacagaccggacacagagggacggagcgagcaaggagacatggcttcatcattcctgcccgcgggggccatcaccggcgacagcggtggagagctgagctcaggggacgactccggggaggtggagttcccccatagccctgagatcgaggagaccagttgcctggccgagctgtttgagaaggctgccgcgcacctgcaaggcctgattcaggtggccagcagggagcagctcttgtacctgtatgccaggtacaaacaggtcaaagttggaaattgtaatactcctaaaccaagcttctttgattttgaaggaaagcaaaaatgggaagcttggaaagcacttggtgattcaagccccagccaagcaatgcaggaatatatcgcagtagttaaaaaactagatccaggttggaatcctcagataccagagaagaaaggaaaagaagcaaatacaggttttggtgggccagttattagttctctatatcatgaagaaaccatcagggaagaagacaaaaatatatttgattactgcagggaaaacaacattgaccatataaccaaagccatcaaatcgaaaaatgtggatgtgaatgtgaaagatgaagagggtagggctctacttcactgggcctgtgatcgaggacataaggaactagtcacagtgttgctgcaacatagagctgacattaactgtcaggtaccagctcagccacaatgggctagaacgccaagcgggctgttggggtgcctgattccatgcctaggctcttggacagctttggaccagacaagccttggatagccttctggacttgtcgtgggccagaggggagcccactgccctgaagggacaatgaaggccaaacagctctacattatgcctctgcctgtgagtttctggatattgtagagctgctgctccagtctggtgctgaccccactctccgagaccaggatggctgcctgccagaggaggtgacaggctgcaaaacagtttctttggtgctgcagcggcacacaactggcaaggcttaatcaaaagactggaaaactgcagtctgtaatagcataaggcttccattatgaaagaaaactacaaaaataatacttcttttccacccgtctttggtctcgctatgtcacccaggctgaagtgcagtggtatgatcatggttcactacagcctcaacctcctgggctcaaggaatcctcccacctcagcctcctgtgtagctgagatagctgggactacaggtgcgtgccaccacaccccactaatttttgtatcttttgtacagatagggtctctctgtgttcctcaggtggtctcaaactcctggcctcaagcagttttcaggcctcttaaagtgctgagattacaggtgtgagccactgtgcccagccaggtatgccactcttgaaactggctcccaacattttccctgtaagccccaaaagctccatctggggaattcactgacttttactattatataaggaaagtagatagttgacataggaagagaaatgaaataaaaaatgagttgagatgcaaagataaccacttaaaagataatttttctaacaggtgttactattaaaataatgagtaataaacttgcttagtatagtcctcaacggtgaagaagattttcattagcatgaactaacctgttctttggaataagcccctctataacagaaatgaggcatattagtgctgtttattttgtgatttttctatcttaacttcttattttctgagatataaaccaaaatcattcaccaagatgattcatttttgaaataatttaattaatctgtggaagtgatatgcatattagtacatactgaaatgctgtaattctagtagagcattctcttcactgtctgttctttcacaatccttgctacattgcaacctgctgtttagcttaagtctttcacattccacactaattgaatgtgttttaagaaacatacattagttatagtgaagtcaccaggatgatgccttcagtttttaattggtattactttgtgcattttttaagacattagcaaatcaaaaaccatttattcatttttaatttacagggtatttgagcaagaagctattaaggaactccttttttcatctctttagcagttcgaacttgatatttcttagacaagttttttattacctgttttgccgcatctaaaactgtatagattttaagcaaagaatataacttatcttttattttattttaaaggtttcaaatttatattcaaagctatca

SEQ ID NO: 313091 - DNA, 2235 bp, Homo sapiens
cgcagggctgtttggaggcgcttggggcgcacaatctggggcaggcggaaccttagtcctcagcctcgcgtttcccgcgactccgctctcaccgctacactaccacacaaacggcctccttcccccacccccgggggcccatcccggtggcgggctccggagctcgggactgctaatttcagcgaaacgattaaaagacgcccctacagctgacggcactttctctcctccggcagggaaggacgtccagcgtagcgtcgcccgcgcttccccgccggcgcagagcaggcctcacagaatcgcacgccgctggcacgcacgccgccccgcccccacggcccagcgccagccgcgccccgcgctcgcacgcatcccggcctcactgcccctcgactcctgttccgttggaggggcctgaggcgagcctgagcgcgctgttggccggagggaagccggaggagaccgggtcgactgggcagagcggcagagggtcgaggagcctgctctgcacgcccagggagtagaagtgggcagggagcagggtcacgtgagggagcgcgccgcgactgagcttgggtccgactggagctcaggctcgcgacccagactggtgggccaggcctccaagccggccttacacccaatccaaggaggacagaccggacacagagggacggagcgagcaaggagacatggcttcatcattcctgcccgcgggggccatcaccggcgacagcggtggagagctgagctcaggggacgactccggggaggtggagttcccccatagccctgagatcgaggagaccagttgcctggccgagctgtttgagaaggctgccgcgcacctgcaaggcctgattcaggtggccagcagggagcagctcttgtacctgtatgccaggtacaaacaggtcaaagttggaaattgtaatactcctaaaccaagcttctttgattttgaaggaaagcaaaaatgggaagcttggaaagcacttggtgattcaagccccagccaagcaatgcaggaatatatcgcagtagttaaaaaactagatccaggttggaatcctcagataccagagaagaaaggaaaagaagcaaatacaggttttggtgggccagttattagttctctatatcatgaagaaaccatcagggaagaagacaaaaatatatttgattactgcagggaaaacaacattgaccatataaccaaagccatcaaatcgaaaaatgtggatgtgaatgtgaaagatgaagagggtagggctctacttcactgggcctgtgatcgaggacataaggaactagtcacagtgttgctgcaacatagagctgacattaactgtcaggtaccagctcagccacaatgggctagaacgccaagcgggctgttggggtgcctgattccatgcctaggctcttggacagctttggaccagacaagccttggatagccttctggacttgtcgtgggccagaggggagcccactgccctgaagggacaatgaaggccaaacagctctacattatgcctctgcctgtgagtttctggatattgtagagctgctgctccagtctggtgctgaccccactctccgagaccaggatggctgcctgccagaggaggtgacaggctgcaaaacagtttctttggtgctgcagcggcacacaactggcaaggcttaatcaaaagactggaaaactgcagtctgtaatagcataaggcttccattatgaaagaaaactacaaaaataatacttcttttccacccgtctttggtatgtattggctaataaaatcagttctgtggaactgggaaaaaaaaaaaaaaaaaaaaaaaaaaaaaaaaaaaaaaaaaaaagaaaaaaaaaaaaaaaaaaaaaaaaaaaaaaaaaaaaaaaaaaaaaaaaaaaaaaaaaaaaaaaaaaaaaaaaaaagaaaaaacaaggggggggccgcggatgaaaacgacgcgaggggaacgaacaaaccataagagcaacccacaactaaatagataaaagggagaggccgcaccacatgaagcaggaaaactaaaaaaacagataccgacagacatgccgacataaaaaacaacacagcgggaaggcgaaaacaaccaaatccaaaccggactgcggacagaggaaggaaacacaccacaacacgagatggggggagacacacagacgaacaacacacaaccaggaaacaaacaccagccaac

SEQ ID NO: 313092 - DNA, 861 bp, Homo sapiens
ccaaagtgctggggttacagacgtgagccaccgcacctagctcagtgacacaatcttgatctagtgtttcattcacttaattcaagacaaaggaggcctttgctggaaaatgcatcttttctgcttttaccctacatagttcacagacactctctgcagttactaaacggggtggcctgagtaatcctgatctttaagcaaggatcttttctaaactctgagtggtatgggtaagaaaaagaaaagaaatatctcggtcttctgcagtgaaattgatttttctaatgctcctggaaatactgttttagagtagaaaaataagtggagccaggcactagaatcataggaaaatactttttccaaattgagaagggaacatacgtacatacataaatttggtaaccaaaatgcattttttcttttttcttttaatctaccatttgaaatctaaaatactgtgataaaaactgtcaaaagtgaaaatttgtttatgaaaggtatattgtttaatacatcctctactatagagtgatcagaagcaaaagaagtaaattaatgaaacatcaagaccccactcatctcagcactaagtctgtcagcaccaccatccttcctaaaggaaataaattaaacttgattccttaaggtactacaggaatcagagacaaaagtggaaagaacaaattaaggttggagagaaattttcagtttaaagtttatagatatgaagaaaattcttattttacccattaagaacaaatacagaagtgaaattttcttactggtagtcagtggtcagatatagctacattttccccttaagtcataccacccaactctagcttccaaaaaatgttgaaa

SEQ ID NO: 313093 - DNA, 1804 bp, Homo sapiens
  misc_feature (1603)..(1603): n is a, c, g, or t
  misc_feature (1626)..(1626): n is a, c, g, or t
  misc_feature (1645)..(1645): n is a, c, g, or t
  misc_feature (1664)..(1664): n is a, c, g, or t
  misc_feature (1673)..(1673): n is a, c, g, or t
caacagttccagttacaacagctccagttacaacagctccagttcaacagctccagttacaacagctccgctgatgaaagttagagctgcttcctccaggcagccctgggagtaggggcacagacttgtgcctcgcttcccagcagctgcccagtgcctctgtccacacccacctccctggtgtacttgccccctacagcagcagcccagatcctcccctggattaaaattgcaactggtgccctaacccaaaacttgagaaaaaattctctatcacatccactcttctggcatttgtagaatctctggccctgggtgtgtcttttcctgtagctgttacagatttcttaagcagatttcttaagcagatggacatgtccagattcatgcctaaatatccagttgataactggaaaatgctggttcacggttctttagtaaagattaataagggatccccatgtgctggggagtgtgcttccatttgagtggggatatcagaagaaaaagaggggcttgtgtagtaaaccttactttgccaattcagctgtagagcccaaattgttacaagatgcaaagatgtactccactttttgaccaagcatcagcacctttggcttaccatccagtccttacttctgtgactgtaagggccccaccagtgtcagcagacttgtttgtgctttgggggaactctcttctcagctccctttgccagtcccaagcctggtggatctgcatctcacgcccactgcacaccgttcctctccatctgcccttccctcccaggcccccggtcgggggagcaggtgtggcaagtgttaggaactcccttctggtgacagctggtcttcctagagtgttgctggtaactatcgcctcttggtcttctgacatcattgccaggaacggggcactttttcgtcttgtagtttggccctcgggtttcctcactaggtattgtgtaactccctcaaaaaaaggtttatgaaatgctgaacctcaggtttcatagacgtctttgtacactaaaaattctgcagcagaatatttttaaacattcgcagttttttgtaagctatatttttgtatatttaattgctattttaaaattttaatgcattttgctaatcactcctcaaaaataaaacatgcatgtaattgactcaaacgtgtaaataaaagcaaattttgaaaaatagtgttgtgcatatgcctttgaacagagggaacatccatgtgccactgacgcaagcaccttcagcaagacttggaaactcaaggtgagtaattctatcagagctggtaactagtactgagtgattgtgatggaagcccctgcccttcctgtggcatagtgtgcaagcgggggtggggtcagtggtgaagagtgtgtcaggccaccacagccagagaacagagaatcctggaatgcagagtacagtggagtctgaagccccctggcctccctgagctctgcaaacagctggatacagataagcagtcttccacgtgaacgccagcaccagggtgacctgaaatagcctcgtgccgaattcggcacgagcacacatcacaggcttaaactgtcttagagactttncaagtgattggatcacaggctanggatctgtgcatggtgccngttgaaacccaagtcttcncagtgctangtgagggagggctcaaccggggtaatgtgaatggggctgttgtcttttgcaatcccttaacatattaactttggacaaaccttgataggcttgcaccaaacctttctaaacatttttatggatcatctcct

SEQ ID NO: 313094 - DNA, 1750 bp, Homo sapiens
  misc_feature (1549)..(1549): n is a, c, g, or t
  misc_feature (1572)..(1572): n is a, c, g, or t
  misc_feature (1591)..(1591): n is a, c, g, or t
  misc_feature (1610)..(1610): n is a, c, g, or t
  misc_feature (1619)..(1619): n is a, c, g, or t
caacagttccagttacaacagctccagttacaacagctccagttcaacagctccagttacaacagctccgctgatgaaagttagagctgcttcctccaggcagccctgggagtaggggcacagacttgtgcctcgcttcccagcagctgcccagtgcctctgtccacacccacctccctggtgtacttgccccctacagcagcagcccagatcctcccctggattaaaattgcaactggtgccctaacccaaaacttgagaaaaaattctctatcacatccactcttctggcatttgtagaatctctggccctgggtgtgtcttttcctgtagctgttacagatttcttaagcagatttcttaagcagatggacatgtccagattcatgcctaaatatccagttgataactggaaaatgctggttcacggttctttagtaaagattaataagggatccccatgtgctggggagtgtgcttccatttgagtggggatatcagaagaaaaagaggggcttgtgtagtaaaccttactttgccaattcagctgtagagcccaaattgttacaagatgcaaagatgtactccactttttgaccaagcatcagcacctttggcttaccatccagtccttacttctgtgactgtaagggccccaccagtgtcagcagacttgtttgtgctttgggggaactctcttctcagctccctttgccagtcccaagcctggtggatctgcatctcacgcccactgcacaccgttcctctccatctgcccttccctcccaggcccccggtcgggggagcaggtgtggcaagtgttaggaactcccttctggtgacagctggtcttcctagagtgttgctggtaactatcgcctcttggtcttctgacatcattgccaggaacggggcactttttcgtcttgtagtttggccctcgggtttcctcactaggtattgtgtaactccctcaaaaaaaggtttatgaaatgctgaacctcaggtttcatagacgtctttgtacactaaaaattctgcagcagaatatttttaaacattcgcagttttttgtaagctatatttttgtatatttaattgctattttaaaattttaatgcattttgctaatcactcctcaaaaataaaacatgcatgtaattgactcaaacgtgtaaataaaagcaaattttgacgcaagcaccttcagcaagacttggaaactcaaggtgagtaattctatcagagctggtaactagtactgagtgattgtgatggaagcccctgcccttcctgtggcatagtgtgcaagcgggggtggggtcagtggtgaagagtgtgtcaggccaccacagccagagaacagagaatcctggaatgcagagtacagtggagtctgaagccccctggcctccctgagctctgcaaacagctggatacagataagcagtcttccacgtgaacgccagcaccagggtgacctgaaatagcctcgtgccgaattcggcacgagcacacatcacaggcttaaactgtcttagagactttncaagtgattggatcacaggctanggatctgtgcatggtgccngttgaaacccaagtcttcncagtgctangtgagggagggctcaaccggggtaatgtgaatggggctgttgtcttttgcaatcccttaacatattaactttggacaaaccttgataggcttgcaccaaacctttctaaacatttttatggatcatctcct

SEQ ID NO: 313095 - DNA, 1697 bp, Homo sapiens
  misc_feature (1496)..(1496): n is a, c, g, or t
  misc_feature (1519)..(1519): n is a, c, g, or t
  misc_feature (1538)..(1538): n is a, c, g, or t
  misc_feature (1557)..(1557): n is a, c, g, or t
  misc_feature (1566)..(1566): n is a, c, g, or t
caacagttccagttacaacagctccagttacaacagctccagttcaacagctccagttacaacagctccgctgatgaaagttagagctgcttcctccaggcagccctgggagtaggggcacagacttgtgcctcgcttcccagcagctgcccagtgcctctgtccacacccacctccctggtgtacttgccccctacagcagcagcccagatcctcccctggattaaaattgcaactggtgccctaacccaaaacttgagaaaaaattctctatcacatccactcttctggcatttgtagaatctctggccctgggtgtgtcttttcctgtagctgttacagatttcttaagcagatttcttaagcagatggacatgtccagattcatgcctaaatatccagttgataactggaaaatgctggttcacggttctttagtaaagattaataagggatccccatgtgctggggagtgtgcttccatttgagtggggatatcagaagaaaaagaggggcttgtgtagtaaaccttactttgccaattcagctgtagagcccaaattgttacaagatgcaaagatgtactccactttttgaccaagcatcagcacctttggcttaccatccagtccttacttctgtgactgtaagggccccaccagtgtcagcagacttgtttgtgctttgggggaactctcttctcagctccctttgccagtcccaagcctggtggatctgcatctcacgcccactgcacaccgttcctctccatctgcccttccctcccaggcccccggtcgggggagcaggtgtggcaagtgttaggaactcccttctggtgacagctggtcttcctagagtgttgctgtcgtcttgtagtttggccctcgggtttcctcactaggtattgtgtaactccctcaaaaaaaggtttatgaaatgctgaacctcaggtttcatagacgtctttgtacactaaaaattctgcagcagaatatttttaaacattcgcagttttttgtaagctatatttttgtatatttaattgctattttaaaattttaatgcattttgctaatcactcctcaaaaataaaacatgcatgtaattgactcaaacgtgtaaataaaagcaaattttgacgcaagcaccttcagcaagacttggaaactcaaggtgagtaattctatcagagctggtaactagtactgagtgattgtgatggaagcccctgcccttcctgtggcatagtgtgcaagcgggggtggggtcagtggtgaagagtgtgtcaggccaccacagccagagaacagagaatcctggaatgcagagtacagtggagtctgaagccccctggcctccctgagctctgcaaacagctggatacagataagcagtcttccacgtgaacgccagcaccagggtgacctgaaatagcctcgtgccgaattcggcacgagcacacatcacaggcttaaactgtcttagagactttncaagtgattggatcacaggctanggatctgtgcatggtgccngttgaaacccaagtcttcncagtgctangtgagggagggctcaaccggggtaatgtgaatggggctgttgtcttttgcaatcccttaacatattaactttggacaaaccttgataggcttgcaccaaacctttctaaacatttttatggatcatctcct

SEQ ID NO: 313096 - DNA, 988 bp, Homo sapiens
ttggcccactgcaagctccgcctcccaggttcacgccattctcccgcctcgggagctgggacaacaggtgcccgccaccacgctcggctaattttttgtatttttagtacagacggagtttcaccgtgttagccaggatggtctcgatctcctgacctcgtgatgcacctgccttgacctcccaaagtgctgggattacaggcgtgagccactgcgcccggccaataatttttttagtttaagttcatttttgtccccgctgatgaaagttagagctgcttcctccaggcagccctgggagtaggggcacagacttgtgcctcgcttcccagcagctgcccagtgcctctgtccacacccacctccctggtgtacttgccccctacagcagcagcccagatcctcccctggattaaaattgcaactggtgccctaacccaaaacttgagaaaaaattctctatcacatccactcttctggcatttgtagaatctctggccctgggtgtgtcttttcctgtagctgttacagatttcttaagcagatttcttaagcagatggacatgtccagattcatgcctaaatatccagttgataactggaaaatgctggttcacggttctttagtaaagattaataagggatccccatgtgctggggagtgtgcttccatttgagtggggatatcagaagaaaaagaggggcttgtgtagtaaaccttactttgccaattcagctgtagagcccaaattgttacaagatgcaaagatgtactccactttttgaccaagcatcagcacctttggcttaccatccagtccttacttctgtgactgtaagggccccaccagtgtcagcagacttgtttgtgctttgggggaactctcttctcagctccctttgccagtcccaagcctggtggatctgcatctcacgcccactgcacaccgttcctctccatctgcccttccctcccaggcccccggtc

SEQ ID NO: 313097 - DNA, 592 bp, Homo sapiens
tttttttttttgccgaggcaggtgtgcaatggtgtggtctcggctaactgcagcctccgcctcctgggttcaagcaattctcctgcctcagcctcccaagtagctgggattacaggcacccaccaccacacccggctaatttttttgtatttttagtacagacggcgtttcaccgtgttggccaggctggtgttgaactcctgacctcaggtgatccgcctgccttggcctcccaaagtgctgggattacaggcatgagccaccacacctggcgcgagctcttgatttttgttttaacttttaaacgaaattaaactggacaagtgtaatcttttatgtgaaaagttgtttttgtgtaaaaaaaaaaaaaaaacaagtttctgaaactgagttttaatgattagtaacaacctacatgccaaatgaaatagtttttctaagattgtattaacttagagctctctgcattgttcaacccagatcactaaattgattggtgaaattccgtttctccttgatttctgttgacattgtatatccatgttttttcttcttcctctctacctttagtgattctattctgacactatct

SEQ ID NO: 313098 - DNA, 3835 bp, Homo sapiens
agcggagcccctctacctccggaagagacgagtgcggtaacaccgttcacagagctagccggacgtcctccgactcaagatatttgtcaaatattttcagaagatggctgatccttggcaggaatgcatggattatgcagtaactctagcaagacaagctggagaggtagtttgtgaagctataaaaaatgaaatgaatgttatgctgaaaagttctccagttgatttggtaactgctacggaccaaaaagttgaaaaaatgcttatctcttccataaaggaaaagtatccatctcacagtttcattggtgaagaatctgtggcagctggggaaaaaagtatcttaaccgacaaccccacatggatcattgaccctattgatggaacaactaactttgtacatagatttccttttgtagctgtttcaattggctttgctgtaaataaaaagatagaatttggagttgtgtacagttgtgtggaaggcaagatgtacactgccagaaaaggaaaaggtgccttttgtaatggtcaaaaactacaagtttcacaacaagaagatattaccaaatctctcttggtgactgagttgggctcttccagaacaccagagactgtgagaatggttctttctaatatggaaaagcttttttgcattcctgttcatgggatccggagtgttggaacagcagctgttaatatgtgccttgtggcaactggcggagcagatgcatattatgaaatgggaattcactgctgggatgttgcaggagctggcattattgttactgaagctggtggcgtgctaatggatgttacaggtggaccatttgatttgatgtcacgaagagtaattgctgcaaataatagaatattagcagaaaggatagctaaagaaattcaggttatacctttgcaacgagacgacgaagattaattaaggcagcctcatagtcaatcccagttgcttttccccagatttggtgactcatcaatggatatgtgttttggatgtatgatatgcttggtttaaattctctttgtccaggtcaaaaatttggaacttgtttcttattttactatgtctaggtttgcaagaattgacataatgtttgtttcactgatttaaaaaattttgcatgtaagaatgtactttaggaaacatacccaggaagtacagttgataaatataacatcaactgaaatagtcaattagcaattttgtgtttctaaatatctatggtcccctgaaattttgacttagtatataggtgcagagacacccacttagaaagttaactgtttggaaaaacatttctctttagtttcaaaaaccatatataattaaatttgtaaggatatactgagtaccctaggccaacttttttttctttgcagagaaccttttttgttttattcttcagtgttcatatagcacctggcccattacatatctaggcaactaaaaacaaacattgtaagaatgaatatttttaatgtagtaattcctagttacaatagatacataaagtaatgaactcagcattctgtacttttgcttcaggtttgaagtaaaaattatctagttaaattttttttatttcacgttaccatgccatttcacattaccataccatcagatagcatggcttattgtgggcatttctgcagtgaatacattttccaaaacagttaaattgtctgtttggatttgctttaaagtcttgtgtaagagagaagaaactatttctataataaaaagcactctcatcagatatctgacataattagatacaatataacattttactaagttcagtattcatgttttaaaggtgtttatactgatttgattgtgctggcaaatatactgtattgttaatattgaactgtttatttttctcttagtcttcttatttaattaacttcattgccgctggattctgttcagcctttaaaaatatttcttagtggtcattgctctgcagaactcaaaaagaaaattgtacttgttcatagacatttttaaagggttaatttattgttcagccttatcccttggcacgtaaacagactactagacttattgtaggttcgtttgagctttgtgttgtaaaattaaaaatgcttctgtaaagttttcaaggtagggagtgattttattattgtgtatatctaatatattaagtatgtgtgatactaaggtttgactgctataattatttgtactgttgatcacatgtacttaaaacatctgatactgtattctaagacaggttgtttttgcaattaaatttattttaataagacgatcatgaataaaactttaaattgatatttttattattattaccattatcattattattatttttagattcagggtctcgctctgttgcccagggtctgtctctgactgtgctgtggtgcagtcatagctcactgtatccttaaattcctgggctcaagtgatcctcctctttcagtctcctgagtagctgggactataagttcatgccaccatgccctactaatgttttaattttatttttgtaaagatgggatcttcctatgttttccaggccccttggcctcccaaagtgctgggattacagatgtgagccaccgagccaggccatgatatttacattattaaagttaatagttcaaactacttttagaggctttgttttgtttttgttttttgaagacagtgtcttgctcttctgctcaaacagtaatgcagtggcatgatcaccattcattgcagtctcaaccttctgggctcaagcagtcctcccacctcagcctccctagtaactggaaccacaggcacatgccaccatgcctggctaattttttagtttttgtagagacagaatcttcctatgttgcttaggctggtctcattgggctcaagtgatcctcctgcctcagccttctaaagtgctgggattacagatgtgagccattgcacccaacatacttttagaggtttttgtgttgagttacaaatatttgaaacttgcaaatgtaatttaatatatgttcttattttttgcctgtaatctttccaacttttctaaaaacctatatttttttctacaatagcttttccatctgtttattctaaatgcagttgcatattttgtgtctgaaatttctttagatgctgaaaaaggatgatcgacaagtgaattatctaataatatttgaaaatatttctttgagtaacaggacttcttagacttaacatgtatattttgtatcagggtatattatctttctgcatgtggatacatacacagatacatacataaatatacataaatatatgtacttgaacacataaaatatatgtacttgccttttaacgaaattgtgttcattctatcctatacttacttgtgaagcattatttggctttgttatgaattaccagccattcttagaattggtttacaatgctaagtcagaagttttcctgggatatgtattattctgactaatttgtccttaattttaagatctagtgtagagcctaaaataccatgtttgaagaaaacaaaaataattattttaaactgtttccttttacctcagttccctatgtttaccctgcctcatttagaaaaaatacgtactttttattactgtctatttagtcacacacatagtttaaaatttcaaatactgctacacagttcagaatgaaaaccagcattttcctgttccattctatcccaccctagtttatctcctcaaactcttttagcagttgttgctggtatttacctccatctttgaaaaggatagatatgttctactaaatctt

SEQ ID NO: 313099 - DNA, 3707 bp, Homo sapiens
agcggagcccctctacctccggaagagacgagtgcggtaacaccgttcacagagctagccggacgtcctccgactcaagatatttgtcaaatattttcagaagatggctgatccttggcaggaatgcatggattatgcagtaactctagcaagacaagctggagaggtagtttgtgaagctataaaaaatgaaatgaatgttatgctgaaaagttctccagttgatttggtaactgctacggaccaaaaagttgaaaaaatgcttatctcttccataaaggaaaagtatccatctcacagtttcattggtgaagaatctgtggcagctggggaaaaaagtatcttaaccgacaaccccacatggatcattgaccctattgatggaacaactaactttgtacatagatttccttttgtagctgtttcaattggctttgctgtaaataaaaagatagaatttggagttgtgtacagttgtgtggaaggcaagatgtacactgccagaaaaggaaaaggtgccttttgtaatggtcaaaaactacaagtttcacaacaagaagatattaccaaatctctcttggtgactgagttgggctcttccagaacaccagagactgtgagaatggttctttctaatatggaaaagcttttttgcattcctgttcatgggatccggagtgttggaacagcagctgttaatatgtgccttgtggcaactggcggagcagatgcatattatgaaatgggaattcactgctgggatgttgcaggagctggcattattgttactgaagctggtggcgtgctaatggatgttacaggtggaccatttgatttgatgtcacgaagagtaattgctgcaaataatagaatattagcagaaaggatagctaaagaaattcaggttatacctttgcaacgagacgacgaagattaattaaggcagcctcatagtcaatcccagttgcttttccccagatttggtgactcatcaatggatatgtgttttggatgtatgatatgcttggtttaaattctctttgtccaggtcaaaaatttggaacttgtttcttattttactatgtctaggtttgcaagaattgacataatgtttgtttcactgatttaaaaaattttgcatgtaagaatgtactttaggaaacatacccaggaagtacagttgataaatataacatcaactgaaatagtcaattagcaattttgtgtttctaaatatctatggtcccctgaaattttgacttagtatataggtgcagagacacccacttagaaagttaactgtttggaaaaacatttctctttagtttcaaaaaccatatataattaaatttgtaaggatatactgagtaccctaggccaacttttttttctttgcagagaaccttttttgttttattcttcagtgttcatatagcacctggcccattacatatctaggcaactaaaaacaaacattgtaagaatgaatatttttaatgtagtaattcctagttacaatagatacataaagtaatgaactcagcattctgtacttttgcttcaggtttgaagtaaaaattatctagttaaattttttttatttcacgttaccatgccatttcacattaccataccatcagatagcatggcttattgtgggcatttctgcagtgaatacattttccaaaacagttaaattgtctgtttggatttgctttaaagtcttgtgtaagagagaagaaactatttctataataaaaagcactctcatcagatatctgacataattagatacaatataacattttactaagttcagtattcatgttttaaaggtgtttatactgatttgattgtgctggcaaatatactgtattgttaatattgaactgtttatttttctcttagtcttcttatttaattaacttcattgccgctggattctgttcagcctttaaaaatatttcttagtggtcattgctctgcagaactcaaaaagaaaattgtacttgttcatagacatttttaaagggttaatttattgttcagccttatcccttggcacgtaaacagactactagacttattgtaggttcgtttgagctttgtgttgtaaaattaaaaatgcttctgtaaagttttcaaggtagggagtgattttattattgtgtatatctaatatattaagtatgtgtgatactaaggtttgactgctataattatttgtactgttgatcacatgtacttaaaacatctgatactgtattctaagacaggttgtttttgcaattaaatttattttaataagacgatcatgaacttatagtcccagctactcaggagactgaaagaggaggatctcctgagtagctgggactataagttcatgccaccatgccctactaatgttttaattttatttttgtaaagatgggatcttcctatgttttccaggccccttggcctcccaaagtgctgggattacagatgtgagccaccgagccaggccatgatatttacattattaaagttaatagttcaaactacttttagaggctttgttttgtttttgttttttgaagacagtgtcttgctcttctgctcaaacagtaatgcagtggcatgatcaccattcattgcagtctcaaccttctgggctcaagcagtcctcccacctcagcctccctagtaactggaaccacaggcacatgccaccatgcctggctaattttttagtttttgtagagacagaatcttcctatgttgcttaggctggtctcattgggctcaagtgatcctcctgcctcagccttctaaagtgctgggattacagatgtgagccattgcacccaacatacttttagaggtttttgtgttgagttacaaatatttgaaacttgcaaatgtaatttaatatatgttcttattttttgcctgtaatctttccaacttttctaaaaacctatatttttttctacaatagcttttccatctgtttattctaaatgcagttgcatattttgtgtctgaaatttctttagatgctgaaaaaggatgatcgacaagtgaattatctaataatatttgaaaatatttctttgagtaacaggacttcttagacttaacatgtatattttgtatcagggtatattatctttctgcatgtggatacatacacagatacatacataaatatacataaatatatgtacttgaacacataaaatatatgtacttgccttttaacgaaattgtgttcattctatcctatacttacttgtgaagcattatttggctttgttatgaattaccagccattcttagaattggtttacaatgctaagtcagaagttttcctgggatatgtattattctgactaatttgtccttaattttaagatctagtgtagagcctaaaataccatgtttgaagaaaacaaaaataattattttaaactgtttccttttacctcagttccctatgtttaccctgcctcatttagaaaaaatacgtactttttattactgtctatttagtcacacacatagtttaaaatttcaaatactgctacacagttcagaatgaaaaccagcattttcctgttccattctatcccaccctagtttatctcctcaaactcttttagcagttgttgctggtatttacctccatctttgaaaaggatagatatgttctactaaatctt

SEQ ID NO: 313100 - DNA, 3991 bp, Homo sapiens
aattgcccctttttatgtccccaactccgaaaagctcctagaaacttggtgcatccccaggcccaggtagtcactctaagtgatggggcagcgcccaggtcctgtgctgcccgcagtcgcggtgctgggacaggtggcaaaaaggaaggtggcctggctcctacgctggaaggctgtgaccaggacagaaacagcaggaaacagttcaggtgtttatggctttgggaaaatgaaaatatttgtcaaatattttcagaagatggctgatccttggcaggaatgcatggattatgcagtaactctagcaagacaagctggagaggtagtttgtgaagctataaaaaatgaaatgaatgttatgctgaaaagttctccagttgatttggtaactgctacggaccaaaaagttgaaaaaatgcttatctcttccataaaggaaaagtatccatctcacagtttcattggtgaagaatctgtggcagctggggaaaaaagtatcttaaccgacaaccccacatggatcattgaccctattgatggaacaactaactttgtacatagatttccttttgtagctgtttcaattggctttgctgtaaataaaaagatagaatttggagttgtgtacagttgtgtggaaggcaagatgtacactgccagaaaaggaaaaggtgccttttgtaatggtcaaaaactacaagtttcacaacaagaagatattaccaaatctctcttggtgactgagttgggctcttccagaacaccagagactgtgagaatggttctttctaatatggaaaagcttttttgcattcctgttcatgggatccggagtgttggaacagcagctgttaatatgtgccttgtggcaactggcggagcagatgcatattatgaaatgggaattcactgctgggatgttgcaggagctggcattattgttactgaagctggtggcgtgctaatggatgttacaggtggaccatttgatttgatgtcacgaagagtaattgctgcaaataatagaatattagcagaaaggatagctaaagaaattcaggttatacctttgcaacgagacgacgaagattaattaaggcagcctcatagtcaatcccagttgcttttccccagatttggtgactcatcaatggatatgtgttttggatgtatgatatgcttggtttaaattctctttgtccaggtcaaaaatttggaacttgtttcttattttactatgtctaggtttgcaagaattgacataatgtttgtttcactgatttaaaaaattttgcatgtaagaatgtactttaggaaacatacccaggaagtacagttgataaatataacatcaactgaaatagtcaattagcaattttgtgtttctaaatatctatggtcccctgaaattttgacttagtatataggtgcagagacacccacttagaaagttaactgtttggaaaaacatttctctttagtttcaaaaaccatatataattaaatttgtaaggatatactgagtaccctaggccaacttttttttctttgcagagaaccttttttgttttattcttcagtgttcatatagcacctggcccattacatatctaggcaactaaaaacaaacattgtaagaatgaatatttttaatgtagtaattcctagttacaatagatacataaagtaatgaactcagcattctgtacttttgcttcaggtttgaagtaaaaattatctagttaaattttttttatttcacgttaccatgccatttcacattaccataccatcagatagcatggcttattgtgggcatttctgcagtgaatacattttccaaaacagttaaattgtctgtttggatttgctttaaagtcttgtgtaagagagaagaaactatttctataataaaaagcactctcatcagatatctgacataattagatacaatataacattttactaagttcagtattcatgttttaaaggtgtttatactgatttgattgtgctggcaaatatactgtattgttaatattgaactgtttatttttctcttagtcttcttatttaattaacttcattgccgctggattctgttcagcctttaaaaatatttcttagtggtcattgctctgcagaactcaaaaagaaaattgtacttgttcatagacatttttaaagggttaatttattgttcagccttatcccttggcacgtaaacagactactagacttattgtaggttcgtttgagctttgtgttgtaaaattaaaaatgcttctgtaaagttttcaaggtagggagtgattttattattgtgtatatctaatatattaagtatgtgtgatactaaggtttgactgctataattatttgtactgttgatcacatgtacttaaaacatctgatactgtattctaagacaggttgtttttgcaattaaatttattttaataagacgatcatgaataaaactttaaattgatatttttattattattaccattatcattattattatttttagattcagggtctcgctctgttgcccagggtctgtctctgactgtgctgtggtgcagtcatagctcactgtatccttaaattcctgggctcaagtgatcctcctctttcagtctcctgagtagctgggactataagttcatgccaccatgccctactaatgttttaattttatttttgtaaagatgggatcttcctatgttttccaggccccttggcctcccaaagtgctgggattacagatgtgagccaccgagccaggccatgatatttacattattaaagttaatagttcaaactacttttagaggctttgttttgtttttgttttttgaagacagtgtcttgctcttctgctcaaacagtaatgcagtggcatgatcaccattcattgcagtctcaaccttctgggctcaagcagtcctcccacctcagcctccctagtaactggaaccacaggcacatgccaccatgcctggctaattttttagtttttgtagagacagaatcttcctatgttgcttaggctggtctcattgggctcaagtgatcctcctgcctcagccttctaaagtgctgggattacagatgtgagccattgcacccaacatacttttagaggtttttgtgttgagttacaaatatttgaaacttgcaaatgtaatttaatatatgttcttattttttgcctgtaatctttccaacttttctaaaaacctatatttttttctacaatagcttttccatctgtttattctaaatgcagttgcatattttgtgtctgaaatttctttagatgctgaaaaaggatgatcgacaagtgaattatctaataatatttgaaaatatttctttgagtaacaggacttcttagacttaacatgtatattttgtatcagggtatattatctttctgcatgtggatacatacacagatacatacataaatatacataaatatatgtacttgaacacataaaatatatgtacttgccttttaacgaaattgtgttcattctatcctatacttacttgtgaagcattatttggctttgttatgaattaccagccattcttagaattggtttacaatgctaagtcagaagttttcctgggatatgtattattctgactaatttgtccttaattttaagatctagtgtagagcctaaaataccatgtttgaagaaaacaaaaataattattttaaactgtttccttttacctcagttccctatgtttaccctgcctcatttagaaaaaatacgtactttttattactgtctatttagtcacacacatagtttaaaatttcaaatactgctacacagttcagaatgaaaaccagcattttcctgttccattctatcccaccctagtttatctcctcaaactcttttagcagttgttgctggtatttacctccatctttgaaaaggatagatatgttctactaaatctt

SEQ ID NO: 313101 - DNA, 3789 bp, Homo sapiens
agcggagcccctctacctccggaagagacgagtgcggtaacaccgttcacagagctagccggacgtcctccgactcaagatatttgtcaaatattttcagaagatggctgatccttggcaggaatgcatggattatgcagtaactctagcaagacaagctggagaggtagtttgtgaagctataaaaaatgaaatgaatgttatgctgaaaagttctccagttgatttggtaactgctacggaccaaaaagttgaaaaaatgcttatctcttccataaaggaaaagtatccatctcacagtttcattggtgaagaatctgtggcagctggggaaaaaagtatcttaaccgacaaccccacatggatcattgaccctattgatggaacaactaactttgtacatagatagaatttggagttgtgtacagttgtgtggaaggcaagatgtacactgccagaaaaggaaaaggtgccttttgtaatggtcaaaaactacaagtttcacaacaagaagatattaccaaatctctcttggtgactgagttgggctcttccagaacaccagagactgtgagaatggttctttctaatatggaaaagcttttttgcattcctgttcatgggatccggagtgttggaacagcagctgttaatatgtgccttgtggcaactggcggagcagatgcatattatgaaatgggaattcactgctgggatgttgcaggagctggcattattgttactgaagctggtggcgtgctaatggatgttacaggtggaccatttgatttgatgtcacgaagagtaattgctgcaaataatagaatattagcagaaaggatagctaaagaaattcaggttatacctttgcaacgagacgacgaagattaattaaggcagcctcatagtcaatcccagttgcttttccccagatttggtgactcatcaatggatatgtgttttggatgtatgatatgcttggtttaaattctctttgtccaggtcaaaaatttggaacttgtttcttattttactatgtctaggtttgcaagaattgacataatgtttgtttcactgatttaaaaaattttgcatgtaagaatgtactttaggaaacatacccaggaagtacagttgataaatataacatcaactgaaatagtcaattagcaattttgtgtttctaaatatctatggtcccctgaaattttgacttagtatataggtgcagagacacccacttagaaagttaactgtttggaaaaacatttctctttagtttcaaaaaccatatataattaaatttgtaaggatatactgagtaccctaggccaacttttttttctttgcagagaaccttttttgttttattcttcagtgttcatatagcacctggcccattacatatctaggcaactaaaaacaaacattgtaagaatgaatatttttaatgtagtaattcctagttacaatagatacataaagtaatgaactcagcattctgtacttttgcttcaggtttgaagtaaaaattatctagttaaattttttttatttcacgttaccatgccatttcacattaccataccatcagatagcatggcttattgtgggcatttctgcagtgaatacattttccaaaacagttaaattgtctgtttggatttgctttaaagtcttgtgtaagagagaagaaactatttctataataaaaagcactctcatcagatatctgacataattagatacaatataacattttactaagttcagtattcatgttttaaaggtgtttatactgatttgattgtgctggcaaatatactgtattgttaatattgaactgtttatttttctcttagtcttcttatttaattaacttcattgccgctggattctgttcagcctttaaaaatatttcttagtggtcattgctctgcagaactcaaaaagaaaattgtacttgttcatagacatttttaaagggttaatttattgttcagccttatcccttggcacgtaaacagactactagacttattgtaggttcgtttgagctttgtgttgtaaaattaaaaatgcttctgtaaagttttcaaggtagggagtgattttattattgtgtatatctaatatattaagtatgtgtgatactaaggtttgactgctataattatttgtactgttgatcacatgtacttaaaacatctgatactgtattctaagacaggttgtttttgcaattaaatttattttaataagacgatcatgaataaaactttaaattgatatttttattattattaccattatcattattattatttttagattcagggtctcgctctgttgcccagggtctgtctctgactgtgctgtggtgcagtcatagctcactgtatccttaaattcctgggctcaagtgatcctcctctttcagtctcctgagtagctgggactataagttcatgccaccatgccctactaatgttttaattttatttttgtaaagatgggatcttcctatgttttccaggccccttggcctcccaaagtgctgggattacagatgtgagccaccgagccaggccatgatatttacattattaaagttaatagttcaaactacttttagaggctttgttttgtttttgttttttgaagacagtgtcttgctcttctgctcaaacagtaatgcagtggcatgatcaccattcattgcagtctcaaccttctgggctcaagcagtcctcccacctcagcctccctagtaactggaaccacaggcacatgccaccatgcctggctaattttttagtttttgtagagacagaatcttcctatgttgcttaggctggtctcattgggctcaagtgatcctcctgcctcagccttctaaagtgctgggattacagatgtgagccattgcacccaacatacttttagaggtttttgtgttgagttacaaatatttgaaacttgcaaatgtaatttaatatatgttcttattttttgcctgtaatctttccaacttttctaaaaacctatatttttttctacaatagcttttccatctgtttattctaaatgcagttgcatattttgtgtctgaaatttctttagatgctgaaaaaggatgatcgacaagtgaattatctaataatatttgaaaatatttctttgagtaacaggacttcttagacttaacatgtatattttgtatcagggtatattatctttctgcatgtggatacatacacagatacatacataaatatacataaatatatgtacttgaacacataaaatatatgtacttgccttttaacgaaattgtgttcattctatcctatacttacttgtgaagcattatttggctttgttatgaattaccagccattcttagaattggtttacaatgctaagtcagaagttttcctgggatatgtattattctgactaatttgtccttaattttaagatctagtgtagagcctaaaataccatgtttgaagaaaacaaaaataattattttaaactgtttccttttacctcagttccctatgtttaccctgcctcatttagaaaaaatacgtactttttattactgtctatttagtcacacacatagtttaaaatttcaaatactgctacacagttcagaatgaaaaccagcattttcctgttccattctatcccaccctagtttatctcctcaaactcttttagcagttgttgctggtatttacctccatctttgaaaaggatagatatgttctactaaatctt

SEQ ID NO: 313102 - DNA, 3730 bp, Homo sapiens
agcggagcccctctacctccggaagagacgagtgcggtaacaccgttcacagagctagccggacgtcctccgactcaagatatttgtcaaatattttcagaagatggctgatccttggcaggaatgcatggattatgcagtaactctagcaagacaagctggagaggtagtttgtgaagctataaaaaatgaaatgaatgttatgctgaaaagttctccagttgatttggtaactgctacggaccaaaaagttgaaaaaatgcttatctcttccataaaggaaaagtatccatctcacagatttccttttgtagctgtttcaattggctttgctgtaaataaaaagatagaatttggagttgtgtacagttgtgtggaaggcaagatgtacactgccagaaaaggaaaaggtgccttttgtaatggtcaaaaactacaagtttcacaacaagaagatattaccaaatctctcttggtgactgagttgggctcttccagaacaccagagactgtgagaatggttctttctaatatggaaaagcttttttgcattcctgttcatgggatccggagtgttggaacagcagctgttaatatgtgccttgtggcaactggcggagcagatgcatattatgaaatgggaattcactgctgggatgttgcaggagctggcattattgttactgaagctggtggcgtgctaatggatgttacaggtggaccatttgatttgatgtcacgaagagtaattgctgcaaataatagaatattagcagaaaggatagctaaagaaattcaggttatacctttgcaacgagacgacgaagattaattaaggcagcctcatagtcaatcccagttgcttttccccagatttggtgactcatcaatggatatgtgttttggatgtatgatatgcttggtttaaattctctttgtccaggtcaaaaatttggaacttgtttcttattttactatgtctaggtttgcaagaattgacataatgtttgtttcactgatttaaaaaattttgcatgtaagaatgtactttaggaaacatacccaggaagtacagttgataaatataacatcaactgaaatagtcaattagcaattttgtgtttctaaatatctatggtcccctgaaattttgacttagtatataggtgcagagacacccacttagaaagttaactgtttggaaaaacatttctctttagtttcaaaaaccatatataattaaatttgtaaggatatactgagtaccctaggccaacttttttttctttgcagagaaccttttttgttttattcttcagtgttcatatagcacctggcccattacatatctaggcaactaaaaacaaacattgtaagaatgaatatttttaatgtagtaattcctagttacaatagatacataaagtaatgaactcagcattctgtacttttgcttcaggtttgaagtaaaaattatctagttaaattttttttatttcacgttaccatgccatttcacattaccataccatcagatagcatggcttattgtgggcatttctgcagtgaatacattttccaaaacagttaaattgtctgtttggatttgctttaaagtcttgtgtaagagagaagaaactatttctataataaaaagcactctcatcagatatctgacataattagatacaatataacattttactaagttcagtattcatgttttaaaggtgtttatactgatttgattgtgctggcaaatatactgtattgttaatattgaactgtttatttttctcttagtcttcttatttaattaacttcattgccgctggattctgttcagcctttaaaaatatttcttagtggtcattgctctgcagaactcaaaaagaaaattgtacttgttcatagacatttttaaagggttaatttattgttcagccttatcccttggcacgtaaacagactactagacttattgtaggttcgtttgagctttgtgttgtaaaattaaaaatgcttctgtaaagttttcaaggtagggagtgattttattattgtgtatatctaatatattaagtatgtgtgatactaaggtttgactgctataattatttgtactgttgatcacatgtacttaaaacatctgatactgtattctaagacaggttgtttttgcaattaaatttattttaataagacgatcatgaataaaactttaaattgatatttttattattattaccattatcattattattatttttagattcagggtctcgctctgttgcccagggtctgtctctgactgtgctgtggtgcagtcatagctcactgtatccttaaattcctgggctcaagtgatcctcctctttcagtctcctgagtagctgggactataagttcatgccaccatgccctactaatgttttaattttatttttgtaaagatgggatcttcctatgttttccaggccccttggcctcccaaagtgctgggattacagatgtgagccaccgagccaggccatgatatttacattattaaagttaatagttcaaactacttttagaggctttgttttgtttttgttttttgaagacagtgtcttgctcttctgctcaaacagtaatgcagtggcatgatcaccattcattgcagtctcaaccttctgggctcaagcagtcctcccacctcagcctccctagtaactggaaccacaggcacatgccaccatgcctggctaattttttagtttttgtagagacagaatcttcctatgttgcttaggctggtctcattgggctcaagtgatcctcctgcctcagccttctaaagtgctgggattacagatgtgagccattgcacccaacatacttttagaggtttttgtgttgagttacaaatatttgaaacttgcaaatgtaatttaatatatgttcttattttttgcctgtaatctttccaacttttctaaaaacctatatttttttctacaatagcttttccatctgtttattctaaatgcagttgcatattttgtgtctgaaatttctttagatgctgaaaaaggatgatcgacaagtgaattatctaataatatttgaaaatatttctttgagtaacaggacttcttagacttaacatgtatattttgtatcagggtatattatctttctgcatgtggatacatacacagatacatacataaatatacataaatatatgtacttgaacacataaaatatatgtacttgccttttaacgaaattgtgttcattctatcctatacttacttgtgaagcattatttggctttgttatgaattaccagccattcttagaattggtttacaatgctaagtcagaagttttcctgggatatgtattattctgactaatttgtccttaattttaagatctagtgtagagcctaaaataccatgtttgaagaaaacaaaaataattattttaaactgtttccttttacctcagttccctatgtttaccctgcctcatttagaaaaaatacgtactttttattactgtctatttagtcacacacatagtttaaaatttcaaatactgctacacagttcagaatgaaaaccagcattttcctgttccattctatcccaccctagtttatctcctcaaactcttttagcagttgttgctggtatttacctccatctttgaaaaggatagatatgttctactaaatctt

SEQ ID NO: 313103 - DNA, 3140 bp, Homo sapiens
agcggagcccctctacctccggaagagacgagtgcggtaacaccgttcacagagctagccggacgtcctccgactcaagatatttgtcaaatattttcagaagatggctgatccttggcaggaatgcatggattatgcagtaactctagcaagacaagctggagaggtagtttgtgaagctataaaaaatgaaatgaatgttatctggggaaaaaagtatcttaaccgacaaccccacatggatcattgaccctattgatggaacaactaactttgtacatagatttggtgactcatcaatggatatgtgttttggatgtatgatatgcttggtttaaattctctttgtccaggtcaaaaatttggaacttgtttcttattttactatgtctaggtttgcaagaattgacataatgtttgtttcactgatttaaaaaattttgcatgtaagaatgtactttaggaaacatacccaggaagtacagttgataaatataacatcaactgaaatagtcaattagcaattttgtgtttctaaatatctatggtcccctgaaattttgacttagtatataggtgcagagacacccacttagaaagttaactgtttggaaaaacatttctctttagtttcaaaaaccatatataattaaatttgtaaggatatactgagtaccctaggccaacttttttttctttgcagagaaccttttttgttttattcttcagtgttcatatagcacctggcccattacatatctaggcaactaaaaacaaacattgtaagaatgaatatttttaatgtagtaattcctagttacaatagatacataaagtaatgaactcagcattctgtacttttgcttcaggtttgaagtaaaaattatctagttaaattttttttatttcacgttaccatgccatttcacattaccataccatcagatagcatggcttattgtgggcatttctgcagtgaatacattttccaaaacagttaaattgtctgtttggatttgctttaaagtcttgtgtaagagagaagaaactatttctataataaaaagcactctcatcagatatctgacataattagatacaatataacattttactaagttcagtattcatgttttaaaggtgtttatactgatttgattgtgctggcaaatatactgtattgttaatattgaactgtttatttttctcttagtcttcttatttaattaacttcattgccgctggattctgttcagcctttaaaaatatttcttagtggtcattgctctgcagaactcaaaaagaaaattgtacttgttcatagacatttttaaagggttaatttattgttcagccttatcccttggcacgtaaacagactactagacttattgtaggttcgtttgagctttgtgttgtaaaattaaaaatgcttctgtaaagttttcaaggtagggagtgattttattattgtgtatatctaatatattaagtatgtgtgatactaaggtttgactgctataattatttgtactgttgatcacatgtacttaaaacatctgatactgtattctaagacaggttgtttttgcaattaaatttattttaataagacgatcatgaataaaactttaaattgatatttttattattattaccattatcattattattatttttagattcagggtctcgctctgttgcccagggtctgtctctgactgtgctgtggtgcagtcatagctcactgtatccttaaattcctgggctcaagtgatcctcctctttcagtctcctgagtagctgggactataagttcatgccaccatgccctactaatgttttaattttatttttgtaaagatgggatcttcctatgttttccaggccccttggcctcccaaagtgctgggattacagatgtgagccaccgagccaggccatgatatttacattattaaagttaatagttcaaactacttttagaggctttgttttgtttttgttttttgaagacagtgtcttgctcttctgctcaaacagtaatgcagtggcatgatcaccattcattgcagtctcaaccttctgggctcaagcagtcctcccacctcagcctccctagtaactggaaccacaggcacatgccaccatgcctggctaattttttagtttttgtagagacagaatcttcctatgttgcttaggctggtctcattgggctcaagtgatcctcctgcctcagccttctaaagtgctgggattacagatgtgagccattgcacccaacatacttttagaggtttttgtgttgagttacaaatatttgaaacttgcaaatgtaatttaatatatgttcttattttttgcctgtaatctttccaacttttctaaaaacctatatttttttctacaatagcttttccatctgtttattctaaatgcagttgcatattttgtgtctgaaatttctttagatgctgaaaaaggatgatcgacaagtgaattatctaataatatttgaaaatatttctttgagtaacaggacttcttagacttaacatgtatattttgtatcagggtatattatctttctgcatgtggatacatacacagatacatacataaatatacataaatatatgtacttgaacacataaaatatatgtacttgccttttaacgaaattgtgttcattctatcctatacttacttgtgaagcattatttggctttgttatgaattaccagccattcttagaattggtttacaatgctaagtcagaagttttcctgggatatgtattattctgactaatttgtccttaattttaagatctagtgtagagcctaaaataccatgtttgaagaaaacaaaaataattattttaaactgtttccttttacctcagttccctatgtttaccctgcctcatttagaaaaaatacgtactttttattactgtctatttagtcacacacatagtttaaaatttcaaatactgctacacagttcagaatgaaaaccagcattttcctgttccattctatcccaccctagtttatctcctcaaactcttttagcagttgttgctggtatttacctccatctttgaaaaggatagatatgttctactaaatctt

SEQ ID NO: 313104 - DNA, 299 bp, Homo sapiens
gtatttttatttactgtgtacaagaaatgtttattatctcaccatttcttggggttctgcatatgagagtagcttgactacacggttcttgccaaggtcttccatgaagttacagtcaaagtgttggtcaaggctgcagtcaactgaaggttggactggaactgaaggatccattcactcacgtgattgttggcagatgtcagttcctgggggagttgtctgctggtagcttctctcagttccttaccatgtagcctcttcacagagtagctcacgacatggaagctgacatctcctag

SEQ ID NO: 313105 - DNA, 2578 bp, Homo sapiens
agcggagcccctctacctccggaagagacgagtgcggtaacaccgttcacagagctagccggacgtcctccgactcaagatatttgtcaaatattttcagaagatggctgatccttggcaggaatgcatggattatgcagtaactctagcaagacaagctggagaggtagtttgtgaagctataaaaaatgaaatgaatgttatgctgaaaagttctccagttgatttggtaactgctacggaccaaaaagttgaaaaaatgcttatctcttccataaaggaaaagtatccatctcacagtttcattggtgaagaatctgtggcagctggggaaaaaagtatcttaaccgacaaccccacatggatcattgaccctattgatggaacaactaactttgtacatagatttccttttgtagctgtttcaattggctttgctgtaaataaaaagatagaatttggagttgtgtacagttgtgtggaaggcaagatgtacactgccagaaaaggaaaaggtgccttttgtaatggtcaaaaactacaagtttcacaacaagaagatattaccaaatctctcttggtgactgagttgggctcttccagaacaccagagactgtgagaatggttctttctaatatggaaaagcttttttgcattcctgttcatgggatccggagtgttggaacagcagctgttaatatgtgccttgtggcaactggcggagcagatgcatattatgaaatgggaattcactgctgggatgttgcaggagctggcattattgttactgaagctggtggcgtgctaatggatgttacaggtggaccatttgatttgatgtcacgaagagtaattgctgcaaataatagaatattagcagaaaggatagctaaagaaattcaggttatacctttgcaacgagacgacgaagattaattaaggcagcctcatagtcaatcccagttgcttttccccagatttggtgactcatcaatggatatgtgttttggatgtatgatatgcttggtttaaattctctttgtccaggtcaaaaatttggaacttgtttcttattttactatgtctaggtttgcaagaattgacataatgtttgtttcactgatttaaaaaattttgcatgtaagaatgtactttaggaaacatacccaggaagtacagttgataaatataacatcaactgaaatagtcaattagcaattttgtgtttctaaatatctatggtcccctgaaattttgacttagtatataggtgcagagacacccacttagaaagttaactgtttggaaaaacatttctctttagtttcaaaaaccatatataattaaatttgtaaggatatactgagtaccctaggccaacttttttttctttgcagagaaccttttttgttttattcttcagtgttcatatagcacctggcccattacatatctaggcaactaaaaacaaacattgtaagaatgaatatttttaatgtagtaattcctagttacaatagatacataaagtaatgaactcagcattctgtacttttgcttcaggtttgaagtaaaaattatctagttaaattttttttatttcacgttaccatgccatttcacattaccataccatcagatagcatggcttattgtgggcatttctgcagtgaatacattttccaaaacagttaaattgtctgtttggatttgctttaaagtcttgtgtaagagagaagaaactatttctataataaaaagcactctcatcagatatctgacataattagatacaatataacattttactaagttcagtattcatgttttaaaggtgtttatactgatttgattgtgctggcaaatatactgtattgttaatattgaactgtttatttttctcttagtcttcttatttaattaacttcattgccgctggattctgttcagcctttaaaaatatttcttagtggtcattgctctgcagaactcaaaaagaaaattgtacttgttcatagacatttttaaagggttaatttattgttcagccttatcccttggcacgtaaacagactactagacttattgtaggttcgtttgagctttgtgttgtaaaattaaaaatgcttctgtaaagttttcaaggtagggagtgattttattattgtgtatatctaatatattaagtatgtgtgatactaaggtttgactgctataattatttgtactgttgatcacatgtacttaaaacatctgatactgtattctaagacaggttgtttttgcaattaaatttattttaataagacgatcatgaataaaactttaaattgatatttttattattattaccattatcattattattatttttagattcagggtctcgctctgttgcccagggtctgtctctgactgtgctgtggtgcagtcatagctcactgtatccttaaattcctgggctcaagtgatcctcctctttcagtctcctgagtagctgggactataagaggaggatagcttgagcccaggagttcgagacctgcctgggcaatatagcgagaccccgttctccag

SEQ ID NO: 313106 - DNA, 3782 bp, Homo sapiens
agcggagcccctctacctccggaagagacgagtgcggtaacaccgttcacagagctagccggacgtcctccgactcaagatatttgtcaaatattttcagaagatggctgatccttggcaggaatgcatggattatgcagtaactctagcaagacaagctggagaggtagtttgtgaagctataaaaaatgaaatgaatgttatgctgaaaagttctccagttgatttggtaactgctacggaccaaaaagttgaaaaaatgcttatctcttccataaaggaaaagtatccatctcacagtttcattggtgaagaatctgtggcagctggggaaaaaagtatcttaaccgacaaccccacatggatcattgaccctattgatggaacaactaactttgtacatagatttccttttgtagctgtttcaattggctttgctgtaaataaaaagatagaatttggagttgtgtacagttgtgtggaaggcaagatgtacactgccagaaaaggaaaaggtgccttttgtaatggtcaaaaactacaagtttcacaacaagaagatattaccaaatctctcttggtgactgagttgggctcttccagaacaccagagactgtgagaatggttctttctaatatggaaaagcttttttgcattcctgttcatgggatccggagtgttggaacagcagctgttaatatgtgccttgtggcaactggcggagcagatgcatattatgaaatgggaattcactgctgggatgttgcaggagctggcattattgttactgaagctggtggcgtgctaatggatgttacaggtggaccatttgatttgatgtcacgaagagtaattgctgcaaataatagaatattagcagaaaggatagctaaagaaattcaggttatacctttgcaacgagacgacgaagattaattaaggcagcctcatagtcaatcccagttgcttttccccagatttggtgactcatcaatggatatgtgttttggatgtatgatatgcttggtttaaattctctttgtccaggtcaaaaatttggaacttgtttcttattttactatgtctaggtttgcaagaattgacataatgtttgtttcactgatttaaaaaattttgcatgtaagaatgtactttaggaaacatacccaggaagtacagttgataaatataacatcaactgaaatagtcaattagcaattttgtgtttctaaatatctatggtcccctgaaattttgacttagtatataggtgcagagacacccacttagaaagttaactgtttggaaaaacatttctctttagtttcaaaaaccatatataattaaatttgtaaggatatactgagtaccctaggccaacttttttttctttgcagagaaccttttttgttttattcttcagtgttcatatagcacctggcccattacatatctaggcaactaaaaacaaacattgtaagaatgaatatttttaatgtagtaattcctagttacaatagatacataaagtaatgaactcagcattctgtacttttgcttcaggtttgaagtaaaaattatctagttaaattttttttatttcacgttaccatgccatttcacattaccataccatcagatagcatggcttattgtgggcatttctgcagtgaatacattttccaaaacagttaaattgtctgtttggatttgctttaaagtcttgtgtaagagagaagaaactatttctataataaaaagcactctcatcagatatctgacataattagatacaatataacattttactaagttcagtattcatgttttaaaggtgtttatactgatttgattgtgctggcaaatatactgtattgttaatattgaactgtttatttttctcttagtcttcttatttaattaacttcattgccgctggattctgttcagcctttaaaaatatttcttagtgtaaagggttaatttattgttcagccttatcccttggcacgtaaacagactactagacttattgtaggttcgtttgagctttgtgttgtaaaattaaaaatgcttctgtaaagttttcaaggtagggagtgattttattattgtgtatatctaatatattaagtatgtgtgatactaaggtttgactgctataattatttgtactgttgatcacatgtacttaaaacatctgatactgtattctaagacaggttgtttttgcaattaaatttattttaataagacgatcatgaataaaactttaaattgatatttttattattattaccattatcattattattatttttagattcagggtctcgctctgttgcccagggtctgtctctgactgtgctgtggtgcagtcatagctcactgtatccttaaattcctgggctcaagtgatcctcctctttcagtctcctgagtagctgggactataagttcatgccaccatgccctactaatgttttaattttatttttgtaaagatgggatcttcctatgttttccaggccccttggcctcccaaagtgctgggattacagatgtgagccaccgagccaggccatgatatttacattattaaagttaatagttcaaactacttttagaggctttgttttgtttttgttttttgaagacagtgtcttgctcttctgctcaaacagtaatgcagtggcatgatcaccattcattgcagtctcaaccttctgggctcaagcagtcctcccacctcagcctccctagtaactggaaccacaggcacatgccaccatgcctggctaattttttagtttttgtagagacagaatcttcctatgttgcttaggctggtctcattgggctcaagtgatcctcctgcctcagccttctaaagtgctgggattacagatgtgagccattgcacccaacatacttttagaggtttttgtgttgagttacaaatatttgaaacttgcaaatgtaatttaatatatgttcttattttttgcctgtaatctttccaacttttctaaaaacctatatttttttctacaatagcttttccatctgtttattctaaatgcagttgcatattttgtgtctgaaatttctttagatgctgaaaaaggatgatcgacaagtgaattatctaataatatttgaaaatatttctttgagtaacaggacttcttagacttaacatgtatattttgtatcagggtatattatctttctgcatgtggatacatacacagatacatacataaatatacataaatatatgtacttgaacacataaaatatatgtacttgccttttaacgaaattgtgttcattctatcctatacttacttgtgaagcattatttggctttgttatgaattaccagccattcttagaattggtttacaatgctaagtcagaagttttcctgggatatgtattattctgactaatttgtccttaattttaagatctagtgtagagcctaaaataccatgtttgaagaaaacaaaaataattattttaaactgtttccttttacctcagttccctatgtttaccctgcctcatttagaaaaaatacgtactttttattactgtctatttagtcacacacatagtttaaaatttcaaatactgctacacagttcagaatgaaaaccagcattttcctgttccattctatcccaccctagtttatctcctcaaactcttttagcagttgttgctggtatttacctccatctttgaaaaggatagatatgttctactaaatctt

SEQ ID NO: 313107 - DNA, 3814 bp, Homo sapiens
agcggagcccctctacctccggaagagacgagtgcggtaacaccgttcacagagctagccggacgtcctccgactcaagaagatggctgatccttggcaggaatgcatggattatgcagtaactctagcaagacaagctggagaggtagtttgtgaagctataaaaaatgaaatgaatgttatgctgaaaagttctccagttgatttggtaactgctacggaccaaaaagttgaaaaaatgcttatctcttccataaaggaaaagtatccatctcacagtttcattggtgaagaatctgtggcagctggggaaaaaagtatcttaaccgacaaccccacatggatcattgaccctattgatggaacaactaactttgtacatagatttccttttgtagctgtttcaattggctttgctgtaaataaaaagatagaatttggagttgtgtacagttgtgtggaaggcaagatgtacactgccagaaaaggaaaaggtgccttttgtaatggtcaaaaactacaagtttcacaacaagaagatattaccaaatctctcttggtgactgagttgggctcttccagaacaccagagactgtgagaatggttctttctaatatggaaaagcttttttgcattcctgttcatgggatccggagtgttggaacagcagctgttaatatgtgccttgtggcaactggcggagcagatgcatattatgaaatgggaattcactgctgggatgttgcaggagctggcattattgttactgaagctggtggcgtgctaatggatgttacaggtggaccatttgatttgatgtcacgaagagtaattgctgcaaataatagaatattagcagaaaggatagctaaagaaattcaggttatacctttgcaacgagacgacgaagattaattaaggcagcctcatagtcaatcccagttgcttttccccagatttggtgactcatcaatggatatgtgttttggatgtatgatatgcttggtttaaattctctttgtccaggtcaaaaatttggaacttgtttcttattttactatgtctaggtttgcaagaattgacataatgtttgtttcactgatttaaaaaattttgcatgtaagaatgtactttaggaaacatacccaggaagtacagttgataaatataacatcaactgaaatagtcaattagcaattttgtgtttctaaatatctatggtcccctgaaattttgacttagtatataggtgcagagacacccacttagaaagttaactgtttggaaaaacatttctctttagtttcaaaaaccatatataattaaatttgtaaggatatactgagtaccctaggccaacttttttttctttgcagagaaccttttttgttttattcttcagtgttcatatagcacctggcccattacatatctaggcaactaaaaacaaacattgtaagaatgaatatttttaatgtagtaattcctagttacaatagatacataaagtaatgaactcagcattctgtacttttgcttcaggtttgaagtaaaaattatctagttaaattttttttatttcacgttaccatgccatttcacattaccataccatcagatagcatggcttattgtgggcatttctgcagtgaatacattttccaaaacagttaaattgtctgtttggatttgctttaaagtcttgtgtaagagagaagaaactatttctataataaaaagcactctcatcagatatctgacataattagatacaatataacattttactaagttcagtattcatgttttaaaggtgtttatactgatttgattgtgctggcaaatatactgtattgttaatattgaactgtttatttttctcttagtcttcttatttaattaacttcattgccgctggattctgttcagcctttaaaaatatttcttagtggtcattgctctgcagaactcaaaaagaaaattgtacttgttcatagacatttttaaagggttaatttattgttcagccttatcccttggcacgtaaacagactactagacttattgtaggttcgtttgagctttgtgttgtaaaattaaaaatgcttctgtaaagttttcaaggtagggagtgattttattattgtgtatatctaatatattaagtatgtgtgatactaaggtttgactgctataattatttgtactgttgatcacatgtacttaaaacatctgatactgtattctaagacaggttgtttttgcaattaaatttattttaataagacgatcatgaataaaactttaaattgatatttttattattattaccattatcattattattatttttagattcagggtctcgctctgttgcccagggtctgtctctgactgtgctgtggtgcagtcatagctcactgtatccttaaattcctgggctcaagtgatcctcctctttcagtctcctgagtagctgggactataagttcatgccaccatgccctactaatgttttaattttatttttgtaaagatgggatcttcctatgttttccaggccccttggcctcccaaagtgctgggattacagatgtgagccaccgagccaggccatgatatttacattattaaagttaatagttcaaactacttttagaggctttgttttgtttttgttttttgaagacagtgtcttgctcttctgctcaaacagtaatgcagtggcatgatcaccattcattgcagtctcaaccttctgggctcaagcagtcctcccacctcagcctccctagtaactggaaccacaggcacatgccaccatgcctggctaattttttagtttttgtagagacagaatcttcctatgttgcttaggctggtctcattgggctcaagtgatcctcctgcctcagccttctaaagtgctgggattacagatgtgagccattgcacccaacatacttttagaggtttttgtgttgagttacaaatatttgaaacttgcaaatgtaatttaatatatgttcttattttttgcctgtaatctttccaacttttctaaaaacctatatttttttctacaatagcttttccatctgtttattctaaatgcagttgcatattttgtgtctgaaatttctttagatgctgaaaaaggatgatcgacaagtgaattatctaataatatttgaaaatatttctttgagtaacaggacttcttagacttaacatgtatattttgtatcagggtatattatctttctgcatgtggatacatacacagatacatacataaatatacataaatatatgtacttgaacacataaaatatatgtacttgccttttaacgaaattgtgttcattctatcctatacttacttgtgaagcattatttggctttgttatgaattaccagccattcttagaattggtttacaatgctaagtcagaagttttcctgggatatgtattattctgactaatttgtccttaattttaagatctagtgtagagcctaaaataccatgtttgaagaaaacaaaaataattattttaaactgtttccttttacctcagttccctatgtttaccctgcctcatttagaaaaaatacgtactttttattactgtctatttagtcacacacatagtttaaaatttcaaatactgctacacagttcagaatgaaaaccagcattttcctgttccattctatcccaccctagtttatctcctcaaactcttttagcagttgttgctggtatttacctccatctttgaaaaggatagatatgttctactaaatctt

SEQ ID NO: 313108 - DNA, 808 bp, Homo sapiens
  misc_feature (807)..(807): n is a, c, g, or t
actagttaacaggcattgcctgaaaagagtataaaagaatttcagcatgattttccatattgtgcttccaccactgccaataacaaaataactagcaaccatgaagtgggtggaatcaatttttttaattttcctactaaattttactgaatccagaacactgcatagaaatgaatatggaatagcttccatattggattcttaccaatgtactgcagagataagtttagctgacctggctaccatattttttgcccagtttgttcaagaagccacttacaaggaagtaagcaaaatggtgaaagatgcattgactgcaattgagaaacccactggagatgaacagtcttcagggtgtttagaaaaccagctacctgcctttctggaagaactttgccatgagaaagaaattttggagaagtacggacattcagactgctgcagccaaagtgaagagggaagacataactgttttcttgcacacaaaaagcccactccagcatcgatcccacttttccaagttccagaacctgtcacaagctgtgaagcatatgaagaagacagggagacattcatgaacaaattcatttatgagatagcaagaaggcatcccttcctgtatgcacctacaattcttctttgggctgctcgctatgacaaaataattccatcttgctgcaaagctgaaaatgcagttgaatgcttccaaacaaaggcagcaacagttacaaaagaattaagagaaagcagcttgttaaatcaacatgcatgtgcagtaatgaagtttaccggtgattttacttgatnc

SEQ ID NO: 313109 - DNA, 780 bp, Homo sapiens
  misc_feature (726)..(726): n is a, c, g, or t
  misc_feature (757)..(757): n is a, c, g, or t
actagttaacaggcattgcctgaaaagagtataaaagaatttcagcatgattttccatattgtgcttccaccactgccaataacaaaataactagcaaccatgaagtgggtggaatcaatttttttaattttcctactaaattttactgaatccagaacactgcatagaaatgaatatggaatagcttccatattggattcttaccaatgtactgcagagataagtttagctgacctggctaccatattttttgcccagtttgttcaagaagccacttacaaggaagtaagcaaaatggtgaaagatgcattgactgcaattgagaaacccactggagatgaacagtcttcagggtgtttagaaaaccagctacctgcctttctggaagaactttgccatgagaaagaaattttggagaagtacggacattcagactgctgcagccaaagtgaagagggaagacataactgttttcttgcacacaaaaagcccactccagcatcgatcccacttttccaagttccagaacctgtcacaagctgtgaagcatatgaagaagacagggagacattcatgaacaaattcatttatgagatagcaagaaggcatcccttcctgtatgcacctacaattcttctttgggctgctcgctatgacaaaataattccatcttgctgcaaagctgaaaatgcagttgaatgcttccaaacaaagaaaaacccccnaaaaaaaaagggggggggcccccaaaggggncccccaaaaaaaacccccccaaa

SEQ ID NO: 313110 - DNA, 475 bp, Homo sapiens
atgaggggagattgccttccactacacataagtatggtcaagtatgaaatagtgttttatccacaacctgcacaactccaggctggtggaacacttggcatgttttcagcctcaatctttctactgaaagtactagacaaggtttctcattaaccttgtgaagcaaaagccacaaataacagaggaacaacttgaggctgtcattgcagatttctcaggcctgttggagaaatgctgccaaggccaggaacaggaagtctgctttgctgaagagggacaaaaactgatttcaaaaactcgtgctgctttgggagtttaaattacttcaggggaagagaagacaaaacgagtctttcattcggtgtgaacttttctctttaattttaactgatttaacactttttgtgaattaatgaaatgataaagacttttatgtgagatttccttatcacagaaataaaatatctccaaatgt

SEQ ID NO: 313111 - DNA, 266 bp, Homo sapiens
aataaatgaatataaagtccgtaattgaaaagtcaaattgagagatgcaggagaaaacaaaaagccattttacaggacaatttgaaggatcacagtctgtattaacagttttgccattcatataattcaaatcatatttgattttcaggtttatttatttgaatttaacttccacatgccatattatataggaataactggagaagtgatggctccttttgtctcttagttccaataacttgaaatatttttctccacatatttca

SEQ ID NO: 313112 - DNA, 2029 bp, Homo sapiens
actagttaacaggcattgcctgaaaagagtataaaagaatttcagcatgattttccatattgtgcttccaccactgccaataacaaaataactagcaaccatgaagtgggtggaatcaatttttttaattttcctactaaattttactgaatccagaacactgcatagaaatgaatatggaatagcttccatattggattcttaccaatgtactgcagagataagtttagctgacctggctaccatattttttgcccagtttgttcaagaagccacttacaaggaagtaagcaaaatggtgaaagatgcattgactgcaattgagaaacccactggagatgaacagtcttcagggtgtttagaaaaccagctacctgcctttctggaagaactttgccatgagaaagaaattttggagaagtacggacattcagactgctgcagccaaagtgaagagggaagacataactgttttcttgcacacaaaaagcccactccagcatcgatcccacttttccaagttccagaacctgtcacaagctgtgaagcatatgaagaagacagggagacattcatgaacaaattcatttatgagatagcaagaaggcatcccttcctgtatgcacctacaattcttctttgggctgctcgctatgacaaaataattccatcttgctgcaaagctgaaaatgcagttgaatgcttccaaacaaaggcagcaacagttacaaaagaattaagagaaagcagcttgttaaatcaacatgcatgtgcagtaatgaaaaattttgggacccgaacttttcaagccataactggtactaaactgagtcagaagtttaccaaagttaattttactgaaatccagaaactagtcctggatgtggcccatgtacatgagcactgttgcagaggagatgtgctggattgtctgcaggatggggaaaaaatcatgtcctacatatgttctcaacaagacactctgtcaaacaaaataacagaatgctgcaaactgaccacgctggaacgtggtcaatgtataattcatgcagaaaatgatgaaaaacctgaaggtctatctccaaatctaaacaggtttttaggagatagagattttaaccaattttcttcaggggaaaaaaatatcttcttggcaagttttgttcatgaatattcaagaagacatcctcagcttgctgtctcagtaattctaagagttgctaaaggataccaggagttattggagaagtgtttccagactgaaaaccctcttgaatgccaagataaaggagaagaagaattacagaaatacatccaggagagccaagcattggcaaagcgaagctgcggcctcttccagaaactaggagaatattacttacaaaatgcgtttctcgttgcttacacaaagaaagccccccagctgacctcgtcggagctgatggccatcaccagaaaaatggcagccacagctgacattattatcggacacttatgtatcagacatgaaatgactccagtaaaccctggtgttggccagtgctgcacttcttcatatgccaacaggaggccatgcttcagcagcttggtggtggatgaaacatatgtccctcctgcattctctgatgacaagttcattttccataaggatctgtgccaagctcagggtgtagcgctgcaaacgatgaagcaagagtttctcattaaccttgtgaagcaaaagccacaaataacagaggaacaacttgaggctgtcattgcagatttctcaggcctgttggagaaatgctgccaaggccaggaacaggaagtctgctttgctgaagagggacaaaaactgatttcaaaaactcgtgctgctttgggagtttaaattacttcaggggaagagaagacaaaacgagtctttcattcggtgtgaacttttctctttaattttaactgatttaacactttttgtgaattaatgaaatgataaagacttttatgtgagatttccttatcacagaaataaaatatctccaaatgt

SEQ ID NO: 313113 - DNA, 2038 bp, Homo sapiens
actagttaacaggcattgcctgaaaagagtataaaagaatttcagcatgattttccatattgtgcttccaccactgccaataacaaaataactagcaaccatgaagtgggtggaatcaatttttttaattttcctactaaattttactgaatccagaacactgcatagaaatgaatatggaatagcttccatattggattcttaccaatgtactgcagagataagtttagctgacctggctaccatattttttgcccagtttgttcaagaagccacttacaaggaagtaagcaaaatggtgaaagatgcattgactgcaattgagaaacccactggagatgaacagtcttcagggtgtttagaaaaccagaagtacggacattcagactgctgcagccaaagtgaagagggaagacataactgttttcttgcacacaaaaagcccactccagcatcgatcccacttttccaagttccagaacctgtcacaagctgtgaagcatatgaagaagacagggagacattcatgaacaaattcatttatgagatagcaagaaggcatcccttcctgtatgcacctacaattcttctttgggctgctcgctatgacaaaataattccatcttgctgcaaagctgaaaatgcagttgaatgcttccaaacaaaggcagcaacagttacaaaagaattaagagaaagcagcttgttaaatcaacatgcatgtgcagtaatgaaaaattttgggacccgaacttttcaagccataactggtactaaactgagtcagaagtttaccaaagttaattttactgaaatccagaaactagtcctggatgtggcccatgtacatgagcactgttgcagaggagatgtgctggattgtctgcaggatggggaaaaaatcatgtcctacatatgttctcaacaagacactctgtcaaacaaaataacagaatgctgcaaactgaccacgctggaacgtggtcaatgtataattcatgcagaaaatgatgaaaaacctgaaggtctatctccaaatctaaacaggtttttaggagatagagattttaaccaattttcttcaggggaaaaaaatatcttcttggcaagttttgttcatgaatattcaagaagacatcctcagcttgctgtctcagtaattctaagagttgctaaaggataccaggagttattggagaagtgtttccagactgaaaaccctcttgaatgccaagataaaggagaagaagaattacagaaatacatccaggagagccaagcattggcaaagcgaagctgcggcctcttccagaaactaggagaatattacttacaaaatgcgtttctcgttgcttacacaaagaaagccccccagctgacctcgtcggagctgatggccatcaccagaaaaatggcagccacagcagccacttgttgccaactcagtgaggacaaactattggcctgtggcgagggagcggctgacattattatcggacacttatgtatcagacatgaaatgactccagtaaaccctggtgttggccagtgctgcacttcttcatatgccaacaggaggccatgcttcagcagcttggtggtggatgaaacatatgtccctcctgcattctctgatgacaagttcattttccataaggatctgtgccaagctcagggtgtagcgctgcaaacgatgaagcaagagtttctcattaaccttgtgaagcaaaagccacaaataacagaggaacaacttgaggctgtcattgcagatttctcaggcctgttggagaaatgctgccaaggccaggaacaggaagtctgctttgctgaagagggacaaaaactgatttcaaaaactcgtgctgctttgggagtttaaattacttcaggggaagagaagacaaaacgagtctttcattcggtgtgaacttttctctttaattttaactgatttaacactttttgtgaattaatgaaatgataaagacttttatgtgagatttccttatcacagaaataaaatatctccaaatgt

SEQ ID NO: 313114 - DNA, 1669 bp, Homo sapiens
actagttaacaggcattgcctgaaaagagtataaaagaatttcagcatgattttccatattgtgcttccaccactgccaataacaaaataactagcaaccatgaagtgggtggaatcaatttttttaattttcctactaaattttactgaatccagaacactgcatagaaatgaatatggaatagcttccatattggattcttaccaatgtactgcagagataagtttagctgacctggctaccatattttttgcccagtttgttcaagaagccacttacaaggaagtaagcaaaatggtgaaagatgcattgactgcaattgagaaacccactggagatgaacagtcttcagggtgtttagaaaaccagctacctgcctttctggaagaactttgaactggtactaaactgagtcagaagtttaccaaagttaattttactgaaatccagaaactagtcctggatgtggcccatgtacatgagcactgttgcagaggagatgtgctggattgtctgcaggatggggaaaaaatcatgtcctacatatgttctcaacaagacactctgtcaaacaaaataacagaatgctgcaaactgaccacgctggaacgtggtcaatgtataattcatgcagaaaatgatgaaaaacctgaaggtctatctccaaatctaaacaggtttttaggagatagagattttaaccaattttcttcaggggaaaaaaatatcttcttggcaagttttgttcatgaatattcaagaagacatcctcagcttgctgtctcagtaattctaagagttgctaaaggataccaggagttattggagaagtgtttccagactgaaaaccctcttgaatgccaagataaaggagaagaagaattacagaaatacatccaggagagccaagcattggcaaagcgaagctgcggcctcttccagaaactaggagaatattacttacaaaatgcgtttctcgttgcttacacaaagaaagccccccagctgacctcgtcggagctgatggccatcaccagaaaaatggcagccacagcagccacttgttgccaactcagtgaggacaaactattggcctgtggcgagggagcggctgacattattatcggacacttatgtatcagacatgaaatgactccagtaaaccctggtgttggccagtgctgcacttcttcatatgccaacaggaggccatgcttcagcagcttggtggtggatgaaacatatgtccctcctgcattctctgatgacaagttcattttccataaggatctgtgccaagctcagggtgtagcgctgcaaacgatgaagcaagagtttctcattaaccttgtgaagcaaaagccacaaataacagaggaacaacttgaggctgtcattgcagatttctcaggcctgttggagaaatgctgccaaggccaggaacaggaagtctgctttgctgaagagggacaaaaactgatttcaaaaactcgtgctgctttgggagtttaaattacttcaggggaagagaagacaaaacgagtctttcattcggtgtgaacttttctctttaattttaactgatttaacactttttgtgaattaatgaaatgataaagacttttatgtgagatttccttatcacagaaataaaatatctccaaatgt

SEQ ID NO: 313115 - DNA, 2487 bp, Homo sapiens
actagttaacaggcattgcctgaaaagagtataaaagaatttcagcatgattttccatattgtgcttccaccactgccaataacaaaataactagcaaccatgaagtgggtggaatcaatttttttaattttcctactaaattttactgaatccagaacactgcatagaaatgaatatggaatagcttccatattggattcttaccaatgtactgcagagataagtttagctgacctggctaccatattttttgcccagtttgttcaagaagccacttacaaggaagtaagcaaaatggtgaaagatgcattgactgcaattgagaaacccactggagatgaacagtcttcagggtgtttagaaaaccagctacctgcctttctggaagaactttgccatgagaaagaaattttggagaagtacggacattcagactgctgcagccaaagtgaagagggaagacataactgttttcttgcacacaaaaagcccactccagcatcgatcccacttttccaagttccagaacctgtcacaagctgtgaagcatatgaagaagacagggagacattcatgaacaaattcatttatgagatagcaagaaggcatcccttcctgtatgcacctacaattcttctttgggctgctcgctatgacaaaataattccatcttgctgcaaagctgaaaatgcagttgaatgcttccaaacaaaggcagcaacagttacaaaagaattaagagaaagcagcttgttaaatcaacatgcatgtgcagtaatgaaaaattttgggacccgaacttttcaagccataactggtactaaactgagtcagaagtttaccaaagttaattttactgaaatccagaaactagtcctggatgtggcccatgtacatgagcactgttgcagaggagatgtgctggattgtctgcaggatggggaaaaaatcatgtcctacatatgttctcaacaagacactctgtcaaacaaaataacagaatgctgcaaactgaccacgctggaacgtggtcaatgtataattcatgcagaaaatgatgaaaaacctgaaggtctatctccaaatctaaacaggtttttaggagatagagattttaaccaattttcttcaggggaaaaaaatatcttcttggcaagttttgttcatgaatattcaagaagacatcctcagcttgctgtctcagtaattctaagagttgctaaaggataccaggagttattggagaagtgtttccagactgaaaaccctcttgaatgccaagataaaggagaagaagaattacagaaatacatccaggagagccaagcattggcaaagcgaagctgcggcctcttccagaaactaggagaatattacttacaaaatgcgtttctcgttgcttacacaaagaaagccccccagctgacctcgtcggagctgatggccatcaccagaaaaatggcagccacagcagccacttgttgccaactcagtgaggacaaactattggcctgtggcgagggagcggctgacattattatcggacacttatgtatcagacatgaaatgactccagtaaaccctggtgttggccagtgctgcacttcttcatatgccaacaggaggccatgcttcagcagcttggtggtggatgaaacatatgtccctcctgcattctctgatgacaagttcattttccataaggatctgtgccaagctcagggtgtagcgctgcaaacgatgaagcaagagtttctcattaaccttgtgaagcaaaagccacaaataacagaggaacaacttgaggctgtcattgcagatttctcaggcctgttggagaaatgctgccaaggccaggaacaggaagtctgctttgctgaagagggacaaaaactgatttcaaaaactcgtgctgctttgggagtttaaattacttcaggggaagagaagacaaaacgagtctttcattcggtgtgaacttttctctttaattttaactgatttaacactttttgtgaattaatgaaatgataaagacttttatgtgagatttccttatcacagaaataaaatatctccaaatgttttccttttccaagtttgcttatttatgaaaagttatcgataatttctttagttttgtataccattgtctgaagcagattctgttaaaatagcattaagtgttggttgttataggagattaaagctatccaaggatggatttacagcactagatcacttggtgaactgaaaaatgttcccaagttaaacactatttgatgctaccagggcattttgtttattaaatgaccatcactgaagtattctaacagataatctggagatgagaaaagaaattattattcttctatgggatctaagaaaatttaacatctactttttttctcaatcttgttcagttctctattcacagacattttaaaacataagaatattacagttttgattgaatataattaatg

SEQ ID NO: 313116 - DNA, 2031 bp, Homo sapiens
actagttaacaggcattgcctgaaaagagtataaaagaatttcagcatgattttccatattgtgcttccaccactgccaataacaaaataactagcaaccatgaagtgggtggaatcaatttttttaattttcctactaaattttactgaatccagaacactgcatagaaatgaatatggaatagcttccatattggattcttaccaatgtactgcagagataagtttagctgacctggctaccatattttttgcccagtttgttcaagaagccacttacaaggaagtaagcaaaatggtgaaagatgcattgactgcaattgagaaacccactggagatgaacagtcttcagggtgtttagaaaaccagctacctgcctttctggaagaactttgccatgagaaagaaattttggagaagtacggacattcagactgctgcagccaaagtgaagagggaagacataactgttttcttgcacacaaaaagcccactccagcatcgatcccacttttccaagttccagaacctgtcacaagctgtgaagcatatgaagaagacagggagacattcatgaacaaattcatttatgagatagcaagaaggcatcccttcctgtatgcacctacaattcttctttgggctgctcgctatgacaaaataattccatcttgctgcaaagctgaaaatgcagttgaatgcttccaaacaaaggcagcaacagttacaaaagaattaagagaaagcagcttgttaaatcaacatgcatgtgcagtaatgaaaaattttgggacccgaacttttcaagccataactggtactaaactgagtcagaagtttaccaaagttaattttactgaaatccagaaactagtcctggatgtggcccatgtacatgagcactgttgcagaggagatgtgctggattgtctgcaggatggggaaaaaatcatgtcctacatatgttctcaacaagacactctgtcaaacaaaataacagaatgctgcaaactgaccacgctggaacgtggtcaatgtataattcatgcagaaaatgatgaaaaacctgaaggtctatctccaaatctaaacaggtttttaggagatagagattttaaccaattttcttcaggggaaaaaaatatcttcttggcaagttttgttcatgaatattcaagaagacatcctcagcttgctgtctcagtaattctaagagttgctaaaggataccaggagttattggagaagtgtttccagactgaaaaccctcttgaatgccaagataaaggagaagaagaattacagaaatacatccaggagagccaagcattggcaaagcgaagctgcggcctcttccagaaactaggagaatattacttacaaaatgcgtttctcgttgcttacacaaagaaagccccccagctgacctcgtcggagctgatggccatcaccagaaaaatggcagccacagcagccacttgttgccaactcagtgaggacaaactattggcctgtggcgagggagcggctgacattattatcggacacttatgtatcagacatgaaatgactccagtaaaccctggtgttggccagtgctgcacttcttcatatgccaacaggaggccatgcttcagcagctccataaggatctgtgccaagctcagggtgtagcgctgcaaacgatgaagcaagagtttctcattaaccttgtgaagcaaaagccacaaataacagaggaacaacttgaggctgtcattgcagatttctcaggcctgttggagaaatgctgccaaggccaggaacaggaagtctgctttgctgaagagggacaaaaactgatttcaaaaactcgtgctgctttgggagtttaaattacttcaggggaagagaagacaaaacgagtctttcattcggtgtgaacttttctctttaattttaactgatttaacactttttgtgaattaatgaaatgataaagacttttatgtgagatttccttatcacagaaataaaatatctccaaatgt

SEQ ID NO: 313117 - DNA, 2030 bp, Homo sapiens
actagttaacaggcattgcctgaaaagagtataaaagaatttcagcatgattttccatattgtgcttccaccactgccaataacaaaataactagcaaccatgaagtgggtggaatcaatttttttaattttcctactaaattttactgaatccagaacactgcatagaaatgaatatggaatagcttccatattggattcttaccaatgtactgcagagataagtttagctgacctggctaccatattttttgcccagtttgttcaagaagccacttacaaggaagtaagcaaaatggtgaaagatgcattgactgcaattgagaaacccactggagatgaacagtcttcagggtgtttagaaaaccagctacctgcctttctggaagaactttgccatgagaaagaaattttggagaagtacggacattcagactgctgcagccaaagtgaagagggaagacataactgttttcttgcacacaaaaagcccactccagcatcgatcccacttttccaagttccagaacctgtcacaagctgtgaagcatatgaagaagacagggagacattcatgaacaaattcatttatgagatagcaagaaggcatcccttcctgtatgcacctacaattcttctttgggctgctcgctatgacaaaataattccatcttgctgcaaagctgaaaatgcagttgaatgcttccaaacaaaggcagcaacagttacaaaagaattaagagaaagcagcttgttaaatcaacatgcatgtgcagtaatgaaaaattttgggacccgaacttttcaagccataactggtactaaactgagtcagaagtttaccaaagttaattttactgaaatccagaaactagtcctggatgtggcccatgtacatgagcactgttgcagaggagatgtgctggattgtctgcaggatggggaaaaaatcatgtcctacatatgttctcaacaagacactctgtcaaacaaaataacagaatgctgcaaactgaccacgctggaacgtggtcaatgtataattcatgcagaaaatgatgaaaaacctgaaggtctatctccaaatctaaacaggtttttaggagatagagattttaaccaattttcttcaggggaaaaaaatatcttcttggcaagttttgttcatgaatattcaagaagacatcctcagcttgctgtctcagtaattctaagagttgctaaaggataccaggagttattggagaagtgtttccagactgaaaaccctcttgaatgccaagataaaggagaagaagaattacagaaatacatccaggagagccaagcattggcaaagcgaagctgcggcctcttccagaaactaggagaatattacttacaaaatgcgtttctcgttgcttacacaaagaaagccccccagctgacctcgtcggagctgatggccatcaccagaaaaatggcagccacagcagccacttgttgccaactcagtgaggacaaactattggcctgtggcgagggagcggctgacattattatcggacacttatgtatcagacatgaaatgactccagtaaaccctggtgttggccagtgctgcacttcttcatatgccaacaggaggccatgcttcagcagcttggtggtggatgaaacatatgtccctcctgcattctctgatgacaagttcattttccataaggatctgtgccaagctcagggtgtagcgctgcaaacgatgaagcaagagtttctcattaaccttgtgaagcaaaagccacaaataacagaggaacaacttgaggctgtcattgcagatttctcaggcctgttggagaaatgctgccaaggccaggaacaggaagtctgctttgctgaagagggacaaaaactgatttcaaaaactcgtgctgctttgggagtttaaattacttcagaactgatttaacactttttgtgaattaatgaaatgataaagacttttatgtgagatttccttatcacagaaataaaatatctccaaatgt

SEQ ID NO: 313118 - DNA, 2086 bp, Homo sapiens
actagttaacaggcattgcctgaaaagagtataaaagaatttcagcatgattttccatattgtgcttccaccactgccaataacaaaataactagcaaccatgaagtgggtggaatcaatttttttaattttcctactaaattttactgaatccagaacactgcatagaaatgaatatggaatagcttccatattggattcttaccaatgtactgcagagataagtttagctgacctggctaccatattttttgcccagtttgttcaagaagccacttacaaggaagtaagcaaaatggtgaaagatgcattgactgcaattgagaaacccactggagatgaacagtcttcagggtgtttagaaaaccagctacctgcctttctggaagaactttgccatgagaaagaaattttggagaagtacggacattcagactgctgcagccaaagtgaagagggaagacataactgttttcttgcacacaaaaagcccactccagcatcgatcccacttttccaagttccagaacctgtcacaagctgtgaagcatatgaagaagacagggagacattcatgaacaaattcatttatgagatagcaagaaggcatcccttcctgtatgcacctacaattcttctttgggctgctcgctatgacaaaataattccatcttgctgcaaagctgaaaatgcagttgaatgcttccaaacaaaggcagcaacagttacaaaagaattaagagaaagcagcttgttaaatcaacatgcatgtgcagtaatgaaaaattttgggacccgaacttttcaagccataactggtactaaactgagtcagaagtttaccaaagttaattttactgaaatccagaaactagtcctggatgtggcccatgtacatgagcactgttgcagaggagatgtgctggattgtctgcaggatggggaaaaaatcatgtcctacatatgttctcaacaagacactctgtcaaacaaaataacagaatgctgcaaactgaccacgctggaacgtggtcaatgtataattcatgcagaaaatgatgaaaaacctgaaggtctatctccaaatctaaacaggtttttaggagatagagattttaaccaattttcttcaggggaaaaaaatatcttcttggcaagttttgttcatgaatattcaagaagacatcctcagcttgctgtctcagtaattctaagagttgctaaaggataccaggagttattggagaagtgtttccagactgaaaaccctcttgaatgccaagataaaggagaagaagaattacagaaatacatccaggagagccaagcattggcaaagcgaagctgcggcctcttccagaaactaggagaatattacttacaaaatgcgtttctcgttgcttacacaaagaaagccccccagctgacctcgtcggagctgatggccatcaccagaaaaatggcagccacagcagccacttgttgccaactcagtgaggacaaactattggcctgtggcgagggagcggctgacattattatcggacacttatgtatcagacatgaaatgactccagtaaaccctggtgttggccagtgctgcacttcttcatatgccaacaggaggccatgcttcagcagcttggtggtggatgaaacatatgtccctcctgcattctctgatgacaagttcattttccataaggatctgtgccaagctcagggtgtagcgctgcaaacgatgaagcaagagtttctcattaaccttgtgaagcaaaagccacaaataacagaggaacaacttgaggctgtcattgcagatttctcaggcctgttggagaaatgctgccaaggccaggaacaggaagtctgctttgctgaagagggacaaaaactgatttcaaaaactcgtgctgctttgggagtttaaattacttcaggggaagagaagacaaaacgagtctttcattcggtgtgaacttttctctttaattttaactgatttaacactttttgtgaattaatgaaatgataaagacttttatgtgagatttccttatcacagaaataaaatatctccaaatgt

SEQ ID NO: 313119 - DNA, 2170 bp, Homo sapiens
actagttaacaggcattgcctgaaaagagtataaaagaatttcagcatgattttccatattgtgcttccaccactgccaataacaaaataactagcaaccatgaagtgggtggaatcaatttttttaattttcctactaaattttactgaatccagaacactgcatagaaatgaatatggaatagcttccatattggattcttaccaatgtactgcagagataagtttagctgacctggctaccatattttttgcccagtttgttcaagaagccacttacaaggaagtaagcaaaatggtgaaagatgcattgactgcaattgagaaacccactggagatgaacagtcttcagggtgtttagaaaaccagctacctgcctttctggaagaactttgccatgagaaagaaattttggagaagtacggacattcagactgctgcagccaaagtgaagagggaagacataactgttttcttgcacacaaaaagcccactccagcatcgatcccacttttccaagttccagaacctgtcacaagctgtgaagcatatgaagaagacagggagacattcatgaacaaattcatttatgagatagcaagaaggcatcccttcctgtatgcacctacaattcttctttgggctgctcgctatgacaaaataattccatcttgctgcaaagctgaaaatgcagttgaatgcttccaaacaaaggcagcaacagttacaaaagaattaagagaaagcagcttgttaaatcaacatgcatgtgcagtaatgaaaaattttgggacccgaacttttcaagccataactggtactaaactgagtcagaagtttaccaaagttaattttactgaaatccagaaactagtcctggatgtggcccatgtacatgagcactgttgcagaggagatgtgctggattgtctgcaggatggggaaaaaatcatgtcctacatatgttctcaacaagacactctgtcaaacaaaataacagaatgctgcaaactgaccacgctggaacgtggtcaatgtataattcatgcagaaaatgatgaaaaacctgaaggtctatctccaaatctaaacaggtttttaggagatagagattttaaccaattttcttcaggggaaaaaaatatcttcttggcaagttttgttcatgaatattcaagaagacatcctcagcttgctgtctcagtaattctaagagttgctaaaggataccaggagttattggagaagtgtttccagactgaaaaccctcttgaatgccaagataaaggagaagaagaattacagaaatacatccaggagagccaagcattggcaaagcgaagctgcggcctcttccagaaactaggagaatattacttacaaaatgcgtttctcgttgcttacacaaagaaagccccccagctgacctcgtcggagctgatggccatcaccagaaaaatggcagccacagcagccacttgttgccaactcagtgaggacaaactattggcctgtggcgagggagcggctgacattattatcggacacttatgtatcagacatgaaatgactccagtaaaccctggtgttggccagtgctgcacttcttcatatgccaacaggaggccatgcttcagcagcttggtggtggatgaaacatatgtccctcctgcattctctgatgacaagttcattttccataaggatctgtgccaagctcagggtgtagcgctgcaaacgatgaagcaagagtttctcattaaccttgtgaagcaaaagccacaaataacagaggaacaacttgaggctgtcattgcagatttctcaggcctgttggagaaatgctgccaaggccaggaacaggaagtctgctttgctgaagagggacaaaaactgatttcaaaaactcgtgctgctttgggagtttaaattacttcaggggaagagaagacaaaacgagtctttcattcggtgtgaacttttctctttaattttaactgatttaacactttttgtgaattaatgaaatgataaagacttttatgtgagatttccttatcacagaaataaaatatctccaaatgtaaaaaaaaaaaacacttaccaatatggtgcccacgtaacccgcaggtagtacttttatcgcgttgttgtcttgtgccccggtcg

SEQ ID NO: 313120 - DNA, 2060 bp, Homo sapiens
actagttaacaggcattgcctgaaaagagtataaaagaatttcagcatgattttccatattgtgcttccaccactgccaataacaaaataactagcaaccatgaagtgggtggaatcaatttttttaattttcctactaaattttactgaatccagaacactgcatagaaatgaatatggaatagcttccatattggattcttaccaatgtactgcagagataagtttagctgacctggctaccatattttttgcccagtttgttcaagaagccacttacaaggaagtaagcaaaatggtgaaagatgcattgactgcaattgagaaacccactggagatgaacagtcttcagggtgtttagaaaaccagccatgagaaagaaattttggagaagtacggacattcagactgctgcagccaaagtgaagagggaagacataactgttttcttgcacacaaaaagcccactccagcatcgatcccacttttccaagttccagaacctgtcacaagctgtgaagcatatgaagaagacagggagacattcatgaacaaattcatttatgagatagcaagaaggcatcccttcctgtatgcacctacaattcttctttgggctgctcgctatgacaaaataattccatcttgctgcaaagctgaaaatgcagttgaatgcttccaaacaaaggcagcaacagttacaaaagaattaagagaaagcagcttgttaaatcaacatgcatgtgcagtaatgaaaaattttgggacccgaacttttcaagccataactggtactaaactgagtcagaagtttaccaaagttaattttactgaaatccagaaactagtcctggatgtggcccatgtacatgagcactgttgcagaggagatgtgctggattgtctgcaggatggggaaaaaatcatgtcctacatatgttctcaacaagacactctgtcaaacaaaataacagaatgctgcaaactgaccacgctggaacgtggtcaatgtataattcatgcagaaaatgatgaaaaacctgaaggtctatctccaaatctaaacaggtttttaggagatagagattttaaccaattttcttcaggggaaaaaaatatcttcttggcaagttttgttcatgaatattcaagaagacatcctcagcttgctgtctcagtaattctaagagttgctaaaggataccaggagttattggagaagtgtttccagactgaaaaccctcttgaatgccaagataaaggagaagaagaattacagaaatacatccaggagagccaagcattggcaaagcgaagctgcggcctcttccagaaactaggagaatattacttacaaaatgcgtttctcgttgcttacacaaagaaagccccccagctgacctcgtcggagctgatggccatcaccagaaaaatggcagccacagcagccacttgttgccaactcagtgaggacaaactattggcctgtggcgagggagcggctgacattattatcggacacttatgtatcagacatgaaatgactccagtaaaccctggtgttggccagtgctgcacttcttcatatgccaacaggaggccatgcttcagcagcttggtggtggatgaaacatatgtccctcctgcattctctgatgacaagttcattttccataaggatctgtgccaagctcagggtgtagcgctgcaaacgatgaagcaagagtttctcattaaccttgtgaagcaaaagccacaaataacagaggaacaacttgaggctgtcattgcagatttctcaggcctgttggagaaatgctgccaaggccaggaacaggaagtctgctttgctgaagagggacaaaaactgatttcaaaaactcgtgctgctttgggagtttaaattacttcaggggaagagaagacaaaacgagtctttcattcggtgtgaacttttctctttaattttaactgatttaacactttttgtgaattaatgaaatgataaagacttttatgtgagatttccttatcacagaaataaaatatctccaaatgt

SEQ ID NO: 313121 - DNA, 1601 bp, Homo sapiens
actagttaacaggcattgcctgaaaagagtataaaagaatttcagcatgattttccatattgtgcttccaccactgccaataacaaaataactagcaaccatgaagtgggtggaatcaatttttttaattttcctactaaattttactgaatccagaacactgcatagaaatgaatatggaatagcttccatattggattcttaccaatgtactgcagagataagtttagctgacctggctaccatattttttgcccagtttgttcaagaagccacttacaaggaagtaagcaaaatggtgaaagatgcattgactgcaattgagaaacccactggagatgaacagtcttcagggtgtttagaaaaccagctacctgcctttctggaagaactttgccatgagaaagaaattttggagaagtacggacattcagactgctgcagccaaagtgaagagggaagacataactgttttcttgcacacaaaaagcccactccagcatcgatcccacttttccaagttccagaacctgtcacaagctgtgaagcatatgaagaagacagggagacattcatgaacaaattcatttatgagatagcaagaaggcatcccttcctgtatgcacctacaattcttctttgggctgctcgctatgacaaaataattccatcttgctgcaaagctgaaaatgcagttgaatgcttccaaacaaaggcagcaacagttacaaaagaattaagagaaagcagcttgttaaatcaacatgcatgtgcagtaatgaaaaattttgggacccgaacttttcaagccataactggtactaaactgagtcagaagtttaccaaagttaattttactgaaatccagaaactagtcctggatgtggcccatgtacatgagcactgttgcagaggagatgtgctggattgtctgcaggatggggaaaaaatcatgtcctacatatgttctcaacaagacactctgtcaaacaaaataacagaatgctgcaaactgaccacgctggaacgtggtcaatgtataattcatgcagaaaatgatgaaaaacctgaaggtctatctccaaatctaaacaggtttttaggagatagagattttaaccaattttcttcaggggaaaaaaatatcttcttggcaagtggtggtggatgaaacatatgtccctcctgcattctctgatgacaagttcattttccataaggatctgtgccaagctcagggtgtagcgctgcaaacgatgaagcaagagtttctcattaaccttgtgaagcaaaagccacaaataacagaggaacaacttgaggctgtcattgcagatttctcaggcctgttggagaaatgctgccaaggccaggaacaggaagtctgctttgctgaagagggacaaaaactgatttcaaaaactcgtgctgctttgggagtttaaattacttcaggggaagagaagacaaaacgagtctttcattcggtgtgaacttttctctttaattttaactgatttaacactttttgtgaattaatgaaatgataaagacttttatgtgagatttccttatcacagaaataaaatatctccaaatgt

SEQ ID NO: 313122 - DNA, 2426 bp, Homo sapiens
actagttaacaggcattgcctgaaaagagtataaaagaatttcagcatgattttccatattgtgcttccaccactgccaataacaaaataactagcaaccatgaagtgggtggaatcaatttttttaattttcctactaaattttactgaatccagaacactgcatagaaatgaatatggaatagcttccatattggattcttaccaatgtactgcagagataagtttagctgacctggctaccatattttttgcccagtttgttcaagaagccacttacaaggaagtaagcaaaatggtgaaagatgcattgactgcaattgagaaacccactggagatgaacagtcttcagggtgtttagaaaaccagctacctgcctttctggaagaactttgccatgagaaagaaattttggagaagtacggacattcagactgctgcagccaaagtgaagagggaagacataactgttttcttgcacacaaaaagcccactccagcatcgatcccacttttccaagttccagaacctgtcacaagctgtgaagcatatgaagaagacagggagacattcatgaacaaattcatttatgagatagcaagaaggcatcccttcctgtatgcacctacaattcttctttgggctgctcgctatgacaaaataattccatcttgctgcaaagctgaaaatgcagttgaatgcttccaaacaaaggcagcaacagttacaaaagaattaagagaaagcagcttgttaaatcaacatgcatgtgcagtaatgaaaaattttgggacccgaacttttcaagccataactggtactaaactgagtcagaagtttaccaaagttaattttactgaaatccagaaactagtcctggatgtggcccatgtacatgagcactgttgcagaggagatgtgctggattgtctgcaggatggggaaaaaatcatgtcctacatatgttctcaacaagacactctgtcaaacaaaataacagaatgctgcaaactgaccacgctggaacgtggtcaatgtataattcatgcagaaaatgatgaaaaacctgaaggtctatctccaaatctaaacaggtttttaggagatagagattttaaccaattttcttcaggggaaaaaaatatcttcttggcaagttttgttcatgaatattcaagaagacatcctcagcttgctgtctcagtaattctaagagttgctaaaggataccaggagttattggagaagtgtttccagactgaaaaccctcttgaatgccaagataaaggagaagaagaattacagaaatacatccaggagagccaagcattggcaaagcgaagctgcggcctcttccagaaactaggagaatattacttacaaaatgcgtttctcgttgcttacacaaagaaagccccccagctgacctcgtcggagctgatggccatcaccagaaaaatggcagccacagcagccacttgttgccaactcagtgaggacaaactattggcctgtggcgagggagcggctgacattattatcggacacttatgtatcagacatgaaatgactccagtaaaccctggtgttggccagtgctgcacttcttcatatgccaacaggaggccatgcttcagcagcttggtggtggatgaaacatatgtccctcctgcattctctgatgacaagttcattttccataaggatctgtgccaagctcagggtgtagcgctgcaaacgatgaagcaagagtttctcattaaccttgtgaagcaaaagccacaaataacagaggaacaacttgaggctgtcattgcagatttctcaggcctgttggagaaatgctgccaaggccaggaacaggaagtctgctttgctgaagagggacaaaaactgatttcaaaaactcgtgctgctttgggagtttaaattacttcaggtaacaaaacattcagacaagcctgaatacaatgttgtttctccagaaatatcaatccataatgagatagatcatgaggagtgccattaattctcttaaaaatacatggaattcaaaaaaaagtttattttaaaaacacttgaacaaaattacgcacacaatgttaaattagtggctcaactatgcaaaatcctttttggttatttaaaagacttcaacaaatgctatcagaagactttcctacgtatccaatatttctctgatataaaataatagaaccagttacttactgcacctattagtttaattagtatttaatatatttttgctcatattgcaggggaagagaagacaaaacgagtctttcattcggtgtgaacttttctctttaattttaactgatttaacactttttgtgaattaatgaaatgataaagacttttatgtgagatttccttatcacagaaataaaatatctccaaatgt

SEQ ID NO: 313123 - DNA, 1655 bp, Homo sapiens
cgcctcgagtgtggccccgcctccagctccttcgtcgcggcctctagtgcactttcggctccttccccttcccgggcctttcagcttggtctttccgggcctcgcttcccccagcccctgcgcccggcccgaacgagaggttccggagccccggcgcgggcgggttctggggtgtagacgctgctggccagcccgccccagccgaggttctcggcaccgccttgagagcttcagctgccccagggtgtgattagaatcccaagaaaatcaaatggcatccggggatttctgctcacctggagaagggatggaaatacttcaacaagtgtgcagcaaacaacttcctccttgtaacctgagtaaagaggacctgttacagaacccatacttcagcaagcttctcctgaatctctcacagcatgtggatgagagtggcttaagcctcaccctagcaaaggagcaggctcaggcatggaaggaagttcgactgcataagacaacatggttgaggtctgagattttacacagagtcattcaagagttgcttgtggactactatgtgaagatacaagacacaaatgtaacttctgaggacaaaaagtttcatgagacccttgaacagcggctgcttgtaactgaactgatgcggctcttaggtcctagccaggagagggagatacctccactgctggggctggagaaagcggaccttctggaactcatgccactctcagaggatttgtgtggatgagggctcggctacagcaagaagtagaggagcagctcaaaaagaaatgtttcactctgctctgctactatgatcccaattcagatgctgacagtgaaaccgtgaaggcagcaaaggtgtggaaactcgcagaggtcctggtgggtgagcagcagcagtgccaggatgccaagagccagcagaaggagcagatgttgctgctggagaagaagagtgctgcttactcccaggtgcttctccgctgcctcactttgctgcagaggcttcttcaagaacaccggctgaagactcaatccgagctagaccgcatcaatgcccagtacctggaagtcaagtgcggtgctatgatccttaagctgaggatggaggagctaaagattttgtccgacacttacactgttgagaaagtggaagttcatcgtctgattagggaccgtttggagggagccattcacctacaggagcaggacatggagaactcaagacaggtcctgaactcctatgaggtccttggggaggagtttgacaggctggtgaaagagtacaccgtactcaagcaggcaacagagaacaagcggtgggccctccaggagttcagcaaggtctaccgttgagctctggcagggccaggagacatggcttctgcatagctgctgcctcctaatcttcctgctagtgggaccaccttcacctggggctgccttcagtacaagggagtgtggaaatgcttacgcttgaaacactgcagtcatttaggcactctcctggtttctctttattttttatgactgggcctcttctggaaaatctagcaaggagatttatataatttttatgcatagctgtgtgtcagtgtcagccctgtattgtatttgattatctcctgaataaagttatgatattataa

SEQ ID NO: 313124 - DNA, 1603 bp, Homo sapiens
  misc_feature (9)..(10): n is a, c, g, or t
  misc_feature (16)..(16): n is a, c, g, or t
  misc_feature (22)..(22): n is a, c, g, or t
aaggctagnncgggcnggtgtnaatcggccgaggtggtctttccgggcctcgcttcccccagcccctgcgcccggcccgaacgagaggttccggagccccggcgcgggcgggttctggggtgtagacgctgctggccagcccgccccagccgaggttctcggcaccgccttgagagcttcagctgccccagggtgtgattagaatcccaagaaaatcaaatggcatccggggatttctgctcacctggagaagggatggaaatacttcaacaagtgtgcagcaaacaacttcctccttgtaacctgagtaaagaggacctgttacagaacccatacttcagcaagcttctcctgaatctctcacagcatgtggatgagagtggcttaagcctcaccctagcaaaggagcaggctcaggcatggaaggaagttcgactgcataagacaacatggttgaggtctgagattttacacagagtcattcaagagttgcttgtggactactatgtgaagatacaagacacaaatgtaacttctgaggacaaaaagtttcatgagacccttgaacagcggctgcttgtaactgaactgatgcggctcttaggtcctagccaggagagggagatacctccactgctggggctggagaaagcggaccttctggaactcatgccactctcagaggatttgtgtggatgagggctcggctacagcaagaagtagaggagcagctcaaaaagaaatgtttcactctgctctgctactatgatcccaattcagatgctgacagtgaaaccgtgaaggcagcaaaggtgtggaaactcgcagaggtcctggtgggtgagcagcagcagtgccaggatgccaagagccagcagaaggagcagatgttgctgctggagaagaagagtgctgcttactcccaggtgcttctccgctgcctcactttgctgcagaggcttcttcaagaacaccggctgaagactcaatccgagctagaccgcatcaatgcccagtacctggaagtcaagtgcggtgctatgatccttaagctgaggatggaggagctaaagattttgtccgacacttacactgttgagaaagtggaagttcatcgtctgattagggaccgtttggagggagccattcacctacaggagcaggacatggagaactcaagacaggtcctgaactcctatgaggtccttggggaggagtttgacaggctggtgaaagagtacaccgtactcaagcaggcaacagagaacaagcggtgggccctccaggagttcagcaaggtctaccgttgagctctggcagggccaggagacatggcttctgcatagctgctgcctcctaatcttcctgctagtgggaccaccttcacctggggctgccttcagtacaagggagtgtggaaatgcttacgcttgaaacactgcagtcatttaggcactctcctggtttctctttattttttatgactgggcctcttctggaaaatctagcaaggagatttatataatttttatgcatagctgtgtgtcagtgtcagccctgtattgtatttgattatctcctgaataaagttatgatattataa

SEQ ID NO: 313125 - DNA, 1600 bp, Homo sapiens
  misc_feature (1)..(1): n is a, c, g, or t
ntatacggctaggtagcgaggctgggtggtgtggtctttccgggcctcgcttcccccagcccctgcgcccggcccgaacgagaggttccggagccccggcgcgggcgggttctggggtgtagacgctgctggccagcccgccccagccgaggttctcggcaccgccttgagagcttcagctgccccagggtgtgattagaatcccaagaaaatcaaatggcatccggggatttctgctcacctggagaagggatggaaatacttcaacaagtgtgcagcaaacaacttcctccttgtaacctgagtaaagaggacctgttacagaacccatacttcagcaagcttctcctgaatctctcacagcatgtggatgagagtggcttaagcctcaccctagcaaaggagcaggctcaggcatggaaggaagttcgactgcataagacaacatggttgaggtctgagattttacacagagtcattcaagagttgcttgtggactactatgtgaagatacaagacacaaatgtaacttctgaggacaaaaagtttcatgagacccttgaacagcggctgcttgtaactgaactgatgcggctcttaggtcctagccaggagagggagatacctccactgctggggctggagaaagcggaccttctggaactcatgccactctcagaggatttgtgtggatgagggctcggctacagcaagaagtagaggagcagctcaaaaagaaatgtttcactctgctctgctactatgatcccaattcagatgctgacagtgaaaccgtgaaggcagcaaaggtgtggaaactcgcagaggtcctggtgggtgagcagcagcagtgccaggatgccaagagccagcagaaggagcagatgttgctgctggagaagaagagtgctgcttactcccaggtgcttctccgctgcctcactttgctgcagaggcttcttcaagaacaccggctgaagactcaatccgagctagaccgcatcaatgcccagtacctggaagtcaagtgcggtgctatgatccttaagctgaggatggaggagctaaagattttgtccgacacttacactgttgagaaagtggaagttcatcgtctgattagggaccgtttggagggagccattcacctacaggagcaggacatggagaactcaagacaggtcctgaactcctatgaggtccttggggaggagtttgacaggctggtgaaagagtacaccgtactcaagcaggcaacagagaacaagcggtgggccctccaggagttcagcaaggtctaccgttgagctctggcagggccaggagacatggcttctgcatagctgctgcctcctaatcttcctgctagtgggaccaccttcacctggggctgccttcagtacaagggagtgtggaaatgcttacgcttgaaacactgcagtcatttaggcactctcctggtttctctttattttttatgactgggcctcttctggaaaatctagcaaggagatttatataatttttatgcatagctgtgtgtcagtgtcagccctgtattgtatttgattatctcctgaataaagttatgatattataa

SEQ ID NO: 313126 - DNA, 2217 bp, Homo sapiens
cgcctcgagtgtggccccgcctccagctccttcgtcgcggcctctagtgcactttcggctccttccccttcccgggcctttcagcttggtctttccgggcctcgcttcccccagcccctgcgcccggcccgaacgagaggttccggagccccggcgcgggcgggttctggggtgtagacgctgctggccagcccgccccagccgaggttctcggcaccgccttgagagcttcagctgccccagggtgtgattagaatcccaagaaaatcaaatggcatccggggatttctgctcacctggagaagggatggaaatacttcaacaagtgtgcagcaaacaacttcctccttgtaacctgagtaaagaggacctgttacagaacccatacttcagcaagcttctcctgaatctctcacagcatgtggatgagagtggcttaagcctcaccctagcaaaggagcaggctcaggcatggaaggaagttcgactgcataagacaacatggttgaggtctgagattttacacagagtcattcaagagttgcttgtggactactatgtgaagatacaagacacaaatgtaacttctgaggacaaaaagtttcatgagacccttgaacagcggctgcttgtaactgaactgatgcggctcttaggtcctagccaggagagggagatacctccactgctggggctggagaaagcggaccttctggaactcatgccactctcagaggatttgtgtggatgagggctcggctacagcaagaagtagaggagcagctcaaaaagaaatgtttcactctgctctgctactatgatcccaattcagatgctgacagtgaaaccgtgaaggcagcaaaggtgtggaaactcgcagaggtcctggtgggtgagcagcagcagtgccaggatgccaagagccagcagaaggagcagatgttgctgctggagaagaagagtgctgcttactcccaggtgcttctccgctgcctcactttgctgcagaggcttcttcaagaacaccggctgaagactcaatccgagctagaccgcatcaatgcccagtacctggaagtcaagtgcggtgctatgatccttaagctgaggatggaggagctaaagattttgtccgacacttacactgttgagaaagtggaagttcatcgtctgattagggaccgtttggagggagccattcacctacaggagcaggacatggagaactcaagacaggtcctgaactcctatgaggtccttggggaggagtttgacaggctggtgaaagagtacaccgtactcaagcaggcaacagagaacaagcggtgggccctccaggagttcagcaaggtctaccgttgagctctggcagggccaggagacatggcttctgcatagctgctgcctcctaatcttcctgctagtgggaccaccttcacctggggctgccttcagtacaagggagtgtggaaatgcttacgcttgaaacactgcagtcatttaggcactctcctggtttctctttattttttatgactgggcctcttctggaaaatctagcaaggagatttatataatttttatgcatagctgtgtgtcagtgtcagccctgtattgtatttgattatctcctgaataaagttatgatattataaaaaaaaaaaacgccagcacccacgcccacacgcccacacaaacaccgagcgacccacaccgcgcgcgcccaacacacgggcacacaaacggcccccggccacagcgggccagcgaacaacgcggccacaaaggcgcgcacacacccggacgaaccccacacagatgccaacataacctccacacaccggatccggaagcccccccacaacaacagcacccaccaacccaccacaacaccacccaccacaccacacccacacccaccacccaaggatgacacaccacaggccctcaaccgtacaccgactcaagcacagaaactcgcccagtcatcagcgctctcaggctgctacgacgtgtgaaggcttcaagctagtgagagaacggagctcgtctatgctatcgtgctagttcattccaggcaaccgcagacactgcgggagcgagaaagtaaaaggtgaggagaaagagaggtcgcaggaccctataacagcaggactaacctctgaggagaagagagcacggcactagaccacgtgtggtcgctacgaacagatggcg

SEQ ID NO: 313127 - DNA, 1779 bp, Homo sapiens
cgcctcgagtgtggccccgcctccagctccttcgtcgcggcctctagtgcactttcggctccttccccttcccgggcctttcagcttggtctttccgggcctcgcttcccccagcccctgcgcccggcccgaacgagaggttccggagccccggcgcgggcgggttctggggtgtagacgctgctggccagcccgccccagccgaggttctcggcaccgccttgagagcttcagctgccccagggtgtgattagaatcccaagaaaatcaaatggcatccggggatttctgctcacctggagaagggatggaaatacttcaacaagtgtgcagcaaacaacttcctccttgtaacctgagtaaagaggacctgttacagaacccatacttcagcaagcttctcctgaatctctcacagcatgtggatgagagtggcttaagcctcaccctagcaaaggagcaggctcaggcatggaaggaagttcgactgcataagacaacatggttgaggtctgagattttacacagagtcattcaagagttgcttgtggactactatgtgaagatacaagacacaaatgtaacttctgaggacaaaaagtttcatgagacccttgaacagcggctgcttgtaactgaactgatgcggctcttaggtcctagccaggagagggagatacctccactgctggggctggagaaagcggaccttctggaactcatgccactctcagaggatttgtgtggatgagggctcggctacagcaagaagtagaggagcagctcaaaaagaaatgtttcactctgctctgctactatgatcccaattcagatgctgacagtgaaaccgtgaaggcagcaaaggtgtggaaactcgcagaggtcctggtgggtgagcagcagcagtgccaggatgccaagagccagcagaaggagcagatgttgctgctggagaagaagagtgctgcttactcccaggtgcttctccgctgcctcactttgctgcagaggcttcttcaagaacaccggctgaagactcaatccgagctagaccgcatcaatgcccagtacctggaagtcaagtgcggtgctatgatccttaagctgaggatggaggagctaaagattttgtccgacacttacactgttgagaaagtggaagttcatcgtctgattagggaccgtttggagggagccattcacctacaggagcaggacatggagaactcaagacaggtcctgaactcctatgaggtccttggggaggagtttgacaggctggtgaaagagtacaccgtactcaagcaggcaacagagaacaagcggtgggccctccaggagttcagcaaggtctaccgttgagctctggcagggccaggagacatggcttctgcatagctgctgcctcctaatcttcctgctagtgggaccaccttcacctggggctgccttcagtacaagggagtgtggaaatgcttacgcttgaaacactgcagtcatttaggcactctcctggtttctctttattttttatgactgggcctcttctggaaaatctagcaaggagatttatataatttttatgcatagctgtgtgtcagtgtcagccctgtattgtatttgattatctcctgaataaagttatgatattataaaaacacacaacacaaaacaaacaacaaacacaaccaaacaggacacacaaaacacacaaaaaaaaaaggggggggcaaaatacacagaggaaagagaaaagcaaagtgaaagagaacaaaaaaa

SEQ ID NO: 313128 - DNA, 1615 bp, Homo sapiens
cgcctcgagtgtggccccgcctccagctccttcgtcgcggcctctagtgcactttcggctccttccccttcccgggcctttcagcttggtctttccgggcctcgcttcccccagcccctgcgcccggcccgaacgagaggttccggagccccggcgcgggcgggttctggggtgtagacgctgctggccagcccgccccagccgaggttctcggcaccgccttgagagcttcagctgccccagggtgtgattagaatcccaagaaaatcaaatggcatccggggatttctgctcacctggagaagggatggaaatacttcaacaagtgtgcagcaaacaacttcctccttgtaacctgagtaaagaggacctgttacagaacccatacttcagcaagcttctcctgaatctctcacagcatgtggatgagagtggcttaagcctcaccctagcaaaggagcaggctcaggcatggaaggaagttcgactgcataagacaacatggttgaggtctgagattttacacagagtcattcaagagttgcttgtggactactatgtgaagatacaagacacaaatgtaacttctgaggacaaaaagtttcatgagacccttgaacagcggctgcttgtaactgaactgatgcggctcttaggtcctagccaggagagggagatacctccactgctggggctggagaaagcggaccttctggaactcatgccactctcagaggatttgtgtggatgagggctcggctacagcaagaagtagaggagcagctcaaaaagaaatgtttcactctgctctgctactatgatcccaattcagatgctgacagtgaaaccgtgaaggcagcaaaggtgtggaaactcgcagaggtcctggtgggtgagcagcagcagtgccaggatgccaagagccagcagaaggagcagatgttgctgctggagaagaagagtgctgcttactcccaggtttatcagggcatgggacagcccctttcctttatcctgaccccaggagcacttttggggaagacaaagattcctgatctaccctcctttctactatctttatttatgccctcttcttcctccatcttgggctcaggtgcttctccgctgcctcactttgctgcagaggcttcttcaagaacaccggctgaagactcaatccgagctagaccgcatcaatgcccagtacctggaagtcaagtgcggtgctatgatccttaagctgaggatggaggagctaaagattttgtccaacagagaacaagcggtgggccctccaggagttcagcaaggtctaccgttgagctctggcagggccaggagacatggcttctgcatagctgctgcctcctaatcttcctgctagtgggaccaccttcacctggggctgccttcagtacaagggagtgtggaaatgcttacgcttgaaacactgcagtcatttaggcactctcctggtttctctttattttttatgactgggcctcttctggaaaatctagcaaggagatttatataatttttatgcatagctgtgtgtcagtgtcagccctgtattgtatttgattatctcctgaataaagttatgatattataa

SEQ ID NO: 313129 - DNA, 1537 bp, Homo sapiens
cgcctcgagtgtggccccgcctccagctccttcgtcgcggcctctagtgcactttcggctccttccccttcccgggcctttcagcttggtctttccgggcctcgcttcccccagcccctgcgcccggcccgaacgagaggttccggagccccggcgcgggcgggttctggggtgtagacgctgctggccagcccgccccagccgaggttctcggcaccgccttgagagcttcagctgccccagggtgtgattagaatcccaagaaaatcaaatggcatccggggatttctgctcacctggagaagggatggaaatacttcaacaagtgtgcagcaaacaacttcctccttgtaacctgagtaaagaggacctgttacagaacccatacttcagcaagcttctcctgaatctctcacagcatgtggatgagagtggcttaagcctcaccctagcaaaggagcaggctcaggcatggaaggaagttcgactgcataagacaacatggttgaggtctgagattttacacagagtcattcaagagttgcttgtggactactatgtgaagatacaagacacaaatgtaacttctgaggacaaaaagtttcatgagacccttgaacagcggctgcttgtaactgaactgatgcggctcttaggtcctagccaggagagggagatacctccactgctggggctggagaaagcggaccttctggaactcatgccactctcagaggatttgtgtggatgagggctcggctacagcaagaagtagaggagcagctcaaaaagaaatgtttcactctgctctgctactatgatcccaattcagatgctgacagtgaaaccgtgaaggcagcaaaggtgtggaaactcgcagaggtcctggtgggtgagcagcagcagtgccaggatgccaagagccagcagaaggagcagatgttgctgctggagaagaagagtgctgcttactcccaggtttatcagggcatgggacagcccctttcctttatcctgaccccaggagcacttttggggaagacaaagattcctgatctaccctcctttctactatctttatttatgccctcttcttcctccatcttgggctcaggtgcttctccgctgcctcactttgctgcagaggcttcttcaagaacaccggctgaagactcaatccgagctagaccgcatcaatgcccagtacctggaagtcaagtgcggtgctatgatccttaagctgaggtgagctgtgacccctgtggatcttaagggattctgtctcacgttatcagccctctatcccttaccctaatctctttcctctcccttatcctagcgccttgtgggtatccagtaaatgtcacatagcagtattagcttttggattacccaaaagctttcaacatccttgagacttttcttttacagtcttctgaaataggcactttactgtgagatcaattgctcgggaattcagagtgaccttgtttatcctatcagtgcttagcccacaccttgaccgtcggcaggtact

SEQ ID NO: 313130 - DNA, 1736 bp, Homo sapiens
ataatggtggtggtggtggagaatcctcttgtttagactcagtgaattggaaagttctctttttaggatgctccttttggacagcttggagcaagtggaaacacatgtgtgcttagaatgtgacatgttttggcacttgtaaatctgtttgtccataaagcttgtgtaagagcttgggacccaggatgtgtggtataggccctctgtaaaagtcatccttgaggttcctttccagcttgtggacagcagaaatttgaacataaggtagtgtccttggagcagccagctgtttattcatctttttgttttctttcacttcttggttccacaattagaatcccaagaaaatcaaatggcatccggggatttctgctcacctggagaagggatggaaatacttcaacaagtgtgcagcaaacaacttcctccttgtaacctgagtaaagaggacctgttacagaacccatacttcagcaagcttctcctgaatctctcacagcatgtggatgagagtggcttaagcctcaccctagcaaaggagcaggctcaggcatggaaggaagttcgactgcataagacaacatggttgaggtctgagattttacacagagtcattcaagagttgcttgtggactactatgtgaagatacaagacacaaatgtaacttctgaggacaaaaagtttcatgagacccttgaacagcggctgcttgtaactgaactgatgcggctcttaggtcctagccaggagagggagatacctccactgctggggctggagaaagcggaccttctggaactcatgccactctcagaggatttgtgtggatgagggctcggctacagcaagaagtagaggagcagctcaaaaagaaatgtttcactctgctctgctactatgatcccaattcagatgctgacagtgaaaccgtgaaggcagcaaaggtgtggaaactcgcagaggtcctggtgggtgagcagcagcagtgccaggatgccaagagccagcagaaggagcagatgttgctgctggagaagaagagtgctgcttactcccaggtgcttctccgctgcctcactttgctgcagaggcttcttcaagaacaccggctgaagactcaatccgagctagaccgcatcaatgcccagtacctggaagtcaagtgcggtgctatgatccttaagctgaggatggaggagctaaagattttgtccgacacttacactgttgagaaagtggaagttcatcgtctgattagggaccgtttggagggagccattcacctacaggagcaggacatggagaactcaagacaggtcctgaactcctatgaggtccttggggaggagtttgacaggctggtgaaagagtacaccgtactcaagcaggcaacagagaacaagcggtgggccctccaggagttcagcaaggtctaccgttgagctctggcagggccaggagacatggcttctgcatagctgctgcctcctaatcttcctgctagtgggaccaccttcacctggggctgccttcagtacaagggagtgtggaaatgcttacgcttgaaacactgcagtcatttaggcactctcctggtttctctttattttttatgactgggcctcttctggaaaatctagcaaggagatttatataatttttatgcatagctgtgtgtcagtgtcagccctgtattgtatttgattatctcctgaataaagttatgatattataa

SEQ ID NO: 313131 - DNA, 1520 bp, Homo sapiens
cgcctcgagtgtggccccgcctccagctccttcgtcgcggcctctagtgcactttcggctccttccccttcccgggcctttcagcttggtctttccgggcctcgcttcccccagcccctgcgcccggcccgaacgagaggttccggagccccggcgcgggcgggttctggggtgtagacgctgctggccagcccgccccagccgaggttctcggcaccgccttgagagcttcagctgccccagggtgtgattagaatcccaagaaaatcaaatggcatccggggatttctgctcacctggagaagggatggaaatacttcaacaagtgtgcagcaaacaacttcctccttgtaacctgagtaaagaggacctgttacagaacccatacttcagcaagcttctcctgaatctctcacagcatgtggatgagagtggcttaagcctcaccctagcaaaggagcaggctcaggcatggaaggaagttcgactgcataagacaacatggttgaggtctgagattttacacagagtcattcaagagttgcttgtggactactatgtgaagatacaagacacaaatgtaacttctgaggacaaaaaggatttgtgtggatgagggctcggctacagcaagaagtagaggagcagctcaaaaagaaatgtttcactctgctctgctactatgatcccaattcagatgctgacagtgaaaccgtgaaggcagcaaaggtgtggaaactcgcagaggtcctggtgggtgagcagcagcagtgccaggatgccaagagccagcagaaggagcagatgttgctgctggagaagaagagtgctgcttactcccaggtgcttctccgctgcctcactttgctgcagaggcttcttcaagaacaccggctgaagactcaatccgagctagaccgcatcaatgcccagtacctggaagtcaagtgcggtgctatgatccttaagctgaggatggaggagctaaagattttgtccgacacttacactgttgagaaagtggaagttcatcgtctgattagggaccgtttggagggagccattcacctacaggagcaggacatggagaactcaagacaggtcctgaactcctatgaggtccttggggaggagtttgacaggctggtgaaagagtacaccgtactcaagcaggcaacagagaacaagcggtgggccctccaggagttcagcaaggtctaccgttgagctctggcagggccaggagacatggcttctgcatagctgctgcctcctaatcttcctgctagtgggaccaccttcacctggggctgccttcagtacaagggagtgtggaaatgcttacgcttgaaacactgcagtcatttaggcactctcctggtttctctttattttttatgactgggcctcttctggaaaatctagcaaggagatttatataatttttatgcatagctgtgtgtcagtgtcagccctgtattgtatttgattatctcctgaataaagttatgatattataa

SEQ ID NO: 313132 - DNA, 931 bp, Homo sapiens
cgcctcgagtgtggccccgcctccagctccttcgtcgcggcctctagtgcactttcggctccttccccttcccgggcctttcagcttggtctttccgggcctcgcttcccccagcccctgcgcccggcccgaacgagaggttccggagccccggcgcgggcgggttctggggtgtagacgctgctggccagcccgccccagccgaggttctcggcaccgccttgagagcttcagctgccccagggtgtgattagaatcccaagaaaatcaaatggcatccggggatttctgctcacctggagaagggatggaaatacttcaacaagtgtgcagcaaacaacttcctccttgtaacctgagtaaagaggacctgttacagaacccatacttcagcaagcttctcctgaatctctcacagcatgtggatgagagtggcttaagcctcaccctagcaaaggagcaggctcaggcatggaaggaagttcgactgcataagacaacatggttgaggtctgagattttacacagagtcattcaagagttgcttgtggactactatgtgaagatacaagacacaaatgtaacttctgaggacaaaaagtttcatgagacccttgaacagcggctgcttgtaactgaactgatgcggctcttaggtcctagccaggagagggagatacctccactgctggggctggagaaagcggaccttctggaactcatgccactctcagaggatttgtgtggatgagggctcggctacagcaagaagtagaggagcagctcaaaaagaaatgtttcactctgctctgctactatgatcccaattcagggtgagtgctagctgtctgttctgctcacagctggacttcagggttcctggtctgctcttttgagaataatatattttgattttagatttgggacagag

SEQ ID NO: 313133 - DNA, 1180 bp, Homo sapiens
tcaagcaatcctcctgccttggcctcccaaagtgctaggattgcaggcgtaagccaccatgctcagcccagaatggggccatttttaatagattattagaagaaaacctgtcataaggcaggatttgtgggtctagatacaggataggggcactggaaggttgctttacagggattgtagcgattagggttttcctgtcagtcctctgcccctttgctcagatgctgacagtgaaaccgtgaaggcagcaaaggtgtggaaactcgcagaggtcctggtgggtgagcagcagcagtgccaggatgccaagagccagcagaaggagcagatgttgctgctggagaagaagagtgctgcttactcccaggtttatcagggcatgggacagcccctttcctttatcctgaccccaggagcacttttggggaagacaaagattcctgatctaccctcctttctactatctttatttatgccctcttcttcctccatcttgggctcaggtgcttctccgctgcctcactttgctgcagaggcttcttcaagaacaccggctgaagactcaatccgagctagaccgcatcaatgcccagtacctggaagtcaagtgcggtgctatgatccttaagctgaggatggaggagctaaagattttgtccgacacttacactgttgagaaagtggaagttcatcgtctgattagggaccgtttggagggagccattcacctacaggagcaggacatggagaactcaagacaggtcctgaactcctatgaggtccttggggaggagtttgacaggctggtgaaagagtacaccgtactcaagcaggcaacagagaacaagcggtgggccctccaggagttcagcaaggtctaccgttgagctctggcagggccaggagacatggcttctgcatagctgctgcctcctaatcttcctgctagtgggaccaccttcacctggggctgccttcagtacaagggagtgtggaaatgcttacgcttgaaacactgcagtcatttaggcactctcctggtttctctttattttttatgactgggcctcttctggaaaatctagcaaggagatttatataatttttatgcatagctgtgtgtcagtgtcagccctgtattgtatttgattatctcctgaataaagttatgatattataa

SEQ ID NO: 313134 - DNA, 969 bp, Homo sapiens
cgcctcgagtgtggccccgcctccagctccttcgtcgcggcctctagtgcactttcggctccttccccttcccgggcctttcagcttggtctttccgggcctcgcttcccccagcccctgcgcccggcccgaacgagaggttccggagccccggcgcgggcgggttctggggtgtagacgctgctggccagcccgccccagccgaggttctcggcaccgccttgagagcttcagctgccccagggtgtgcaggtttgctttagagggtcggcgggcggagcttcggggaagaggagctctgggagagtcattccggccagtggccggagaccgtcgtcgctcttgggaatccttggccgcccagacagaagggaagtaggcgccggagagcccgttctgcattttgattcatctcgggccctattagaatcccaagaaaatcaaatggcatccggggatttctgctcacctggagaagggatggaaatacttcaacaagtgtgcagcaaacaacttcctccttgtaacctgagtaaagaggacctgttacagaacccatacttcagcaagcttctcctgaatctctcacagcatgtggatgagagtggcttaagcctcaccctagcaaaggagcaggctcaggcatggaaggaagttcgactgcataagacaacatggttgaggtctgagattttacacagagtcattcaagagttgcttgtggactactatgtgaagatacaagacacaaatgtaacttctgaggacaaaaagtttcatgagacccttgaacagcggctgcttgtaactgaactgatgcggctcttaggtcctagccaggagagggagatacctccactgctggggctggagaaagcggaccttctggaactcatgccactctcagaggttggcggggagatattggaaccaaataaatgaaatggtttaatttctcccatatcttta

SEQ ID NO: 313135 - DNA, 818 bp, Homo sapiens
cgcctcgagtgtggccccgcctccagctccttcgtcgcggcctctagtgcactttcggctccttccccttcccgggcctttcagcttggtctttccgggcctcgcttcccccagcccctgcgcccggcccgaacgagaggttccggagccccggcgcgggcgggttctggggtgtagacgctgctggccagcccgccccagccgaggttctcggcaccgccttgagagcttcagctgccccagggtgtgattagaatcccaagaaaatcaaatggcatccggggatttctgctcacctggagaagggatggaaatacttcaacaagtgtgcagcaaacaacttcctccttgtaacctgagtaaagaggacctgttacagaacccatacttcagcaagcttctcctgaatctctcacagcatgtggatgagagtggcttaagcctcaccctagcaaaggagcaggctcaggcatggaaggaagttcgactgcataagacaacatggttgaggtctgagattttacacagagtcattcaagagttgcttgtggactactatgtgaagatacaagacacaaatgtaacttctgaggacaaaaagtttcatgagacccttgaacagcggctgcttgtaactgaactgatgcggctcttaggtcctagccaggagagggagatacctccactgctggggctggagaaagcggaccttctggaactcatgccactctcagaggattgtgtggatgagggctcggtacagcagaagtaaggaccagtcaaaaaatggtcacctgccggaattagacccaacattg

SEQ ID NO: 313136 - DNA, 993 bp, Homo sapiens
cgcctcgagtgtggccccgcctccagctccttcgtcgcggcctctagtgcactttcggctccttccccttcccgggcctttcagcttggtctttccgggcctcgcttcccccagcccctgcgcccggcccgaacgagaggttccggagccccggcgcgggcgggttctggggtgtagacgctgctggccagcccgccccagccgaggttctcggcaccgccttgagagcttcagctgccccagggtgtgcaggtttgctttagagggtcggcgggcggagcttcggggaagaggagctctgggagagtcattccggccagtggccggagaccgtcgtcgctcttgggaatccttggccgcccagacagaagggaagtaggcgccggagagcccgttctgcattttgattcatctcgggccctattagaatcccaagaaaatcaaatggcatccggggatttctgctcacctggagaagggatggaaatacttcaacaagtgtgcagcaaacaacttcctccttgtaacctgagtaaagaggacctgttacagaacccatacttcagcaagcttctcctgaatctctcacagcatgtggatgagagtggcttaagcctcaccctagcaaaggagcaggctcaggcatggaaggaagttcgactgcataagacaacatggttgaggtctgagattttacacagagtcattcaagagttgcttgtggactactatgtgaagatacaagacacaaatgtaacttctgaggacaaaaagtttcatgagacccttgaacagcggctgcttgtaactgaactgatgcggctcttaggtcctagccaggagagggagatacctccactgctggggctggagaaagcggaccttctggaaaatctagcaaggagatttatataatttttatgcatagctgtgtgtcagtgtcagccctgtattgtatttgattatctcctgaataaagttatgatattataa

SEQ ID NO: 313137 - DNA, 1444 bp, Homo sapiens
  misc_feature (1)..(1): n is a, c, g, or t
ntatacggctaggtagcgaggctgggtggtgtggtctttccgggcctcgcttcccccagcccctgcgcccggcccgaacgagaggttccggagccccggcgcgggcgggttctggggtgtagacgctgctggccagcccgccccagccgaggttctcggcaccgccttgagagcttcagctgccccagggtgtgcaggtttgctttagagggtcggcgggcggagcttcggggaagaggagctctgggagagtcattccggccagtggccggagaccgtcgtcgctcttgggaatccttggccgcccagacagaagggaagtaggcgccggagagcccgttctgcattttgattcatctcgggccctgtaagggtcatatcttgtgaaaataacctgtaaaatcaatttaacgttcagtgcagcgtgtaaagacagctctaagaatttaaaagacgcctgagtcagaacatttaaatgcttgggtccctgtagcagcgttttaacacgtctgagtgcagagggtggagaatcgagcctgattgccgttcacgccctgtaacctttaagaagggtaaagaaaggcaccctaaaaaacgcaaggggacacttaccctagggggggacgaacagctagctttttggaatttgggttggtcttcatttccaagtgcgaaatttgcctgcaaaactttttatttgcagtcatagatcaacgataaacagaattgttaaaacactgaacttaactaagtagtggctttgttgacaagtcgattgtgttattaattcttaatgtctcatccaaggcaggaatcgttatctcagttttgcaggtgggaaaagtttggcacagaaaaaagcattttccttaagttctcagaagcaacggccggccgagctgcaaattaagtcccagcattctgcctcctcagctgcgtccccctctagaccatgttagaaaacaaatgagtagttactttgatgttactcataaaacgatcgagtaaaccaaatgttctataaacatgaagcgttaaatcataataaccttcaatgcctgttcagctttgggaggctcagttgccctttggagtttgataccttgcagagaggaggggcagagcaaaaacatgaaaagtaatgtcaagggaaaatttttgtctcctgaggtcaaactgtgcccatctttactgcccctgtgttggtgtcattcctttcagcgcactccatgttctggcaaaacacccacagctcacgttctcgttgtagccacattacacctttgcattactcttttgccactgacctcactgtcagtcttcttgtcacgctgtttcctccaggtgctcttttcttaggctgttatgtgaaaaccagttgttcaagtgtggaatgatttgtcattcctgaaggatgattctagagttaatgataaaaaaaaaa

SEQ ID NO: 313138 - DNA, 790 bp, Homo sapiens
tcaagcaatcctcctgccttggcctcccaaagtgctaggattgcaggcgtaagccaccatgctcagcccagaatggggccatttttaatagattattagaagaaaacctgtcataaggcaggatttgtgggtctagatacaggataggggcactggaaggttgctttacagggattgtagcgattagggttttcctgtcagtcctctgcccctttgctcagatgctgacagtgaaaccgtgaaggcagcaaaggtgtggaaactcgcagaggtcctggtgggtgagcagcagcagtgccaggatgccaagagccagcagaaggagcagatgttgctgctggagaagaagagtgctgcttactcccaggtgcttctccgctgcctcactttgctgcagaggcttcttcaagaacaccggctgaagactcaatccgagctagaccgcatcaatgcccagtacctggaagtcaagtgcggtgctatgatccttaagctgaggtgagctgtgacccctgtggatcttaagggattctgtctcacgttatcagccctctatcccttaccctaatctctttcctctcccttatcctagcgccttgtgggtatccagtaaatgtcacatagcagtattagcttttggattacccaaaagctttcaacatccttgagacttttcttttacagtcttctgaaataggcactttactgtgagatcaattgctcgggaattcagagtgaccttgtttatcctatcagtgcttagcccacaccttgaccgtcggcaggtact

SEQ ID NO: 313139 - DNA, 579 bp, Homo sapiens
  misc_feature (1)..(1): n is a, c, g, or t
ntatacggctaggtagcgaggctgggtggtgtggtctttccgggcctcgcttcccccagcccctgcgcccggcccgaacgagaggttccggagccccggcgcgggcgggttctggggtgtagacgctgctggccagcccgccccagccgaggttctcggcaccgccttgagagcttcagctgccccagggtgtgattagaatcccaagaaaatcaaatggcatccggggatttctgctcacctggagaagggatggaaatacttcaacaagtgcataagacaacatggttgaggtctgagattttacacagagtcattcaagagttgcttgtggactactatgtgaagatacaagacacaaatgtaacttctgaggacaaaaagtttcatgagacccttgaacagcggctgcttgtaactgaactgatgcggctcttaggtcctagccaggagagggagatacctccactgctggggctggagaaagcggaccttctggaactcatgccactctcagaggttggcggggagatattggaaccaaataaatgaaatggtttaatttctcccatatcttta

SEQ ID NO: 313140 - DNA, 396 bp, Homo sapiens
ttcagcaaggtctaccgttgagctctggcagggccaggagacatggcttctgcatagctgctgcctcctaatcttcctgctagtgggaccaccttcacctggggctgccttcagtacaagggagtgtggaaatgcttacgcttgaaacactgcagtcatttaggcactctcctggtttctctttattttttatgactgggcctcttctggaaaatctagcaaggagatttatataatttttatgcatagctgtgtgtcagtgtcagccctgtattgtatttgattatctcctgaataaagttatgatattataacttaggattttagtcattttccttgggcaaagattgaaaaagaacattgaaggctatatgggtaaggagcggggaactgagt

SEQ ID NO: 313141 - DNA, 763 bp, Homo sapiens
  misc_feature (1)..(1): n is a, c, g, or t
ntatacggctaggtagcgaggctgggtggtgtggtctttccgggcctcgcttcccccagcccctgcgcccggcccgaacgagaggttccggagccccggcgcgggcgggttctggggtgtagacgctgctggccagcccgccccagccgaggttctcggcaccgccttgagagcttcagctgccccagggtgtgattagaatcccaagaaaatcaaatggcatccggggatttctgctcacctggagaagggatggaaatacttcaacaagtgtgcagcaaacaacttcctccttgtaacctgagtaaagaggacctgttacagaacccatacttcagcaagcttctcctgaatctctcacagcatgtggatgagagtggcttaagcctcaccctagcaaaggagcaggctcaggcatggaaggaagttcgactgcataagacaacatggttgaggtctgagattttacacagagtcattcaagagttgcttgtggactactatgtgaagatacaagacacaaatgtaacttctgaggacaaaaagtttcatgagacccttgaacagcggctgcttgtaactgaactgatgcggctcttaggtcctagccaggagagggagatacctccactgctggggctggagaaagcggaccttctggaactcatgccactctcagaggattgtgtggatgagggctcggtacagcagaagtaaggaccagtcaaaaaatggtcacctgccggaattagacccaacattg

SEQ ID NO: 313142 - DNA, 1791 bp, Homo sapiens
cgcctcgagtgtggccccgcctccagctccttcgtcgcggcctctagtgcactttcggctccttccccttcccgggcctttcagcttggtctttccgggcctcgcttcccccagcccctgcgcccggcccgaacgagaggttccggagccccggcgcgggcgggttctggggtgtagacgctgctggccagcccgccccagccgaggttctcggcaccgccttgagagcttcagctgccccagggtgtgattagaatcccaagaaaatcaaatggcatccggggatttctgctcacctggagaagggatggaaatacttcaacaagtgtgcagcaaacaacttcctccttgtaacctgagtaaagaggacctgttacagaacccatacttcagcaagcttctcctgaatctctcacagcatgtggatgagagtggcttaagcctcaccctagcaaaggagcaggctcaggcatggaaggaagttcgactgcataagacaacatggttgaggtctgagattttacacagagtcattcaagagttgcttgtggactactatgtgaagatacaagacacaaatgtaacttctgaggacaaaaagtttcatgagacccttgaacagcggctgcttgtaactgaactgatgcggctcttaggtcctagccaggagagggagatacctccactgctggggctggagaaagcggaccttctggaactcatgccactctcagaggatttgtgtggatgagggctcggctacagcaagaagtagaggagcagctcaaaaagaaatgtttcactctgctctgctactatgatcccaattcagatgctgacagtgaaaccgtgaaggcagcaaaggtgtggaaactcgcagaggtcctggtgggtgagcagcagcagtgccaggatgccaagagccagcagaaggagcagatgttgctgctggagaagaagagtgctgcttactcccaggtttatcagggcatgggacagcccctttcctttatcctgaccccaggagcacttttggggaagacaaagattcctgatctaccctcctttctactatctttatttatgccctcttcttcctccatcttgggctcaggtgcttctccgctgcctcactttgctgcagaggcttcttcaagaacaccggctgaagactcaatccgagctagaccgcatcaatgcccagtacctggaagtcaagtgcggtgctatgatccttaagctgaggatggaggagctaaagattttgtccgacacttacactgttgagaaagtggaagttcatcgtctgattagggaccgtttggagggagccattcacctacaggagcaggacatggagaactcaagacaggtcctgaactcctatgaggtccttggggaggagtttgacaggctggtgaaagagtacaccgtactcaagcaggcaacagagaacaagcggtgggccctccaggagttcagcaaggtctaccgttgagctctggcagggccaggagacatggcttctgcatagctgctgcctcctaatcttcctgctagtgggaccaccttcacctggggctgccttcagtacaagggagtgtggaaatgcttacgcttgaaacactgcagtcatttaggcactctcctggtttctctttattttttatgactgggcctcttctggaaaatctagcaaggagatttatataatttttatgcatagctgtgtgtcagtgtcagccctgtattgtatttgattatctcctgaataaagttatgatattataa

SEQ ID NO: 313143 - DNA, 1479 bp, Homo sapiens
cgcctcgagtgtggccccgcctccagctccttcgtcgcggcctctagtgcactttcggctccttccccttcccgggcctttcagcttggtctttccgggcctcgcttcccccagcccctgcgcccggcccgaacgagaggttccggagccccggcgcgggcgggttctggggtgtagacgctgctggccagcccgccccagccgaggttctcggcaccgccttgagagcttcagctgccccagggtgtgattagaatcccaagaaaatcaaatggcatccggggatttctgctcacctggagaagggatggaaatacttcaacaagtgtgcagcaaacaacttcctccttgtaacctgagtaaagaggacctgttacagaacccatacttcagcaagcttctcctgaatctctcacagcatgtggatgagagtggcttaagcctcaccctagcaaaggagcaggctcaggcatggaaggaagttcgactgcataagacaacatggttgaggtctgagattttacacagagtcattcaagagttgcttgtggactactatgtgaagatacaagacacaaatgtaacttctgaggacaaaaagtttcatgagacccttgaacagcggctgcttgtaactgaactgatgcggctcttaggtcctagccaggagagggagatacctccactgctggggctggagaaagcggaccttctggaactcatgccactctcagaggatttgtgtggatgagggctcggctacagcaagaagtagaggagcagctcaaaaagaaatgtttcactctgctctgctactatgatcccaattcagatgctgacagtgaaaccgtgaaggcagcaaaggtgtggaaactcgcagaggtcctggtgggtgagcagcagcagtgccaggatgccaagagccagcagaaggagcagatgttgctgctggagaagaagagtgctgcttactcccaggtgcttctccgctgcctcactttgctgcagaggcttcttcaagaacaccggctgaagactcaatccgagctagaccgcatcaatgcccagtacctggaagtcaagtgcggtgctatgatccttaagctgaggatggaggagctaaagattttgtccaacagagaacaagcggtgggccctccaggagttcagcaaggtctaccgttgagctctggcagggccaggagacatggcttctgcatagctgctgcctcctaatcttcctgctagtgggaccaccttcacctggggctgccttcagtacaagggagtgtggaaatgcttacgcttgaaacactgcagtcatttaggcactctcctggtttctctttattttttatgactgggcctcttctggaaaatctagcaaggagatttatataatttttatgcatagctgtgtgtcagtgtcagccctgtattgtatttgattatctcctgaataaagttatgatattataa

SEQ ID NO: 313144 - DNA, 1675 bp, Homo sapiens
cgcctcgagtgtggccccgcctccagctccttcgtcgcggcctctagtgcactttcggctccttccccttcccgggcctttcagcttggtctttccgggcctcgcttcccccagcccctgcgcccggcccgaacgagaggttccggagccccggcgcgggcgggttctggggtgtagacgctgctggccagcccgccccagccgaggttctcggcaccgccttgagagcttcagctgccccagggtgtgattagaatcccaagaaaatcaaatggcatccggggatttctgctcacctggagaagggatggaaatacttcaacaagtgtgcagcaaacaacttcctccttgtaacctgagtaaagaggacctgttacagaacccatacttcagcaagcttctcctgaatctctcacagcatgtggatgagagtggcttaagcctcaccctagcaaaggagcaggctcaggcatggaaggaagttcgactgcataagacaacatggttgaggtctgagattttacacagagtcattcaagagttgcttgtggactactatgtgaagatacaagacacaaatgtaacttctgaggacaaaaagtttcatgagacccttgaacagcggctgcttgtaactgaactgatgcggctcttaggtcctagccaggagagggagatacctccactgctggggctggagaaagcggaccttctggaactcatgccactctcagaggatttgtgtggatgagggctcggctacagcaagaagtagaggagcagctcaaaaagaaatgtttcactctgctctgctactatgatcccaattcagtcctctgcccctttgctcagatgctgacagtgaaaccgtgaaggcagcaaaggtgtggaaactcgcagaggtcctggtgggtgagcagcagcagtgccaggatgccaagagccagcagaaggagcagatgttgctgctggagaagaagagtgctgcttactcccaggtgcttctccgctgcctcactttgctgcagaggcttcttcaagaacaccggctgaagactcaatccgagctagaccgcatcaatgcccagtacctggaagtcaagtgcggtgctatgatccttaagctgaggatggaggagctaaagattttgtccgacacttacactgttgagaaagtggaagttcatcgtctgattagggaccgtttggagggagccattcacctacaggagcaggacatggagaactcaagacaggtcctgaactcctatgaggtccttggggaggagtttgacaggctggtgaaagagtacaccgtactcaagcaggcaacagagaacaagcggtgggccctccaggagttcagcaaggtctaccgttgagctctggcagggccaggagacatggcttctgcatagctgctgcctcctaatcttcctgctagtgggaccaccttcacctggggctgccttcagtacaagggagtgtggaaatgcttacgcttgaaacactgcagtcatttaggcactctcctggtttctctttattttttatgactgggcctcttctggaaaatctagcaaggagatttatataatttttatgcatagctgtgtgtcagtgtcagccctgtattgtatttgattatctcctgaataaagttatgatattataa

SEQ ID NO: 313145 - DNA, 1509 bp, Homo sapiens
cgcctcgagtgtggccccgcctccagctccttcgtcgcggcctctagtgcactttcggctccttccccttcccgggcctttcagcttggtctttccgggcctcgcttcccccagcccctgcgcccggcccgaacgagaggttccggagccccggcgcgggcgggttctggggtgtagacgctgctggccagcccgccccagccgaggttctcggcaccgccttgagagcttcagctgccccagggtgtgattagaatcccaagaaaatcaaatggcatccggggatttctgctcacctggagaagggatggaaatacttcaacaagtgtgcagcaaacaacttcctccttgtaacctgagtaaagaggacctgttacagaacccatacttcagcaagcttctcctgaatctctcacagcatgtggatgagagtggcttaagcctcaccctagcaaaggagcaggctcaggcatggaaggaagttcgactgcataagacaacatggttgaggtctgagattttacacagagtcattcaagagttgcttgtggactactatgtgaagatacaagacacaaatgtaacttctgaggacaaaaagtttcatgagacccttgaacagcggctgcttgtaactgaactgatgcggctcttaggtcctagccaggagagggagatacctccactgctggggctggagaaagcggaccttctggaactcatgccactctcagaggatttgtgtggatgagggctcggctacagcaagaagtagaggagcagctcaaaaagaaatgtttcactctgctctgctactatgatcccaattcaggtgcttctccgctgcctcactttgctgcagaggcttcttcaagaacaccggctgaagactcaatccgagctagaccgcatcaatgcccagtacctggaagtcaagtgcggtgctatgatccttaagctgaggatggaggagctaaagattttgtccgacacttacactgttgagaaagtggaagttcatcgtctgattagggaccgtttggagggagccattcacctacaggagcaggacatggagaactcaagacaggtcctgaactcctatgaggtccttggggaggagtttgacaggctggtgaaagagtacaccgtactcaagcaggcaacagagaacaagcggtgggccctccaggagttcagcaaggtctaccgttgagctctggcagggccaggagacatggcttctgcatagctgctgcctcctaatcttcctgctagtgggaccaccttcacctggggctgccttcagtacaagggagtgtggaaatgcttacgcttgaaacactgcagtcatttaggcactctcctggtttctctttattttttatgactgggcctcttctggaaaatctagcaaggagatttatataatttttatgcatagctgtgtgtcagtgtcagccctgtattgtatttgattatctcctgaataaagttatgatattataa

SEQ ID NO: 313146 - DNA, 1828 bp, Homo sapiens
cgcctcgagtgtggccccgcctccagctccttcgtcgcggcctctagtgcactttcggctccttccccttcccgggcctttcagcttggtctttccgggcctcgcttcccccagcccctgcgcccggcccgaacgagaggttccggagccccggcgcgggcgggttctggggtgtagacgctgctggccagcccgccccagccgaggttctcggcaccgccttgagagcttcagctgccccagggtgtgcaggtttgctttagagggtcggcgggcggagcttcggggaagaggagctctgggagagtcattccggccagtggccggagaccgtcgtcgctcttgggaatccttggccgcccagacagaagggaagtaggcgccggagagcccgttctgcattttgattcatctcgggccctattagaatcccaagaaaatcaaatggcatccggggatttctgctcacctggagaagggatggaaatacttcaacaagtgtgcagcaaacaacttcctccttgtaacctgagtaaagaggacctgttacagaacccatacttcagcaagcttctcctgaatctctcacagcatgtggatgagagtggcttaagcctcaccctagcaaaggagcaggctcaggcatggaaggaagttcgactgcataagacaacatggttgaggtctgagattttacacagagtcattcaagagttgcttgtggactactatgtgaagatacaagacacaaatgtaacttctgaggacaaaaagtttcatgagacccttgaacagcggctgcttgtaactgaactgatgcggctcttaggtcctagccaggagagggagatacctccactgctggggctggagaaagcggaccttctggaactcatgccactctcagaggatttgtgtggatgagggctcggctacagcaagaagtagaggagcagctcaaaaagaaatgtttcactctgctctgctactatgatcccaattcagatgctgacagtgaaaccgtgaaggcagcaaaggtgtggaaactcgcagaggtcctggtgggtgagcagcagcagtgccaggatgccaagagccagcagaaggagcagatgttgctgctggagaagaagagtgctgcttactcccaggtgcttctccgctgcctcactttgctgcagaggcttcttcaagaacaccggctgaagactcaatccgagctagaccgcatcaatgcccagtacctggaagtcaagtgcggtgctatgatccttaagctgaggatggaggagctaaagattttgtccgacacttacactgttgagaaagtggaagttcatcgtctgattagggaccgtttggagggagccattcacctacaggagcaggacatggagaactcaagacaggtcctgaactcctatgaggtccttggggaggagtttgacaggctggtgaaagagtacaccgtactcaagcaggcaacagagaacaagcggtgggccctccaggagttcagcaaggtctaccgttgagctctggcagggccaggagacatggcttctgcatagctgctgcctcctaatcttcctgctagtgggaccaccttcacctggggctgccttcagtacaagggagtgtggaaatgcttacgcttgaaacactgcagtcatttaggcactctcctggtttctctttattttttatgactgggcctcttctggaaaatctagcaaggagatttatataatttttatgcatagctgtgtgtcagtgtcagccctgtattgtatttgattatctcctgaataaagttatgatattataa

SEQ ID NO: 313147 - DNA, 1540 bp, Homo sapiens
cgcctcgagtgtggccccgcctccagctccttcgtcgcggcctctagtgcactttcggctccttccccttcccgggcctttcagcttggtctttccgggcctcgcttcccccagcccctgcgcccggcccgaacgagaggttccggagccccggcgcgggcgggttctggggtgtagacgctgctggccagcccgccccagccgaggttctcggcaccgccttgagagcttcagctgccccagggtgtgattagaatcccaagaaaatcaaatggcatccggggatttctgctcacctggagaagggatggaaatacttcaacaagtgtgcagcaaacaacttcctccttgtaacctgagtaaagaggacctgttacagaacccatacttcagcaagcttctcctgaatctctcacagcatgtggatgagagtggcttaagcctcaccctagcaaaggagcaggctcaggcatggaaggaagttcgactgcataagacaacatggttgaggtctgagattttacacagagtcattcaagagttgcttgtggactactatgtgaagatacaagacacaaatgtaacttctgaggacaaaaaggatttgtgtggatgagggctcggctacagcaagaagtagaggagcagctcaaaaagaaatgtttcactctgctctgctactatgatcccaattcagtcctctgcccctttgctcagatgctgacagtgaaaccgtgaaggcagcaaaggtgtggaaactcgcagaggtcctggtgggtgagcagcagcagtgccaggatgccaagagccagcagaaggagcagatgttgctgctggagaagaagagtgctgcttactcccaggtgcttctccgctgcctcactttgctgcagaggcttcttcaagaacaccggctgaagactcaatccgagctagaccgcatcaatgcccagtacctggaagtcaagtgcggtgctatgatccttaagctgaggatggaggagctaaagattttgtccgacacttacactgttgagaaagtggaagttcatcgtctgattagggaccgtttggagggagccattcacctacaggagcaggacatggagaactcaagacaggtcctgaactcctatgaggtccttggggaggagtttgacaggctggtgaaagagtacaccgtactcaagcaggcaacagagaacaagcggtgggccctccaggagttcagcaaggtctaccgttgagctctggcagggccaggagacatggcttctgcatagctgctgcctcctaatcttcctgctagtgggaccaccttcacctggggctgccttcagtacaagggagtgtggaaatgcttacgcttgaaacactgcagtcatttaggcactctcctggtttctctttattttttatgactgggcctcttctggaaaatctagcaaggagatttatataatttttatgcatagctgtgtgtcagtgtcagccctgtattgtatttgattatctcctgaataaagttatgatattataa

SEQ ID NO: 313148 - DNA, 888 bp, Homo sapiens
gcacgagaaaaggttctataatgcagattttatagaaccttttgtacaccctatgggttcttgatgcaaccagtaattttaaataaataaattctacctccaaggaggctgcagctaaaccaacataaggtgtacaaaaggttctataaaatctgcattatagagacaaagaggcaggcaaatccatgtcacaagggtaaagcttacagtttacaaactgggaacgccagggtgtaggatataaaaacgcactcttgagaaaacaaatgtaatcagggtgctgaaaacttgcatggtgctttcagacattagccttgttcaacaaatttcttgtattgacagatccatagtgtgcatgggcagacacattttgcctctatgtctcttaaaattttaattaaaaatactctttccagtaatcctaatttgcacgaagatataatgtccacattacgtgccttgccttgaaatctaaaaaacaaaaaacaaaaaaaaaaaaacaaaaaaatacaacaaagtgacatcactacacttgttttgctgcatttattatcattttaaatctttaccatttttatgacaaaatattttgtactccagacgaagaaaaatgtgtgacatcatggattttttagacagttatacctttatctcacatttataaagcatatcatggctgtgtatagttgccgcttaaaaattgtaatcgaccagcaatattttcagtattttggtgtttttttctattaacctttcatgtttttcatcttccaattaatatttgggggggaggggtttcaaatttatacgaattatgcaataccaagttttgcctatgtaggtagtgcttttagctgtattggttattataggtaagtacacagattt

SEQ ID NO: 313149 - DNA, 970 bp, Homo sapiens
atgaacagcacactgaggaggacacaaaagaagtagacagaatctctgcctctgcttaggagtatgcaatttagttggggcgacaaaacttaaatgctagaaccaataaaagaagattacaaagcaactcgcaaattctggacaatcaggaagtccaagccacaatgatcctgccaagaatcctccaggttaccttgaggatagttttgtaaaatctggagtcttcaatgtatcagaacttgtaagagtatccagaacgcccataacccagggaactggagtcaacttcccaattggagaaatcccaagccaaccatactatcatgacatgaactcgggggtcaatcttcagaggtctctgtcttctccaccaagcagcaaaagacccaaaactatatccatagatgaaaatatggaaccaagtcctacaggagacttttacccctctccaagttcaccagctgctggaagtcgaacatggcacgaaagagatcaagatatgtcttctccgactactatgaagaagcctgaaaagccattgttcagctctgcatctccacaggattcttccccaagactgagcactttcccccagcaccaccatcccggaatacctggagttgcacacagtgtcatctcaactcgaactccacctccaccttcaccgttgccatttccaacacaagctatccttcctccagccccatcgagctacttttctcatccaacaatcagatatcctccccacctgaatcctcaggatactctgaagaactatgtaccttcttatgacccatccagtccacaaaccagccagtcctgggtacctgggtagctggggcctttcccagtgtcgaaagggaacccctttttacggacagtccaaatccggttgacctatggggaacttccttagagaaaagcactggggaagacacccagttgaaatttttcaaacacaaaggaggag

SEQ ID NO: 313150 - DNA, 518 bp, Homo sapiens
tgcctcttgggaaagtaaggttaatgccatgtacagtactagtttgcatgtgttcatttaaatactaaaaactgtagtactgctcgatccatatctgactgctaggtttcaattgacagctgaggatttgtgactggaccatgaatcaaaacggcaggcatttataccccagtaccagtgaggatacattgggaattacttggcaaaggtaacattttaattatttccaaccctacacttacacctaaaaattacatgagctatagtgtttgtttttaactagctttacagaaaatatatgttaaaaatttagttgttttggctatgccattcttctttccctgtcctcctcctttatttcttatgtaaatggaacgtcaaattaagttgggactatagtatatgcttactgatcattggaatttttaaatgctataaaatgttttctacaatttatactgtttttggtgggggagggggtggaatgtgacatttagattttaggacctgaaaagtga

SEQ ID NO: 313151 - DNA, 3095 bp, Homo sapiens
tcccgcgcccccctccccgccttttttgaaaaagcattttaccaccaaccaccaccccaatccaacccacaccgaaccttcgcgcaccccctacaccccaacaacaacaacaactgcaaaatagaaaacaaatccccaaacccaggcgaaaagcagccaacaccggcggcggcggcggcctcggcaagcacggccagcgcgctcggactgcaagagggttaaaagtgtagattggatttcacccctggaactctagcacgccgagtgaacttgaatctttggctatttaaggaggactgggtttgttgtgaagttgcggtgatccagcgcagagccccgtcctgattgatcgcatcgcggggctcagatgactgtaaaatgaatagatgaaattcttgcttctcgaagattttcttgggcatctcccggaaagtgcgttttaaggcgaagtcatgatgtattctcccatctgtctcactcaggatgaatttcacccattcatcgaggcacttcttccacatgtccgtgcaattgcctatacttggttcaacctgcaggctcgaaaacgcaagtactttaaaaagcatgagaagcgaatgtcaaaggatgaagaaagagcagtcaaagatgagcttctcagtgaaaagcctgaaatcaaacagaagtgggcatccaggctccttgccaaactgcgcaaagatattcgccaggagtatcgagaggactttgtgctcaccgtgactggcaagaagcacccgtgctgtgtcttatccaatcccgaccagaagggtaagattaggagaatcgactgcctgcgacaggcagacaaagtctggcgtctggatctagtcatggtgatcctgttcaaaggcatccccttggaaagtaccgatggagagcggctcatgaaatccccacattgcacaaacccagcactttgtgtccagccacatcatatcacagtatcagttaaggagcttgatttgtttttggcatactacgtgcaggagcaagattctggacaatcaggaagtccaagccacaatgatcctgccaagaatcctccaggttaccttgaggatagttttgtaaaatctggagtcttcaatgtatcagaacttgtaagagtatccagaacgcccataacccagggaactggagtcaacttcccaattggagaaatcccaagccaaccatactatcatgacatgaactcgggggtcaatcttcagaggtctctgtcttctccaccaagcagcaaaagacccaaaactatatccatagatgaaaatatggaaccaagtcctacaggagacttttacccctctccaagttcaccagctgctggaagtcgaacatggcacgaaagagatcaagatatgtcttctccgactactatgaagaagcctgaaaagccattgttcagctctgcatctccacaggattcttccccaagactgagcactttcccccagcaccaccatcccggaatacctggagttgcacacagtgtcatctcaactcgaactccacctccaccttcaccgttgccatttccaacacaagctatccttcctccagccccatcgagctacttttctcatccaacaatcagatatcctccccacctgaatcctcaggatactctgaagaactatgtaccttcttatgacccatccagtccacaaaccagccagtcctggtacctgggctagcttggttcctttccaagtgtcaaataggacacccatcttaccggccaatgtccaaaattacggtttgaacataattggagaacctttccttcaagcagaaacaagcaactgagggaaaaagaaacacaacaatagtttaagaaattttttttttaaataaaaaaaaaggaaaagaggaagactggacaaaacaacacaaaggcagaaaggaaagaaactgaagaaagaagataatagaccagcaattgcagcacttacaatcactaattcccttaaggttgaaactgtaatgacataaaaagggtcgatgatatttcactgatggtagatcgcagcccctgcaacgtagcctttgttacatgaagtccgctgggaaatagatgttctgtctctatgacaatatattttaactgactttctagatgccttaatatttgcatgataagctagttttattggtttagtattcttgttgtttacgcatggaatcactattcctggttatctcaccaacgaaggctaggaggcggcgtcagaggtgctgggtgacagagccatgagccagccattttataagcactctgatttctaaaagttaaaaaaaatatatgaaatctctgtagcctttagttatcagtacagatttattaaatttcggcccttaacccagccttttccagtgtgtaacccagtttgaaatcttaaaaaaagaaaaaatgaaaaaaaaaggaaaaaaagaaaaaaggaaaaaaacagtttgaacacaaaggctctatggaagaaatgcctctatgtaggtgaagtgttctctctgcatgcaacagtaaaaattaatataatattttccccacaaaagaaacacttaacagaggcaagtgcaatttataaatttatatctaaaggggaatcatgattataagtccttcagcccttggactctaaattgaggggattaaaaagaatttaaaataattttgaacgaatttattttcccctcagtttttgagggcattaaaaaggcattaaatcaagacaaatcatgtgcttgagaaaaataaaattaatgaaaacacagcacttatgttggtttagctgcagcctccttggaggtagaatttatttatttaaaattactggttgcatcaagaacccatagggtgtacaaaaggttctataaaatctgcattatagagacaaagaggggaatcctgtcacaggtaagctaagttacaactggaagcggggtggttaaaaacgctttggaaaaaaagtatcgggggcactgtgggttcgattagccggtcaatttggttggcacccggtggggacattgcttcttataaaatttcacatgggaatggacctgggtaaaaacaaagt

SEQ ID NO: 313152 - DNA, 3969 bp, Homo sapiens
tcccgcgcccccctccccgccttttttgaaaaagcattttaccaccaaccaccaccccaatccaacccacaccgaaccttcgcgcaccccctacaccccaacaacaacaacaactgcaaaatagaaaacaaatccccaaacccaggcgaaaagcagccaacaccggcggcggcggcggcctcggcaagcacggccagcgcgctcggactgcaagagggttaaaagtgtagattggatttcacccctggaactctagcacgccgagtgaacttgaatctttggctatttaaggaggactgggtttgttgtgaagttgcggtgatccagcgcagagccccgtcctgattgatcgcatcgcggggctcagatgactgtaaaatgaatagatgaaattcttgcttctcgaagattttcttgggcatctcccggaaagtgcgttttaaggcgaagtcatgatgtattctcccatctgtctcactcaggatgaatttcacccattcatcgaggcacttcttccacatgtccgtgcaattgcctatacttggttcaacctgcaggctcgaaaacgcaagtactttaaaaagcatgagaagcgaatgtcaaaggatgaagaaagagcagtcaaagatgagcttctcagtgaaaagcctgaaatcaaacagaagtgggcatccaggctccttgccaaactgcgcaaagatattcgccaggagtatcgagaggactttgtgctcaccgtgactggcaagaagcacccgtgctgtgtcttatccaatcccgaccagaagggtaagattaggagaatcgactgcctgcgacaggcagacaaagtctggcgtctggatctagtcatggtgatcctgttcaaaggcatccccttggaaagtaccgatggagagcggctcatgaaatccccacattgcacaaacccagcactttgtgtccagccacatcatatcacagtatcagttaaggagcttgatttgtttttggcatactacgtgcaggagcaagattctggacaatcaggaagtccaagccacaatgatcctgccaagaatcctccaggttaccttgaggatagttttgtaaaatctggagtcttcaatgtatcagaacttgtaagagtatccagaacgcccataacccagggaactggagtcaacttcccaattggagaaatcccaagccaaccatactatcatgacatgaactcgggggtcaatcttcagaggtctctgtcttctccaccaagcagcaaaagacccaaaactatatccatagatgaaaatatggaaccaagtcctacaggagacttttacccctctccaagttcaccagctgctggaagtcgaacatggcacgaaagagatcaagatatgtcttctccgactactatgaagaagcctgaaaagccattgttcagctctgcatctccacaggattcttccccaagactgagcactttcccccagcaccaccatcccggaatacctggagttgcacacagtgtcatctcaactcgaactccacctccaccttcaccgttgccatttccaacacaagctatccttcctccagccccatcgagctacttttctcatccaacaatcagatatcctccccacctgaatcctcaggatactctgaagaactatgtaccttcttatgacccatccagtccacaaaccagccagcctaacggcagtggtcaagtagtagggaaagtgcctggccatttcactcctgtcttggcaccctctccccatcccagtgcagtgcgacctgtgaccctgagcatgacagatactaaacccatcactacatccactgaaggtgaggcagcttcacctacagcaaccacctacacagcctcaggcacatctcaagccaatcgatatgtgggactaagcccaagagacccatccttcctacatcagcaacagctgaggatttgtgactggaccatgaatcaaaacggcaggcatttataccccagtaccagtgaggatacattgggaattacttggcaaagtcctggtacctgggctagcttggttcctttccaagtgtcaaataggacacccatcttaccggccaatgtccaaaattacggtttgaacataattggagaacctttccttcaagcagaaacaagcaactgagggaaaaagaaacacaacaatagtttaagaaattttttttttaaataaaaaaaaaggaaaagaggaagactggacaaaacaacacaaaggcagaaaggaaagaaactgaagaaagaagataatagaccagcaattgcagcacttacaatcactaattcccttaaggttgaaactgtaatgacataaaaagggtcgatgatatttcactgatggtagatcgcagcccctgcaacgtagcctttgttacatgaagtccgctgggaaatagatgttctgtctctatgacaatatattttaactgactttctagatgccttaatatttgcatgataagctagttttattggtttagtattcttgttgtttacgcatggaatcactattcctggttatctcaccaacgaaggctaggaggcggcgtcagaggtgctgggtgacagagccatgagccagccattttataagcactctgatttctaaaagttaaaaaaaatatatgaaatctctgtagcctttagttatcagtacagatttattaaatttcggcccttaacccagccttttccagtgtgtaacccagtttgaaatcttaaaaaaagaaaaaatgaaaaaaaaaggaaaaaaagaaaaaaggaaaaaaacagtttgaacacaaaggctctatggaagaaatgcctctatgtaggtgaagtgttctctctgcatgcaacagtaaaaattaatataatattttccccacaaaagaaacacttaacagaggcaagtgcaatttataaatttatatctaaaggggaatcatgattataagtccttcagcccttggactctaaattgaggggattaaaaagaatttaaaataattttgaacgaatttattttcccctcagtttttgagggcattaaaaaggcattaaatcaagacaaatcatgtgcttgagaaaaataaaattaatgaaaacacagcacttatgttggtttagctgcagcctccttggaggtagaatttatttatttaaaattactggttgcatcaagaacccatagggtgtacaaaaggttctataaaatctgcattatagagacaaagaggcaggcaaatccatgtcacaagggtaaagcttacagtttacaaactgggaacgccagggtgtaggatataaaaacgcactcttgagaaaacaaatgtaatcagggtgctgaaaacttgcatggtgctttcagacattagccttgttcaacaaatttcttgtattgacagatccatagtgtgcatgggcagacacattttgcctctatgtctcttaaaattttaattaaaaatactctttccagtaatcctaatttgcacgaagatataatgtccacattacgtgccttgccttgaaatctaaaaaacaaaaaacaaaaaaaaaaaaacaaaaaaatacaacaaagtgacatcactacacttgttttgctgcatttattatcattttaaatctttaccatttttatgacaaaatattttgtactccagacgaagaaaaatgtgtgacatcatggattttttagacagttatacctttatctcacatttataaagcatatcatggctgtgtatagttgccgcttaaaaattgtaatcgaccagcaatattttcagtattttggtgtttttttctattaacctttcatgtttttcatcttccaattaatatttgggggggaggggtttcaaatttatacgaattatgcaataccaagttttgcctatgtaggtagtgcttttagctgtattggttattataggtaagtacacagattt

SEQ ID NO: 313153 - DNA, 3406 bp, Homo sapiens
tcccgcgcccccctccccgccttttttgaaaaagcattttaccaccaaccaccaccccaatccaacccacaccgaaccttcgcgcaccccctacaccccaacaacaacaacaactgcaaaatagaaaacaaatccccaaacccaggcgaaaagcagccaacaccggcggcggcggcggcctcggcaagcacggccagcgcgctcggactgcaagagggttaaaagtgtagattggatttcacccctggaactctagcacgccgagtgaacttgaatctttggctatttaaggaggactgggtttgttgtgaagttgcggtgatccagcgcagagccccgtcctgattgatcgcatcgcggggctcagatgactgtaaaatgaatagatgaaattcttgcttctcgaagattttcttgggcatctcccggaaagtgcgttttaaggcgaagtcatgatgtattctcccatctgtctcactcaggatgaatttcacccattcatcgaggcacttcttccacatgtccgtgcaattgcctatacttggttcaacctgcaggctcgaaaacgcaagtactttaaaaagcatgagaagcgaatgtcaaaggatgaagaaagagcagtcaaagatgagcttctcagtgaaaagcctgaaatcaaacagaagtgggcatccaggctccttgccaaactgcgcaaagatattcgccaggagtatcgagaggactttgtgctcaccgtgactggcaagaagcacccgtgctgtgtcttatccaatcccgaccagaaggattctggacaatcaggaagtccaagccacaatgatcctgccaagaatcctccaggttaccttgaggatagttttgtaaaatctggagtcttcaatgtatcagaacttgtaagagtatccagaacgcccataacccagggaactggagtcaacttcccaattggagaaatcccaagccaaccatactatcatgacatgaactcgggggtcaatcttcagaggtctctgtcttctccaccaagcagcaaaagacccaaaactatatccatagatgaaaatatggaaccaagtcctacaggagacttttacccctctccaagttcaccagctgctggaagtcgaacatggcacgaaagagatcaagatatgtcttctccgactactatgaagaagcctgaaaagccattgttcagctctgcatctccacaggattcttccccaagactgagcactttcccccagcaccaccatcccggaatacctggagttgcacacagtgtcatctcaactcgaactccacctccaccttcaccgttgccatttccaacacaagctatccttcctccagccccatcgagctacttttctcatccaacaatcagatatcctccccacctgaatcctcaggatactctgaagaactatgtaccttcttatgacccatccagtccacaaaccagccagtcctggtacctgggctagcttggttcctttccaagtgtcaaataggacacccatcttaccggccaatgtccaaaattacggtttgaacataattggagaacctttccttcaagcagaaacaagcaactgagggaaaaagaaacacaacaatagtttaagaaattttttttttaaataaaaaaaaaggaaaagaggaagactggacaaaacaacacaaaggcagaaaggaaagaaactgaagaaagaagataatagaccagcaattgcagcacttacaatcactaattcccttaaggttgaaactgtaatgacataaaaagggtcgatgatatttcactgatggtagatcgcagcccctgcaacgtagcctttgttacatgaagtccgctgggaaatagatgttctgtctctatgacaatatattttaactgactttctagatgccttaatatttgcatgataagctagttttattggtttagtattcttgttgtttacgcatggaatcactattcctggttatctcaccaacgaaggctaggaggcggcgtcagaggtgctgggtgacagagccatgagccagccattttataagcactctgatttctaaaagttaaaaaaaatatatgaaatctctgtagcctttagttatcagtacagatttattaaatttcggcccttaacccagccttttccagtgtgtaacccagtttgaaatcttaaaaaaagaaaaaatgaaaaaaaaaggaaaaaaagaaaaaaggaaaaaaacagtttgaacacaaaggctctatggaagaaatgcctctatgtaggtgaagtgttctctctgcatgcaacagtaaaaattaatataatattttccccacaaaagaaacacttaacagaggcaagtgcaatttataaatttatatctaaaggggaatcatgattataagtccttcagcccttggactctaaattgaggggattaaaaagaatttaaaataattttgaacgaatttattttcccctcagtttttgagggcattaaaaaggcattaaatcaagacaaatcatgtgcttgagaaaaataaaattaatgaaaacacagcacttatgttggtttagctgcagcctccttggaggtagaatttatttatttaaaattactggttgcatcaagaacccatagggtgtacaaaaggttctataaaatctgcattatagagacaaagaggcaggcaaatccatgtcacaagggtaaagcttacagtttacaaactgggaacgccagggtgtaggatataaaaacgcactcttgagaaaacaaatgtaatcagggtgctgaaaacttgcatggtgctttcagacattagccttgttcaacaaatttcttgtattgacagatccatagtgtgcatgggcagacacattttgcctctatgtctcttaaaattttaattaaaaatactctttccagtaatcctaatttgcacgaagatataatgtccacattacgtgccttgccttgaaatctaaaaaacaaaaaacaaaaaaaaaaaaacaaaaaaatacaacaaagtgacatcactacacttgttttgctgcatttattatcattttaaatctttaccatttttatgacaaaatattttgtactccagacgaagaaaaatgtgtgacatcatggattttttagacagttatacctttatctcacatttataaagcatatcatggctgtgtatagttgccgcttaaaaattgtaatcgaccagcaatattttcagtattttggtgtttttttctattaacctttcatgtttttcatcttccaattaatatttgggggggaggggtttcaaatttatacgaattatgcaataccaagttttgcctatgtaggtagtgcttttagctgtattggttattataggtaagtacacagattt

SEQ ID NO: 313154 - DNA, 3942 bp, Homo sapiens
tcccgcgcccccctccccgccttttttgaaaaagcattttaccaccaaccaccaccccaatccaacccacaccgaaccttcgcgcaccccctacaccccaacaacaacaacaactgcaaaatagaaaacaaatccccaaacccaggcgaaaagcagccaacaccggcggcggcggcggcctcggcaagcacggccagcgcgctcggactgcaagagggttaaaagtgtagattggatttcacccctggaactctagcacgccgagtgaacttgaatctttggctatttaaggaggactgggtttgttgtgaagttgcggtgatccagcgcagagccccgtcctgattgatcgcatcgcggggctcagatgactgtaaaatgaatagatgaaattcttgcttctcgaagattttcttgggcatctcccggaaagtgcgttttaaggcgaagtcatgatgtattctcccatctgtctcactcaggatgaatttcacccattcatcgaggcacttcttccacatgtccgtgcaattgcctatacttggttcaacctgcaggctcgaaaacgcaagtactttaaaaagcatgagaagcgaatgtcaaaggatgaagaaagagcagtcaaagatgagcttctcagtgaaaagcctgaaatcaaacagaagtgggcatccaggctccttgccaaactgcgcaaagatattcgccaggagtatcgagaggactttgtgctcaccgtgactggcaagaagcacccgtgctgtgtcttatccaatcccgaccagaagggtaagattaggagaatcgactgcctgcgacaggcagacaaagtctggcgtctggatctagtcatggtgatcctgttcaaaggcatccccttggaaagtaccgatggagagcggctcatgaaatccccacattgcacaaacccagcactttgtgtccagccacatcatatcacagtatcagttaaggagcttgatttgtttttggcatactacgtgcaggagcaagattctggacaatcaggaagtccaagccacaatgatcctgccaagaatcctccaggttaccttgaggatagttttgtaaaatctggagtcttcaatgtatcagaacttgtaagagtatccagaacgcccataacccagggaactggagtcaacttcccaattggagaaatcccaagccaaccatactatcatgacatgaactcgggggtcaatcttcagaggtctctgtcttctccaccaagcagcaaaagacccaaaactatatccatagatgaaaatatggaaccaagtcctacaggagacttttacccctctccaagttcaccagctgctggaagtcgaacatggcacgaaagagatcaagatatgtcttctccgactactatgaagaagcctgaaaagccattgttcagctctgcatctccacaggattcttccccaagactgagcactttcccccagcaccaccatcccggaatacctggagttgcacacagtgtcatctcaactcgaactccacctccaccttcaccgttgccatttccaacacaagctatccttcctccagccccatcgagctacttttctcatccaacaatcagatatcctccccacctgaatcctcaggatactctgaagaactatgtaccttcttatgacccatccagtccacaaaccagccagcctaacggcagtggtcaagtagtagggaaagtgcctggccatttcactcctgtcttggcaccctctccccatcccagtgcagtgcgacctgtgaccctgagcatgacagatactaaacccatcactacatccactgaagcctacacagcctcaggcacatctcaagccaatcgatatgtgggactaagcccaagagacccatccttcctacatcagcaacagctgaggatttgtgactggaccatgaatcaaaacggcaggcatttataccccagtaccagtgaggatacattgggaattacttggcaaagtcctggtacctgggctagcttggttcctttccaagtgtcaaataggacacccatcttaccggccaatgtccaaaattacggtttgaacataattggagaacctttccttcaagcagaaacaagcaactgagggaaaaagaaacacaacaatagtttaagaaattttttttttaaataaaaaaaaaggaaaagaggaagactggacaaaacaacacaaaggcagaaaggaaagaaactgaagaaagaagataatagaccagcaattgcagcacttacaatcactaattcccttaaggttgaaactgtaatgacataaaaagggtcgatgatatttcactgatggtagatcgcagcccctgcaacgtagcctttgttacatgaagtccgctgggaaatagatgttctgtctctatgacaatatattttaactgactttctagatgccttaatatttgcatgataagctagttttattggtttagtattcttgttgtttacgcatggaatcactattcctggttatctcaccaacgaaggctaggaggcggcgtcagaggtgctgggtgacagagccatgagccagccattttataagcactctgatttctaaaagttaaaaaaaatatatgaaatctctgtagcctttagttatcagtacagatttattaaatttcggcccttaacccagccttttccagtgtgtaacccagtttgaaatcttaaaaaaagaaaaaatgaaaaaaaaaggaaaaaaagaaaaaaggaaaaaaacagtttgaacacaaaggctctatggaagaaatgcctctatgtaggtgaagtgttctctctgcatgcaacagtaaaaattaatataatattttccccacaaaagaaacacttaacagaggcaagtgcaatttataaatttatatctaaaggggaatcatgattataagtccttcagcccttggactctaaattgaggggattaaaaagaatttaaaataattttgaacgaatttattttcccctcagtttttgagggcattaaaaaggcattaaatcaagacaaatcatgtgcttgagaaaaataaaattaatgaaaacacagcacttatgttggtttagctgcagcctccttggaggtagaatttatttatttaaaattactggttgcatcaagaacccatagggtgtacaaaaggttctataaaatctgcattatagagacaaagaggcaggcaaatccatgtcacaagggtaaagcttacagtttacaaactgggaacgccagggtgtaggatataaaaacgcactcttgagaaaacaaatgtaatcagggtgctgaaaacttgcatggtgctttcagacattagccttgttcaacaaatttcttgtattgacagatccatagtgtgcatgggcagacacattttgcctctatgtctcttaaaattttaattaaaaatactctttccagtaatcctaatttgcacgaagatataatgtccacattacgtgccttgccttgaaatctaaaaaacaaaaaacaaaaaaaaaaaaacaaaaaaatacaacaaagtgacatcactacacttgttttgctgcatttattatcattttaaatctttaccatttttatgacaaaatattttgtactccagacgaagaaaaatgtgtgacatcatggattttttagacagttatacctttatctcacatttataaagcatatcatggctgtgtatagttgccgcttaaaaattgtaatcgaccagcaatattttcagtattttggtgtttttttctattaacctttcatgtttttcatcttccaattaatatttgggggggaggggtttcaaatttatacgaattatgcaataccaagttttgcctatgtaggtagtgcttttagctgtattggttattataggtaagtacacagattt

SEQ ID NO: 313155 - DNA, 3720 bp, Homo sapiens
tcccgcgcccccctccccgccttttttgaaaaagcattttaccaccaaccaccaccccaatccaacccacaccgaaccttcgcgcaccccctacaccccaacaacaacaacaactgcaaaatagaaaacaaatccccaaacccaggcgaaaagcagccaacaccggcggcggcggcggcctcggcaagcacggccagcgcgctcggactgcaagagggttaaaagtgtagattggatttcacccctggaactctagcacgccgagtgaacttgaatctttggctatttaaggaggactgggtttgttgtgaagttgcggtgatccagcgcagagccccgtcctgattgatcgcatcgcggggctcagatgactgtaaaatgaatagatgaaattcttgcttctcgaagattttcttgggcatctcccggaaagtgcgttttaaggcgaagtcatgatgtattctcccatctgtctcactcaggatgaatttcacccattcatcgaggcacttcttccacatgtccgtgcaattgcctatacttggttcaacctgcaggctcgaaaacgcaagtactttaaaaagcatgagaagcgaatgtcaaaggatgaagaaagagcagtcaaagatgagcttctcagtgaaaagcctgaaatcaaacagaagtgggcatccaggctccttgccaaactgcgcaaagatattcgccaggagtatcgagaggactttgtgctcaccgtgactggcaagaagcacccgtgctgtgtcttatccaatcccgaccagaagggtaagattaggagaatcgactgcctgcgacaggcagacaaagtctggcgtctggatctagtcatggtgatcctgttcaaaggcatccccttggaaagtaccgatggagagcggctcatgaaatccccacattgcacaaacccagcactttgtgtccagccacatcatatcacagtatcagttaaggagcttgatttgtttttggcatactacgtgcaggagcaagattctggacaatcaggaagtccaagccacaatgatcctgccaagaatcctccaggttaccttgaggatagttttgtaaaatctggagtcttcaatgtatcagaacttgtaagagtatccagaacgcccataacccagggaactggagtcaacttcccaattggagaaatcccaagccaaccatactatcatgacatgaactcgggggtcaatcttcagaggtctctgtcttctccaccaagcagcaaaagacccaaaactatatccatagatgaaaatatggaaccaagtcctacaggagacttttacccctctccaagttcaccagctgctggaagtcgaacatggcacgaaagagatcaagatatgtcttctccgactactatgaagaagcctgaaaagccattgttcagctctgcatctccacaggattcttccccaagactgagcactttcccccagcaccaccatcccggaatacctggagttgcacacagtgtcatctcaactcgaactccacctccaccttcaccgttgccatttccaacacaagctatccttcctccagccccatcgagctacttttctcatccaacaatcagatatcctccccacctgaatcctcaggatactctgaagaactatgtaccttcttatgacccatccagtccacaaaccagccagctgaggatttgtgactggaccatgaatcaaaacggcaggcatttataccccagtaccagtgaggatacattgggaattacttggcaaagtcctggtacctgggctagcttggttcctttccaagtgtcaaataggacacccatcttaccggccaatgtccaaaattacggtttgaacataattggagaacctttccttcaagcagaaacaagcaactgagggaaaaagaaacacaacaatagtttaagaaattttttttttaaataaaaaaaaaggaaaagaggaagactggacaaaacaacacaaaggcagaaaggaaagaaactgaagaaagaagataatagaccagcaattgcagcacttacaatcactaattcccttaaggttgaaactgtaatgacataaaaagggtcgatgatatttcactgatggtagatcgcagcccctgcaacgtagcctttgttacatgaagtccgctgggaaatagatgttctgtctctatgacaatatattttaactgactttctagatgccttaatatttgcatgataagctagttttattggtttagtattcttgttgtttacgcatggaatcactattcctggttatctcaccaacgaaggctaggaggcggcgtcagaggtgctgggtgacagagccatgagccagccattttataagcactctgatttctaaaagttaaaaaaaatatatgaaatctctgtagcctttagttatcagtacagatttattaaatttcggcccttaacccagccttttccagtgtgtaacccagtttgaaatcttaaaaaaagaaaaaatgaaaaaaaaaggaaaaaaagaaaaaaggaaaaaaacagtttgaacacaaaggctctatggaagaaatgcctctatgtaggtgaagtgttctctctgcatgcaacagtaaaaattaatataatattttccccacaaaagaaacacttaacagaggcaagtgcaatttataaatttatatctaaaggggaatcatgattataagtccttcagcccttggactctaaattgaggggattaaaaagaatttaaaataattttgaacgaatttattttcccctcagtttttgagggcattaaaaaggcattaaatcaagacaaatcatgtgcttgagaaaaataaaattaatgaaaacacagcacttatgttggtttagctgcagcctccttggaggtagaatttatttatttaaaattactggttgcatcaagaacccatagggtgtacaaaaggttctataaaatctgcattatagagacaaagaggcaggcaaatccatgtcacaagggtaaagcttacagtttacaaactgggaacgccagggtgtaggatataaaaacgcactcttgagaaaacaaatgtaatcagggtgctgaaaacttgcatggtgctttcagacattagccttgttcaacaaatttcttgtattgacagatccatagtgtgcatgggcagacacattttgcctctatgtctcttaaaattttaattaaaaatactctttccagtaatcctaatttgcacgaagatataatgtccacattacgtgccttgccttgaaatctaaaaaacaaaaaacaaaaaaaaaaaaacaaaaaaatacaacaaagtgacatcactacacttgttttgctgcatttattatcattttaaatctttaccatttttatgacaaaatattttgtactccagacgaagaaaaatgtgtgacatcatggattttttagacagttatacctttatctcacatttataaagcatatcatggctgtgtatagttgccgcttaaaaattgtaatcgaccagcaatattttcagtattttggtgtttttttctattaacctttcatgtttttcatcttccaattaatatttgggggggaggggtttcaaatttatacgaattatgcaataccaagttttgcctatgtaggtagtgcttttagctgtattggttattataggtaagtacacagattt

SEQ ID NO: 313156 - DNA, 2751 bp, Homo sapiens
atgaacagcacactgaggaggacacaaaagaagtagacagaatctctgcctctgcttaggagtatgcaatttagttggggcgacaaaacttaaatgctagaaccaataaaagaagattacaaagcaactcgcaaattctggacaatcaggaagtccaagccacaatgatcctgccaagaatcctccaggttaccttgaggatagttttgtaaaatctggagtcttcaatgtatcagaacttgtaagagtatccagaacgcccataacccagggaactggagtcaacttcccaattggagaaatcccaagccaaccatactatcatgacatgaactcgggggtcaatcttcagaggtctctgtcttctccaccaagcagcaaaagacccaaaactatatccatagatgaaaatatggaaccaagtcctacaggagacttttacccctctccaagttcaccagctgctggaagtcgaacatggcacgaaagagatcaagatatgtcttctccgactactatgaagaagcctgaaaagccattgttcagctctgcatctccacaggattcttccccaagactgagcactttcccccagcaccaccatcccggaatacctggagttgcacacagtgtcatctcaactcgaactccacctccaccttcaccgttgccatttccaacacaagctatccttcctccagccccatcgagctacttttctcatccaacaatcagatatcctccccacctgaatcctcaggatactctgaagaactatgtaccttcttatgacccatccagtccacaaaccagccagtcctggtacctgggctagcttggttcctttccaagtgtcaaataggacacccatcttaccggccaatgtccaaaattacggtttgaacataattggagaacctttccttcaagcagaaacaagcaactgagggaaaaagaaacacaacaatagtttaagaaattttttttttaaataaaaaaaaaggaaaagaggaagactggacaaaacaacacaaaggcagaaaggaaagaaactgaagaaagaagataatagaccagcaattgcagcacttacaatcactaattcccttaaggttgaaactgtaatgacataaaaagggtcgatgatatttcactgatggtagatcgcagcccctgcaacgtagcctttgttacatgaagtccgctgggaaatagatgttctgtctctatgacaatatattttaactgactttctagatgccttaatatttgcatgataagctagttttattggtttagtattcttgttgtttacgcatggaatcactattcctggttatctcaccaacgaaggctaggaggcggcgtcagaggtgctgggtgacagagccatgagccagccattttataagcactctgatttctaaaagttaaaaaaaatatatgaaatctctgtagcctttagttatcagtacagatttattaaatttcggcccttaacccagccttttccagtgtgtaacccagtttgaaatcttaaaaaaagaaaaaatgaaaaaaaaaggaaaaaaagaaaaaaggaaaaaaacagtttgaacacaaaggctctatggaagaaatgcctctatgtaggtgaagtgttctctctgcatgcaacagtaaaaattaatataatattttccccacaaaagaaacacttaacagaggcaagtgcaatttataaatttatatctaaaggggaatcatgattataagtccttcagcccttggactctaaattgaggggattaaaaagaatttaaaataattttgaacgaatttattttcccctcagtttttgagggcattaaaaaggcattaaatcaagacaaatcatgtgcttgagaaaaataaaattaatgaaaacacagcacttatgttggtttagctgcagcctccttggaggtagaatttatttatttaaaattactggttgcatcaagaacccatagggtgtacaaaaggttctataaaatctgcattatagagacaaagaggcaggcaaatccatgtcacaagggtaaagcttacagtttacaaactgggaacgccagggtgtaggatataaaaacgcactcttgagaaaacaaatgtaatcagggtgctgaaaacttgcatggtgctttcagacattagccttgttcaacaaatttcttgtattgacagatccatagtgtgcatgggcagacacattttgcctctatgtctcttaaaattttaattaaaaatactctttccagtaatcctaatttgcacgaagatataatgtccacattacgtgccttgccttgaaatctaaaaaacaaaaaacaaaaaaaaaaaaacaaaaaaatacaacaaagtgacatcactacacttgttttgctgcatttattatcattttaaatctttaccatttttatgacaaaatattttgtactccagacgaagaaaaatgtgtgacatcatggattttttagacagttatacctttatctcacatttataaagcatatcatggctgtgtatagttgccgcttaaaaattgtaatcgaccagcaatattttcagtattttggtgtttttttctattaacctttcatgtttttcatcttccaattaatatttgggggggaggggtttcaaatttatacgaattatgcaataccaagttttgcctatgtaggtagtgcttttagctgtattggttattataggtaagtacacagattt

SEQ ID NO: 313157 - DNA, 2205 bp, Homo sapiens
ggttagaattcaataattgtttatatatcttactctggatttttctgcctcactttagtcttaattttcatttaaaaaatagactatagagtttagataggtgtaacatgtataatttggcacatttatctcatattagactgtaattttgaaaatagggatagcaataatttgatgcatctggaatttatatttctcatattgttgtagattttaacattgtatttttttcttttttcttccctccctgctgcctctctcctctcaacagtcctggtacctgggctagcttggttcctttccaagtgtcaaataggacacccatcttaccggccaatgtccaaaattacggtttgaacataattggagaacctttccttcaagcagaaacaagcaactgagggaaaaagaaacacaacaatagtttaagaaattttttttttaaataaaaaaaaaggaaaagaggaagactggacaaaacaacacaaaggcagaaaggaaagaaactgaagaaagaagataatagaccagcaattgcagcacttacaatcactaattcccttaaggttgaaactgtaatgacataaaaagggtcgatgatatttcactgatggtagatcgcagcccctgcaacgtagcctttgttacatgaagtccgctgggaaatagatgttctgtctctatgacaatatattttaactgactttctagatgccttaatatttgcatgataagctagttttattggtttagtattcttgttgtttacgcatggaatcactattcctggttatctcaccaacgaaggctaggaggcggcgtcagaggtgctgggtgacagagccatgagccagccattttataagcactctgatttctaaaagttaaaaaaaatatatgaaatctctgtagcctttagttatcagtacagatttattaaatttcggcccttaacccagccttttccagtgtgtaacccagtttgaaatcttaaaaaaagaaaaaatgaaaaaaaaaggaaaaaaagaaaaaaggaaaaaaacagtttgaacacaaaggctctatggaagaaatgcctctatgtaggtgaagtgttctctctgcatgcaacagtaaaaattaatataatattttccccacaaaagaaacacttaacagaggcaagtgcaatttataaatttatatctaaaggggaatcatgattataagtccttcagcccttggactctaaattgaggggattaaaaagaatttaaaataattttgaacgaatttattttcccctcagtttttgagggcattaaaaaggcattaaatcaagacaaatcatgtgcttgagaaaaataaaattaatgaaaacacagcacttatgttggtttagctgcagcctccttggaggtagaatttatttatttaaaattactggttgcatcaagaacccatagggtgtacaaaaggttctataaaatctgcattatagagacaaagaggcaggcaaatccatgtcacaagggtaaagcttacagtttacaaactgggaacgccagggtgtaggatataaaaacgcactcttgagaaaacaaatgtaatcagggtgctgaaaacttgcatggtgctttcagacattagccttgttcaacaaatttcttgtattgacagatccatagtgtgcatgggcagacacattttgcctctatgtctcttaaaattttaattaaaaatactctttccagtaatcctaatttgcacgaagatataatgtccacattacgtgccttgccttgaaatctaaaaaacaaaaaacaaaaaaaaaaaaacaaaaaaatacaacaaagtgacatcactacacttgttttgctgcatttattatcattttaaatctttaccatttttatgacaaaatattttgtactccagacgaagaaaaatgtgtgacatcatggattttttagacagttatacctttatctcacatttataaagcatatcatggctgtgtatagttgccgcttaaaaattgtaatcgaccagcaatattttcagtattttggtgtttttttctattaacctttcatgtttttcatcttccaattaatatttgggggggaggggtttcaaatttatacgaattatgcaataccaagttttgcctatgtaggtagtgcttttagctgtattggttattataggtaagtacacagattt

SEQ ID NO: 313158 - DNA, 2142 bp, Homo sapiens
tgcctcttgggaaagtaaggttaatgccatgtacagtactagtttgcatgtgttcatttaaatactaaaaactgtagtactgctcgatccatatctgactgctaggtttcaattgacagctgaggatttgtgactggaccatgaatcaaaacggcaggcatttataccccagtaccagtgaggatacattgggaattacttggcaaagtcctggtacctgggctagcttggttcctttccaagtgtcaaataggacacccatcttaccggccaatgtccaaaattacggtttgaacataattggagaacctttccttcaagcagaaacaagcaactgagggaaaaagaaacacaacaatagtttaagaaattttttttttaaataaaaaaaaaggaaaagaggaagactggacaaaacaacacaaaggcagaaaggaaagaaactgaagaaagaagataatagaccagcaattgcagcacttacaatcactaattcccttaaggttgaaactgtaatgacataaaaagggtcgatgatatttcactgatggtagatcgcagcccctgcaacgtagcctttgttacatgaagtccgctgggaaatagatgttctgtctctatgacaatatattttaactgactttctagatgccttaatatttgcatgataagctagttttattggtttagtattcttgttgtttacgcatggaatcactattcctggttatctcaccaacgaaggctaggaggcggcgtcagaggtgctgggtgacagagccatgagccagccattttataagcactctgatttctaaaagttaaaaaaaatatatgaaatctctgtagcctttagttatcagtacagatttattaaatttcggcccttaacccagccttttccagtgtgtaacccagtttgaaatcttaaaaaaagaaaaaatgaaaaaaaaaggaaaaaaagaaaaaaggaaaaaaacagtttgaacacaaaggctctatggaagaaatgcctctatgtaggtgaagtgttctctctgcatgcaacagtaaaaattaatataatattttccccacaaaagaaacacttaacagaggcaagtgcaatttataaatttatatctaaaggggaatcatgattataagtccttcagcccttggactctaaattgaggggattaaaaagaatttaaaataattttgaacgaatttattttcccctcagtttttgagggcattaaaaaggcattaaatcaagacaaatcatgtgcttgagaaaaataaaattaatgaaaacacagcacttatgttggtttagctgcagcctccttggaggtagaatttatttatttaaaattactggttgcatcaagaacccatagggtgtacaaaaggttctataaaatctgcattatagagacaaagaggcaggcaaatccatgtcacaagggtaaagcttacagtttacaaactgggaacgccagggtgtaggatataaaaacgcactcttgagaaaacaaatgtaatcagggtgctgaaaacttgcatggtgctttcagacattagccttgttcaacaaatttcttgtattgacagatccatagtgtgcatgggcagacacattttgcctctatgtctcttaaaattttaattaaaaatactctttccagtaatcctaatttgcacgaagatataatgtccacattacgtgccttgccttgaaatctaaaaaacaaaaaacaaaaaaaaaaaaacaaaaaaatacaacaaagtgacatcactacacttgttttgctgcatttattatcattttaaatctttaccatttttatgacaaaatattttgtactccagacgaagaaaaatgtgtgacatcatggattttttagacagttatacctttatctcacatttataaagcatatcatggctgtgtatagttgccgcttaaaaattgtaatcgaccagcaatattttcagtattttggtgtttttttctattaacctttcatgtttttcatcttccaattaatatttgggggggaggggtttcaaatttatacgaattatgcaataccaagttttgcctatgtaggtagtgcttttagctgtattggttattataggtaagtacacagattt

SEQ ID NO: 313159 - DNA, 1876 bp, Homo sapiens
agctcgcccagcttaatctgctcttatcacttatcgtaaaaatgtactggaggtcctattcagtgcaactgagggaaaaagaaacacaacaatagtttaagaaattttttttttaaataaaaaaaaaggaaaagaggaagactggacaaaacaacacaaaggcagaaaggaaagaaactgaagaaagaagataatagaccagcaattgcagcacttacaatcactaattcccttaaggttgaaactgtaatgacataaaaagggtcgatgatatttcactgatggtagatcgcagcccctgcaacgtagcctttgttacatgaagtccgctgggaaatagatgttctgtctctatgacaatatattttaactgactttctagatgccttaatatttgcatgataagctagttttattggtttagtattcttgttgtttacgcatggaatcactattcctggttatctcaccaacgaaggctaggaggcggcgtcagaggtgctgggtgacagagccatgagccagccattttataagcactctgatttctaaaagttaaaaaaaatatatgaaatctctgtagcctttagttatcagtacagatttattaaatttcggcccttaacccagccttttccagtgtgtaacccagtttgaaatcttaaaaaaagaaaaaatgaaaaaaaaaggaaaaaaagaaaaaaggaaaaaaacagtttgaacacaaaggctctatggaagaaatgcctctatgtaggtgaagtgttctctctgcatgcaacagtaaaaattaatataatattttccccacaaaagaaacacttaacagaggcaagtgcaatttataaatttatatctaaaggggaatcatgattataagtccttcagcccttggactctaaattgaggggattaaaaagaatttaaaataattttgaacgaatttattttcccctcagtttttgagggcattaaaaaggcattaaatcaagacaaatcatgtgcttgagaaaaataaaattaatgaaaacacagcacttatgttggtttagctgcagcctccttggaggtagaatttatttatttaaaattactggttgcatcaagaacccatagggtgtacaaaaggttctataaaatctgcattatagagacaaagaggcaggcaaatccatgtcacaagggtaaagcttacagtttacaaactgggaacgccagggtgtaggatataaaaacgcactcttgagaaaacaaatgtaatcagggtgctgaaaacttgcatggtgctttcagacattagccttgttcaacaaatttcttgtattgacagatccatagtgtgcatgggcagacacattttgcctctatgtctcttaaaattttaattaaaaatactctttccagtaatcctaatttgcacgaagatataatgtccacattacgtgccttgccttgaaatctaaaaaacaaaaaacaaaaaaaaaaaaacaaaaaaatacaacaaagtgacatcactacacttgttttgctgcatttattatcattttaaatctttaccatttttatgacaaaatattttgtactccagacgaagaaaaatgtgtgacatcatggattttttagacagttatacctttatctcacatttataaagcatatcatggctgtgtatagttgccgcttaaaaattgtaatcgaccagcaatattttcagtattttggtgtttttttctattaacctttcatgtttttcatcttccaattaatatttgggggggaggggtttcaaatttatacgaattatgcaataccaagttttgcctatgtaggtagtgcttttagctgtattggttattataggtaagtacacagattt

SEQ ID NO: 313160 - DNA, 1821 bp, Homo sapiens
tgtcggctcttcctatcattgtgattgcagaattcaccaagcgtttgatgaagggtttgatgagtcatcaaaccctaagaggaagactggacaaaacaacacaaaggcagaaaggaaagaaactgaagaaagaagataatagaccagcaattgcagcacttacaatcactaattcccttaaggttgaaactgtaatgacataaaaagggtcgatgatatttcactgatggtagatcgcagcccctgcaacgtagcctttgttacatgaagtccgctgggaaatagatgttctgtctctatgacaatatattttaactgactttctagatgccttaatatttgcatgataagctagttttattggtttagtattcttgttgtttacgcatggaatcactattcctggttatctcaccaacgaaggctaggaggcggcgtcagaggtgctgggtgacagagccatgagccagccattttataagcactctgatttctaaaagttaaaaaaaatatatgaaatctctgtagcctttagttatcagtacagatttattaaatttcggcccttaacccagccttttccagtgtgtaacccagtttgaaatcttaaaaaaagaaaaaatgaaaaaaaaaggaaaaaaagaaaaaaggaaaaaaacagtttgaacacaaaggctctatggaagaaatgcctctatgtaggtgaagtgttctctctgcatgcaacagtaaaaattaatataatattttccccacaaaagaaacacttaacagaggcaagtgcaatttataaatttatatctaaaggggaatcatgattataagtccttcagcccttggactctaaattgaggggattaaaaagaatttaaaataattttgaacgaatttattttcccctcagtttttgagggcattaaaaaggcattaaatcaagacaaatcatgtgcttgagaaaaataaaattaatgaaaacacagcacttatgttggtttagctgcagcctccttggaggtagaatttatttatttaaaattactggttgcatcaagaacccatagggtgtacaaaaggttctataaaatctgcattatagagacaaagaggcaggcaaatccatgtcacaagggtaaagcttacagtttacaaactgggaacgccagggtgtaggatataaaaacgcactcttgagaaaacaaatgtaatcagggtgctgaaaacttgcatggtgctttcagacattagccttgttcaacaaatttcttgtattgacagatccatagtgtgcatgggcagacacattttgcctctatgtctcttaaaattttaattaaaaatactctttccagtaatcctaatttgcacgaagatataatgtccacattacgtgccttgccttgaaatctaaaaaacaaaaaacaaaaaaaaaaaaacaaaaaaatacaacaaagtgacatcactacacttgttttgctgcatttattatcattttaaatctttaccatttttatgacaaaatattttgtactccagacgaagaaaaatgtgtgacatcatggattttttagacagttatacctttatctcacatttataaagcatatcatggctgtgtatagttgccgcttaaaaattgtaatcgaccagcaatattttcagtattttggtgtttttttctattaacctttcatgtttttcatcttccaattaatatttgggggggaggggtttcaaatttatacgaattatgcaataccaagttttgcctatgtaggtagtgcttttagctgtattggttattataggtaagtacacagattt

SEQ ID NO: 313161 - DNA, 2275 bp, Homo sapiens
tcccgcgcccccctccccgccttttttgaaaaagcattttaccaccaaccaccaccccaatccaacccacaccgaaccttcgcgcaccccctacaccccaacaacaacaacaactgcaaaatagaaaacaaatccccaaacccaggcgaaaagcagccaacaccggcggcggcggcggcctcggcaagcacggccagcgcgctcggactgcaagagggttaaaagtgtagattggatttcacccctggaactctagcacgccgagtgaacttgaatctttggctatttaaggaggactgggtttgttgtgaagttgcggtgatccagcgcagagccccgtcctgattgatcgcatcgcggggctcagatgactgtaaaatgaatagatgaaattcttgcttctcgaagattttcttgggcatctcccggaaagtgcgttttaaggcgaagtcatgatgtattctcccatctgtctcactcaggatgaatttcacccattcatcgaggcacttcttccacatgtccgtgcaattgcctatacttggttcaacctgcaggctcgaaaacgcaagtactttaaaaagcatgagaagcgaatgtcaaaggatgaagaaagagcagtcaaagatgagcttctcagtgaaaagcctgaaatcaaacagaagtgggcatccaggctccttgccaaactgcgcaaagatattcgccaggagtatcgagaggactttgtgctcaccgtgactggcaagaagcacccgtgctgtgtcttatccaatcccgaccagaagggtaagattaggagaatcgactgcctgcgacaggcagacaaagtctggcgtctggatctagtcatggtgatcctgttcaaaggcatccccttggaaagtaccgatggagagcggctcatgaaatccccacattgcacaaacccagcactttgtgtccagccacatcatatcacagtatcagttaaggagcttgatttgtttttggcatactacgtgcaggagcaagattctggacaatcaggaagtccaagccacaatgatcctgccaagaatcctccaggttaccttgaggatagttttgtaaaatctggagtcttcaatgtatcagaacttgtaagagtatccagaacgcccataacccagggaactggagtcaacttcccaattggagaaatcccaagccaaccatactatcatgacatgaactcgggggtcaatcttcagaggtctctgtcttctccaccaagcagcaaaagacccaaaactatatccatagatgaaaatatggaaccaagtcctacaggagacttttacccctctccaagttcaccagctgctggaagtcgaacatggcacgaaagagatcaagatatgtcttctccgactactatgaagaagcctgaaaagccattgttcagctctgcatctccacaggattcttccccaagactgagcactttcccccagcaccaccatcccggaatacctggagttgcacacagtgtcatctcaactcgaactccacctccaccttcaccgttgccatttccaacacaagctatccttcctccagccccatcgagctacttttctcatccaacaatcagatatcctccccacctgaatcctcaggatactctgaagaactatgtaccttcttatgacccatccagtccacaaaccagccagtcctggtacctgggctagcttggttcctttccaagtgtcaaataggacacccatcttaccggccaatgtccaaaattacggtttgaacataattggagaacctttccttcaagcagaaacaagcaactgagggaaaaagaaacacaacaatagtttaagaaattttttttttaaataaaaaaaaaggaaaagaggaagactggacaaaacaacacaaaggcagaaaggaaagaaactgaagaaagaagataatagaccagcagcaaaagacccaaaactatatccatagatgaaaatatggaaccaagtcctacaggagacttttacccctctccaagttcaccagctgctggaagtcgaacatggcacgaaagagatcaagatatgtcttctccgactactatgaagaagcctgaaaagccattgttcagctctgcatctccacaggattcttccccaagactgagcactttcccccagcaccaccatcccggaatacctggagttgcacacagtgtcatctcaactcaaactccacctccaccttcaccgttgccatttccaaccaagcaacccct

SEQ ID NO: 313162 - DNA, 1655 bp, Homo sapiens
tcccgcgcccccctccccgccttttttgaaaaagcattttaccaccaaccaccaccccaatccaacccacaccgaaccttcgcgcaccccctacaccccaacaacaacaacaactgcaaaatagaaaacaaatccccaaacccaggcgaaaagcagccaacaccggcggcggcggcggcctcggcaagcacggccagcgcgctcggactgcaagagggttaaaagtgtagattggatttcacccctggaactctagcacgccgagtgaacttgaatctttggctatttaaggaggactgggtttgttgtgaagttgcggtgatccagcgcagagccccgtcctgattgatcgcatcgcggggctcagatgactgtaaaatgaatagatgaaattcttgcttctcgaagattttcttgggcatctcccggaaagtgcgttttaaggcgaagtcatgatgtattctcccatctgtctcactcaggatgaatttcacccattcatcgaggcacttcttccacatgtccgtgcaattgcctatacttggttcaacctgcaggctcgaaaacgcaagtactttaaaaagcatgagaagcgaatgtcaaaggatgaagaaagagcagtcaaagatgagcttctcagtgaaaagcctgaaatcaaacagaagtgggcatccaggctccttgccaaactgcgcaaagatattcgccaggagtatcgagaggactttgtgctcaccgtgactggcaagaagcacccgtgctgtgtcttatccaatcccgaccagaagggtaagattaggagaatcgactgcctgcgacaggcagacaaagtctggcgtctggatctagtcatggtgatcctgttcaaaggcatccccttggaaagtaccgatggagagcggctcatgaaatccccacattgcacaaacccagcactttgtgtccagccacatcatatcacagtatcagttaaggagcttgatttgtttttggcatactacgtgcaggagcaagattctggacaatcaggaagtccaagccacaatgatcctgccaagaatcctccaggttaccttgaggatagttttgtaaaatctggagtcttcaatgtatcagaacttgtaagagtatccagaacgcccataacccagggaactggagtcaacttcccaattggagaaatcccaagccaaccatactatcatgacatgaactcgggggtcaatcttcagaggtctctgtcttctccaccaagcagcaaaagacccaaaactatatccatagatgaaaatatggaaccaagtcctacaggagacttttacccctctccaagttcaccagctgctggaagtcgaacatggcacgaaagagatcaagatatgtcttctccgactactatgaagaagcctgaaaagccattgttcagctctgcatctccacaggattcttccccaagactgagcactttcccccagcaccaccatcccggaatacctggagttgcacacagtgtcatctcaactcgaactccacctccaccttcaccgttgccatttccaacacaagctatccttcctccagcccctggcaaccattcatcacttctccatttctaaaattgtcatttaaaaatgttatataaggagtttccatct

SEQ ID NO: 313163 - DNA, 1273 bp, Homo sapiens
  misc_feature (1056)..(1056): n is a, c, g, or t
  misc_feature (1125)..(1125): n is a, c, g, or t
tcccgcgcccccctccccgccttttttgaaaaagcattttaccaccaaccaccaccccaatccaacccacaccgaaccttcgcgcaccccctacaccccaacaacaacaacaactgcaaaatagaaaacaaatccccaaacccaggcgaaaagcagccaacaccggcggcggcggcggcctcggcaagcacggccagcgcgctcggactgcaagagggttaaaagtgtagattggatttcacccctggaactctagcacgccgagtgaacttgaatctttggctatttaaggaggactgggtttgttgtgaagttgcggtgatccagcgcagagccccgtcctgattgatcgcatcgcggggctcagatgactgtaaaatgaatagatgaaattcttgcttctcgaagattttcttgggcatctcccggaaagtgcgttttaaggcgaagtcatgatgtattctcccatctgtctcactcaggatgaatttcacccattcatcgaggcacttcttccacatgtccgtgcaattgcctatacttggttcaacctgcaggctcgaaaacgcaagtactttaaaaagcatgagaagcgaatgtcaaaggatgaagaaagagcagtcaaagatgagcttctcagtgaaaagcctgaaatcaaacagaagtgggcatccaggctccttgccaaactgcgcaaagatattcgccaggagtatcgagaggactttgtgctcaccgtgactggcaagaagcacccgtgctgtgtcttatccaatcccgaccagaagggtaagattaggagaatcgactgcctgcgacaggcagacaaagtctggcgtctggatctagtcatggtgatcctgttcaaaggcatccccttggaaagtaccgatggagagcggctcatgaaatccccacattgcacaaacccagcactttgtgtccagccacatcatatcacagtatcagttaaggagcttgatttgtttttggcatactacgtgcaggagcaaggtaagaatttcttttcttcaaataaatgcatcaagatatagntgtccttgcattaccaacaatccatagtaaaacaatcattttacaaagccgcataccaaaagtagactnaagtttgagctgtcacagatggtaggtcatttccaaacttggcctggtgggaggaaaaatggcctgcagatagccaggtgacagactgttacctgaggtttgttatataaatgtgggacttaataaactgctatgagctttattattc

SEQ ID NO: 313164 - DNA, 3631 bp, Homo sapiens
tcccgcgcccccctccccgccttttttgaaaaagcattttaccaccaaccaccaccccaatccaacccacaccgaaccttcgcgcaccccctacaccccaacaacaacaacaactgcaaaatagaaaacaaatccccaaacccaggcgaaaagcagccaacaccggcggcggcggcggcctcggcaagcacggccagcgcgctcggactgcaagagggttaaaagtgtagattggatttcacccctggaactctagcacgccgagtgaacttgaatctttggctatttaaggaggactgggtttgttgtgaagttgcggtgatccagcgcagagccccgtcctgattgatcgcatcgcggggctcagatgactgtaaaatgaatagatgaaattcttgcttctcgaagattttcttgggcatctcccggaaagtgcgttttaaggcgaagtcatgatgtattctcccatctgtctcactcaggatgaatttcacccattcatcgaggcacttcttccacatgtccgtgcaattgcctatacttggttcaacctgcaggctcgaaaacgcaagtactttaaaaagcatgagaagcgaatgtcaaaggatgaagaaagagcagtcaaagatgagcttctcagtgaaaagcctgaaatcaaacagaagtgggcatccaggctccttgccaaactgcgcaaagatattcgccaggagtatcgagaggactttgtgctcaccgtgactggcaagaagcacccgtgctgtgtcttatccaatcccgaccagaagggtaagattaggagaatcgactgcctgcgacaggcagacaaagtctggcgtctggatctagtcatggtgatcctgttcaaaggcatccccttggaaagtaccgatggagagcggctcatgaaatccccacattgcacaaacccagcactttgtgtccagccacatcatatcacagtatcagttaaggagcttgatttgtttttggcatactacgtgcaggagcaagattctggacaatcaggaagtccaagccacaatgatcctgccaagaatcctccaggttaccttgaggatagttttgtaaaatctggagtcttcaatgtatcagaacttgtaagagtatccagaacgcccataacccagggaactggagtcaacttcccaattggagaaatcccaagccaaccatactatcatgacatgaactcgggggtcaatcttcagaggtctctgtcttctccaccaagcagcaaaagacccaaaactatatccatagatgaaaatatggaaccaagtcctacaggagacttttacccctctccaagttcaccagctgctggaagtcgaacatggcacgaaagagatcaagatatgtcttctccgactactatgaagaagcctgaaaagccattgttcagctctgcatctccacaggattcttccccaagactgagcactttcccccagcaccaccatcccggaatacctggagttgcacacagtgtcatctcaactcgaactccacctccaccttcaccgttgccatttccaacacaagctatccttcctccagccccatcgagctacttttctcatccaacaatcagatatcctccccacctgaatcctcaggatactctgaagaactatgtaccttcttatgacccatccagtccacaaaccagccagtcctggtacctgggctagcttggttcctttccaagtgtcaaataggacacccatcttaccggccaatgtccaaaattacggtttgaacataattggagaacctttccttcaagcagaaacaagcaactgagggaaaaagaaacacaacaatagtttaagaaattttttttttaaataaaaaaaaaggaaaagaggaagactggacaaaacaacacaaaggcagaaaggaaagaaactgaagaaagaagataatagaccagcaattgcagcacttacaatcactaattcccttaaggttgaaactgtaatgacataaaaagggtcgatgatatttcactgatggtagatcgcagcccctgcaacgtagcctttgttacatgaagtccgctgggaaatagatgttctgtctctatgacaatatattttaactgactttctagatgccttaatatttgcatgataagctagttttattggtttagtattcttgttgtttacgcatggaatcactattcctggttatctcaccaacgaaggctaggaggcggcgtcagaggtgctgggtgacagagccatgagccagccattttataagcactctgatttctaaaagttaaaaaaaatatatgaaatctctgtagcctttagttatcagtacagatttattaaatttcggcccttaacccagccttttccagtgtgtaacccagtttgaaatcttaaaaaaagaaaaaatgaaaaaaaaaggaaaaaaagaaaaaaggaaaaaaacagtttgaacacaaaggctctatggaagaaatgcctctatgtaggtgaagtgttctctctgcatgcaacagtaaaaattaatataatattttccccacaaaagaaacacttaacagaggcaagtgcaatttataaatttatatctaaaggggaatcatgattataagtccttcagcccttggactctaaattgaggggattaaaaagaatttaaaataattttgaacgaatttattttcccctcagtttttgagggcattaaaaaggcattaaatcaagacaaatcatgtgcttgagaaaaataaaattaatgaaaacacagcacttatgttggtttagctgcagcctccttggaggtagaatttatttatttaaaattactggttgcatcaagaacccatagggtgtacaaaaggttctataaaatctgcattatagagacaaagaggcaggcaaatccatgtcacaagggtaaagcttacagtttacaaactgggaacgccagggtgtaggatataaaaacgcactcttgagaaaacaaatgtaatcagggtgctgaaaacttgcatggtgctttcagacattagccttgttcaacaaatttcttgtattgacagatccatagtgtgcatgggcagacacattttgcctctatgtctcttaaaattttaattaaaaatactctttccagtaatcctaatttgcacgaagatataatgtccacattacgtgccttgccttgaaatctaaaaaacaaaaaacaaaaaaaaaaaaacaaaaaaatacaacaaagtgacatcactacacttgttttgctgcatttattatcattttaaatctttaccatttttatgacaaaatattttgtactccagacgaagaaaaatgtgtgacatcatggattttttagacagttatacctttatctcacatttataaagcatatcatggctgtgtatagttgccgcttaaaaattgtaatcgaccagcaatattttcagtattttggtgtttttttctattaacctttcatgtttttcatcttccaattaatatttgggggggaggggtttcaaatttatacgaattatgcaataccaagttttgcctatgtaggtagtgcttttagctgtattggttattataggtaagtacacagattt

SEQ ID NO: 313165 - DNA, 3400 bp, Homo sapiens
cttgtctttctatctgtgaggttgcagttcctcctgctaataaaggagctttctcccatgatgcagtgtgataaggattggcctacatgtagtccagcaagccaccgctgatgttttcttgattaggtgtcttatcttccattgagctgcatctgatgaaggttgctgacagcataatggctgggaaaacgtcggacagctccataaaatggcagctatgttatgacatgtcagccaggacctggtggatggatgaatttcacccattcatcgaggcacttcttccacatgtccgtgcaattgcctatacttggttcaacctgcaggctcgaaaacgcaagtactttaaaaagcatgagaagcgaatgtcaaaggatgaagaaagagcagtcaaagatgagcttctcagtgaaaagcctgaaatcaaacagaagtgggcatccaggctccttgccaaactgcgcaaagatattcgccaggagtatcgagaggactttgtgctcaccgtgactggcaagaagcacccgtgctgtgtcttatccaatcccgaccagaagggtaagattaggagaatcgactgcctgcgacaggcagacaaagtctggcgtctggatctagtcatggtgatcctgttcaaaggcatccccttggaaagtaccgatggagagcggctcatgaaatccccacattgcacaaacccagcactttgtgtccagccacatcatatcacagtatcagttaaggagcttgatttgtttttggcatactacgtgcaggagcaagattctggacaatcaggaagtccaagccacaatgatcctgccaagaatcctccaggttaccttgaggatagttttgtaaaatctggagtcttcaatgtatcagaacttgtaagagtatccagaacgcccataacccagggaactggagtcaacttcccaattggagaaatcccaagccaaccatactatcatgacatgaactcgggggtcaatcttcagaggtctctgtcttctccaccaagcagcaaaagacccaaaactatatccatagatgaaaatatggaaccaagtcctacaggagacttttacccctctccaagttcaccagctgctggaagtcgaacatggcacgaaagagatcaagatatgtcttctccgactactatgaagaagcctgaaaagccattgttcagctctgcatctccacaggattcttccccaagactgagcactttcccccagcaccaccatcccggaatacctggagttgcacacagtgtcatctcaactcgaactccacctccaccttcaccgttgccatttccaacacaagctatccttcctccagccccatcgagctacttttctcatccaacaatcagatatcctccccacctgaatcctcaggatactctgaagaactatgtaccttcttatgacccatccagtccacaaaccagccagtcctggtacctgggctagcttggttcctttccaagtgtcaaataggacacccatcttaccggccaatgtccaaaattacggtttgaacataattggagaacctttccttcaagcagaaacaagcaactgagggaaaaagaaacacaacaatagtttaagaaattttttttttaaataaaaaaaaaggaaaagaggaagactggacaaaacaacacaaaggcagaaaggaaagaaactgaagaaagaagataatagaccagcaattgcagcacttacaatcactaattcccttaaggttgaaactgtaatgacataaaaagggtcgatgatatttcactgatggtagatcgcagcccctgcaacgtagcctttgttacatgaagtccgctgggaaatagatgttctgtctctatgacaatatattttaactgactttctagatgccttaatatttgcatgataagctagttttattggtttagtattcttgttgtttacgcatggaatcactattcctggttatctcaccaacgaaggctaggaggcggcgtcagaggtgctgggtgacagagccatgagccagccattttataagcactctgatttctaaaagttaaaaaaaatatatgaaatctctgtagcctttagttatcagtacagatttattaaatttcggcccttaacccagccttttccagtgtgtaacccagtttgaaatcttaaaaaaagaaaaaatgaaaaaaaaaggaaaaaaagaaaaaaggaaaaaaacagtttgaacacaaaggctctatggaagaaatgcctctatgtaggtgaagtgttctctctgcatgcaacagtaaaaattaatataatattttccccacaaaagaaacacttaacagaggcaagtgcaatttataaatttatatctaaaggggaatcatgattataagtccttcagcccttggactctaaattgaggggattaaaaagaatttaaaataattttgaacgaatttattttcccctcagtttttgagggcattaaaaaggcattaaatcaagacaaatcatgtgcttgagaaaaataaaattaatgaaaacacagcacttatgttggtttagctgcagcctccttggaggtagaatttatttatttaaaattactggttgcatcaagaacccatagggtgtacaaaaggttctataaaatctgcattatagagacaaagaggcaggcaaatccatgtcacaagggtaaagcttacagtttacaaactgggaacgccagggtgtaggatataaaaacgcactcttgagaaaacaaatgtaatcagggtgctgaaaacttgcatggtgctttcagacattagccttgttcaacaaatttcttgtattgacagatccatagtgtgcatgggcagacacattttgcctctatgtctcttaaaattttaattaaaaatactctttccagtaatcctaatttgcacgaagatataatgtccacattacgtgccttgccttgaaatctaaaaaacaaaaaacaaaaaaaaaaaaacaaaaaaatacaacaaagtgacatcactacacttgttttgctgcatttattatcattttaaatctttaccatttttatgacaaaatattttgtactccagacgaagaaaaatgtgtgacatcatggattttttagacagttatacctttatctcacatttataaagcatatcatggctgtgtatagttgccgcttaaaaattgtaatcgaccagcaatattttcagtattttggtgtttttttctattaacctttcatgtttttcatcttccaattaatatttgggggggaggggtttcaaatttatacgaattatgcaataccaagttttgcctatgtaggtagtgcttttagctgtattggttattataggtaagtacacagattt

SEQ ID NO: 313166 - DNA, 3257 bp, Homo sapiens
acagagaagagaaatgaactgtggcatcgctcctgccttctgaacagctctactccgattaaaaaaaaaaaatctcactgtgttctttgtaaaatggtactgcatagtgatgaatttcacccattcatcgaggcacttcttccacatgtccgtgcaattgcctatacttggttcaacctgcaggctcgaaaacgcaagtactttaaaaagcatgagaagcgaatgtcaaaggatgaagaaagagcagtcaaagatgagcttctcagtgaaaagcctgaaatcaaacagaagtgggcatccaggctccttgccaaactgcgcaaagatattcgccaggagtatcgagaggactttgtgctcaccgtgactggcaagaagcacccgtgctgtgtcttatccaatcccgaccagaagggtaagattaggagaatcgactgcctgcgacaggcagacaaagtctggcgtctggatctagtcatggtgatcctgttcaaaggcatccccttggaaagtaccgatggagagcggctcatgaaatccccacattgcacaaacccagcactttgtgtccagccacatcatatcacagtatcagttaaggagcttgatttgtttttggcatactacgtgcaggagcaagattctggacaatcaggaagtccaagccacaatgatcctgccaagaatcctccaggttaccttgaggatagttttgtaaaatctggagtcttcaatgtatcagaacttgtaagagtatccagaacgcccataacccagggaactggagtcaacttcccaattggagaaatcccaagccaaccatactatcatgacatgaactcgggggtcaatcttcagaggtctctgtcttctccaccaagcagcaaaagacccaaaactatatccatagatgaaaatatggaaccaagtcctacaggagacttttacccctctccaagttcaccagctgctggaagtcgaacatggcacgaaagagatcaagatatgtcttctccgactactatgaagaagcctgaaaagccattgttcagctctgcatctccacaggattcttccccaagactgagcactttcccccagcaccaccatcccggaatacctggagttgcacacagtgtcatctcaactcgaactccacctccaccttcaccgttgccatttccaacacaagctatccttcctccagccccatcgagctacttttctcatccaacaatcagatatcctccccacctgaatcctcaggatactctgaagaactatgtaccttcttatgacccatccagtccacaaaccagccagtcctggtacctgggctagcttggttcctttccaagtgtcaaataggacacccatcttaccggccaatgtccaaaattacggtttgaacataattggagaacctttccttcaagcagaaacaagcaactgagggaaaaagaaacacaacaatagtttaagaaattttttttttaaataaaaaaaaaggaaaagaggaagactggacaaaacaacacaaaggcagaaaggaaagaaactgaagaaagaagataatagaccagcaattgcagcacttacaatcactaattcccttaaggttgaaactgtaatgacataaaaagggtcgatgatatttcactgatggtagatcgcagcccctgcaacgtagcctttgttacatgaagtccgctgggaaatagatgttctgtctctatgacaatatattttaactgactttctagatgccttaatatttgcatgataagctagttttattggtttagtattcttgttgtttacgcatggaatcactattcctggttatctcaccaacgaaggctaggaggcggcgtcagaggtgctgggtgacagagccatgagccagccattttataagcactctgatttctaaaagttaaaaaaaatatatgaaatctctgtagcctttagttatcagtacagatttattaaatttcggcccttaacccagccttttccagtgtgtaacccagtttgaaatcttaaaaaaagaaaaaatgaaaaaaaaaggaaaaaaagaaaaaaggaaaaaaacagtttgaacacaaaggctctatggaagaaatgcctctatgtaggtgaagtgttctctctgcatgcaacagtaaaaattaatataatattttccccacaaaagaaacacttaacagaggcaagtgcaatttataaatttatatctaaaggggaatcatgattataagtccttcagcccttggactctaaattgaggggattaaaaagaatttaaaataattttgaacgaatttattttcccctcagtttttgagggcattaaaaaggcattaaatcaagacaaatcatgtgcttgagaaaaataaaattaatgaaaacacagcacttatgttggtttagctgcagcctccttggaggtagaatttatttatttaaaattactggttgcatcaagaacccatagggtgtacaaaaggttctataaaatctgcattatagagacaaagaggcaggcaaatccatgtcacaagggtaaagcttacagtttacaaactgggaacgccagggtgtaggatataaaaacgcactcttgagaaaacaaatgtaatcagggtgctgaaaacttgcatggtgctttcagacattagccttgttcaacaaatttcttgtattgacagatccatagtgtgcatgggcagacacattttgcctctatgtctcttaaaattttaattaaaaatactctttccagtaatcctaatttgcacgaagatataatgtccacattacgtgccttgccttgaaatctaaaaaacaaaaaacaaaaaaaaaaaaacaaaaaaatacaacaaagtgacatcactacacttgttttgctgcatttattatcattttaaatctttaccatttttatgacaaaatattttgtactccagacgaagaaaaatgtgtgacatcatggattttttagacagttatacctttatctcacatttataaagcatatcatggctgtgtatagttgccgcttaaaaattgtaatcgaccagcaatattttcagtattttggtgtttttttctattaacctttcatgtttttcatcttccaattaatatttgggggggaggggtttcaaatttatacgaattatgcaataccaagttttgcctatgtaggtagtgcttttagctgtattggttattataggtaagtacacagattt

SEQ ID NO: 313167 - DNA, 2647 bp, Homo sapiens
gtcagacggtttcggtgcttctcccactcggatgttcccgcggcttaaaagagtccgcagcgagcaccgaaatacctcttccaggttaccttgaggatagttttgtaaaatctggagtcttcaatgtatcagaacttgtaagagtatccagaacgcccataacccagggaactggagtcaacttcccaattggagaaatcccaagccaaccatactatcatgacatgaactcgggggtcaatcttcagaggtctctgtcttctccaccaagcagcaaaagacccaaaactatatccatagatgaaaatatggaaccaagtcctacaggagacttttacccctctccaagttcaccagctgctggaagtcgaacatggcacgaaagagatcaagatatgtcttctccgactactatgaagaagcctgaaaagccattgttcagctctgcatctccacaggattcttccccaagactgagcactttcccccagcaccaccatcccggaatacctggagttgcacacagtgtcatctcaactcgaactccacctccaccttcaccgttgccatttccaacacaagctatccttcctccagccccatcgagctacttttctcatccaacaatcagatatcctccccacctgaatcctcaggatactctgaagaactatgtaccttcttatgacccatccagtccacaaaccagccagtcctggtacctgggctagcttggttcctttccaagtgtcaaataggacacccatcttaccggccaatgtccaaaattacggtttgaacataattggagaacctttccttcaagcagaaacaagcaactgagggaaaaagaaacacaacaatagtttaagaaattttttttttaaataaaaaaaaaggaaaagaggaagactggacaaaacaacacaaaggcagaaaggaaagaaactgaagaaagaagataatagaccagcaattgcagcacttacaatcactaattcccttaaggttgaaactgtaatgacataaaaagggtcgatgatatttcactgatggtagatcgcagcccctgcaacgtagcctttgttacatgaagtccgctgggaaatagatgttctgtctctatgacaatatattttaactgactttctagatgccttaatatttgcatgataagctagttttattggtttagtattcttgttgtttacgcatggaatcactattcctggttatctcaccaacgaaggctaggaggcggcgtcagaggtgctgggtgacagagccatgagccagccattttataagcactctgatttctaaaagttaaaaaaaatatatgaaatctctgtagcctttagttatcagtacagatttattaaatttcggcccttaacccagccttttccagtgtgtaacccagtttgaaatcttaaaaaaagaaaaaatgaaaaaaaaaggaaaaaaagaaaaaaggaaaaaaacagtttgaacacaaaggctctatggaagaaatgcctctatgtaggtgaagtgttctctctgcatgcaacagtaaaaattaatataatattttccccacaaaagaaacacttaacagaggcaagtgcaatttataaatttatatctaaaggggaatcatgattataagtccttcagcccttggactctaaattgaggggattaaaaagaatttaaaataattttgaacgaatttattttcccctcagtttttgagggcattaaaaaggcattaaatcaagacaaatcatgtgcttgagaaaaataaaattaatgaaaacacagcacttatgttggtttagctgcagcctccttggaggtagaatttatttatttaaaattactggttgcatcaagaacccatagggtgtacaaaaggttctataaaatctgcattatagagacaaagaggcaggcaaatccatgtcacaagggtaaagcttacagtttacaaactgggaacgccagggtgtaggatataaaaacgcactcttgagaaaacaaatgtaatcagggtgctgaaaacttgcatggtgctttcagacattagccttgttcaacaaatttcttgtattgacagatccatagtgtgcatgggcagacacattttgcctctatgtctcttaaaattttaattaaaaatactctttccagtaatcctaatttgcacgaagatataatgtccacattacgtgccttgccttgaaatctaaaaaacaaaaaacaaaaaaaaaaaaacaaaaaaatacaacaaagtgacatcactacacttgttttgctgcatttattatcattttaaatctttaccatttttatgacaaaatattttgtactccagacgaagaaaaatgtgtgacatcatggattttttagacagttatacctttatctcacatttataaagcatatcatggctgtgtatagttgccgcttaaaaattgtaatcgaccagcaatattttcagtattttggtgtttttttctattaacctttcatgtttttcatcttccaattaatatttgggggggaggggtttcaaatttatacgaattatgcaataccaagttttgcctatgtaggtagtgcttttagctgtattggttattataggtaagtacacagattt

SEQ ID NO: 313168 - DNA, 2985 bp, Homo sapiens
gtcagacggtttcggtgcttctcccactcggatgttcccgcggcttaaaagagtccgcagcgagcaccgaaatacctcttccaggttaccttgaggatagttttgtaaaatctggagtcttcaatgtatcagaacttgtaagagtatccagaacgcccataacccagggaactggagtcaacttcccaattggagaaatcccaagccaaccatactatcatgacatgaactcgggggtcaatcttcagaggtctctgtcttctccaccaagcagcaaaagacccaaaactatatccatagatgaaaatatggaaccaagtcctacaggagacttttacccctctccaagttcaccagctgctggaagtcgaacatggcacgaaagagatcaagatatgtcttctccgactactatgaagaagcctgaaaagccattgttcagctctgcatctccacaggattcttccccaagactgagcactttcccccagcaccaccatcccggaatacctggagttgcacacagtgtcatctcaactcgaactccacctccaccttcaccgttgccatttccaacacaagctatccttcctccagccccatcgagctacttttctcatccaacaatcagatatcctccccacctgaatcctcaggatactctgaagaactatgtaccttcttatgacccatccagtccacaaaccagccagcctaacggcagtggtcaagtagtagggaaagtgcctggccatttcactcctgtcttggcaccctctccccatcccagtgcagtgcgacctgtgaccctgagcatgacagatactaaacccatcactacatccactgaaggtgaggcagcttcacctacagcaaccacctacacagcctcaggcacatctcaagccaatcgatatgtgggactaagcccaagagacccatccttcctacatcagcaacagctgaggatttgtgactggaccatgaatcaaaacggcaggcatttataccccagtaccagtgaggatacattgggaattacttggcaaagtcctggtacctgggctagcttggttcctttccaagtgtcaaataggacacccatcttaccggccaatgtccaaaattacggtttgaacataattggagaacctttccttcaagcagaaacaagcaactgagggaaaaagaaacacaacaatagtttaagaaattttttttttaaataaaaaaaaaggaaaagaggaagactggacaaaacaacacaaaggcagaaaggaaagaaactgaagaaagaagataatagaccagcaattgcagcacttacaatcactaattcccttaaggttgaaactgtaatgacataaaaagggtcgatgatatttcactgatggtagatcgcagcccctgcaacgtagcctttgttacatgaagtccgctgggaaatagatgttctgtctctatgacaatatattttaactgactttctagatgccttaatatttgcatgataagctagttttattggtttagtattcttgttgtttacgcatggaatcactattcctggttatctcaccaacgaaggctaggaggcggcgtcagaggtgctgggtgacagagccatgagccagccattttataagcactctgatttctaaaagttaaaaaaaatatatgaaatctctgtagcctttagttatcagtacagatttattaaatttcggcccttaacccagccttttccagtgtgtaacccagtttgaaatcttaaaaaaagaaaaaatgaaaaaaaaaggaaaaaaagaaaaaaggaaaaaaacagtttgaacacaaaggctctatggaagaaatgcctctatgtaggtgaagtgttctctctgcatgcaacagtaaaaattaatataatattttccccacaaaagaaacacttaacagaggcaagtgcaatttataaatttatatctaaaggggaatcatgattataagtccttcagcccttggactctaaattgaggggattaaaaagaatttaaaataattttgaacgaatttattttcccctcagtttttgagggcattaaaaaggcattaaatcaagacaaatcatgtgcttgagaaaaataaaattaatgaaaacacagcacttatgttggtttagctgcagcctccttggaggtagaatttatttatttaaaattactggttgcatcaagaacccatagggtgtacaaaaggttctataaaatctgcattatagagacaaagaggcaggcaaatccatgtcacaagggtaaagcttacagtttacaaactgggaacgccagggtgtaggatataaaaacgcactcttgagaaaacaaatgtaatcagggtgctgaaaacttgcatggtgctttcagacattagccttgttcaacaaatttcttgtattgacagatccatagtgtgcatgggcagacacattttgcctctatgtctcttaaaattttaattaaaaatactctttccagtaatcctaatttgcacgaagatataatgtccacattacgtgccttgccttgaaatctaaaaaacaaaaaacaaaaaaaaaaaaacaaaaaaatacaacaaagtgacatcactacacttgttttgctgcatttattatcattttaaatctttaccatttttatgacaaaatattttgtactccagacgaagaaaaatgtgtgacatcatggattttttagacagttatacctttatctcacatttataaagcatatcatggctgtgtatagttgccgcttaaaaattgtaatcgaccagcaatattttcagtattttggtgtttttttctattaacctttcatgtttttcatcttccaattaatatttgggggggaggggtttcaaatttatacgaattatgcaataccaagttttgcctatgtaggtagtgcttttagctgtattggttattataggtaagtacacagattt

SEQ ID NO: 313169 - DNA, 2935 bp, Homo sapiens
tcccgcgcccccctccccgccttttttgaaaaagcattttaccaccaaccaccaccccaatccaacccacaccgaaccttcgcgcaccccctacaccccaacaacaacaacaactgcaaaatagaaaacaaatccccaaacccaggcgaaaagcagccaacaccggcggcggcggcggcctcggcaagcacggccagcgcgctcggactgcaagagggttaaaagtgtagattggatttcacccctggaactctagcacgccgagtgaacttgaatctttggctatttaaggaggactgggtttgttgtgaagttgcggtgatccagcgcagagccccgtcctgattgatcgcatcgcggggctcagatgactgtaaaatgaatagatgaaattcttgcttctcgaagattttcttgggcatctcccggaaagtgcgttttaaggcgaagtcatgatgtattctcccatctgtctcactcaggatgaatttcacccattcatcgaggcacttcttccacatgtccgtgcaattgcctatacttggttcaacctgcaggctcgaaaacgcaagtactttaaaaagcatgagaagcgaatgtcaaaggatgaagaaagagcagtcaaagatgagcttctcagtgaaaagcctgaaatcaaacagaagtgggcatccaggctccttgccaaactgcgcaaagatattcgccaggagtatcgagaggactttgtgctcaccgtgactggcaagaagcacccgtgctgtgtcttatccaatcccgaccagaagggtaagattaggagaatcgactgcctgcgacaggcagacaaagtctggcgtctggatctagtcatggtgatcctgttcaaaggcatccccttggaaagtaccgatggagagcggctcatgaaatccccacattgcacaaacccagcactttgtgtccagccacatcatatcacagtatcagttaaggagcttgatttgtttttggcatactacgtgcaggagcaagattctggacaatcaggaagtccaagccacaatgatcctgccaagaatcctccaggttaccttgaggatagttttgtaaaatctggagtcttcaatgtatcagaacttgtaagagtatccagaacgcccataacccagggaactggagtcaacttcccaattggagaaatcccaagccaaccatactatcatgacatgaactcgggggtcaatcttcagaggtctctgtcttctccaccaagcagcaaaagacccaaaactatatccatagatgaaaatatggaaccaagtcctacaggagacttttacccctctccaagttcaccagctgctggaagtcgaacatggcacgaaagagatcaagatatgtcttctccgactactatgaagaagcctgaaaagccattgttcagctctgcatctccacaggattcttccccaagactgagcactttcccccagcaccaccatcccggaatacctggagttgcacacagtgtcatctcaactcgaactccacctccaccttcaccgttgccatttccaacacaagctatccttcctccagccccatcgagctacttttctcatccaacaatcagatatcctccccacctgaatcctcaggatactctgaagaactatgtaccttcttatgacccatccagtccacaaaccagccagtcctggtacctgggctagcttggttcctttccaagtgtcaaataggacacccatcttaccggccaatgtccaaaattacggtttgaacataattggagaacctttccttcaagcagaaacaagcaactgagggaaaaagaaacacaacaatagtttaagaaattttttttttaaataaaaaaaaaggaaaagaggaagactggacaaaacaacacaaaggcagaaaggaaagaaactgaagaaagaagataatagaccagcaattgcagcacttacaatcactaattcccttaaggttgaaactgtaatgacataaaaagggtcgatgatatttcactgatggtagatcgcagcccctgcaacgtagcctttgttacatgaagtccgctgggaaatagatgttctgtctctatgacaatatattttaactgactttctagatgccttaatatttgcatgataagctagttttattggtttagtattcttgttgtttacgcatggaatcactattcctggttatctcaccaacgaaggctaggaggcggcgtcagaggtgctgggtgacagagccatgagccagccattttataaaaacgcactcttgagaaaacaaatgtaatcagggtgctgaaaacttgcatggtgctttcagacattagccttgttcaacaaatttcttgtattgacagatccatagtgtgcatgggcagacacattttgcctctatgtctcttaaaattttaattaaaaatactctttccagtaatcctaatttgcacgaagatataatgtccacattacgtgccttgccttgaaatctaaaaaacaaaaaacaaaaaaaaaaaaacaaaaaaatacaacaaagtgacatcactacacttgttttgctgcatttattatcattttaaatctttaccatttttatgacaaaatattttgtactccagacgaagaaaaatgtgtgacatcatggattttttagacagttatacctttatctcacatttataaagcatatcatggctgtgtatagttgccgcttaaaaattgtaatcgaccagcaatattttcagtattttggtgtttttttctattaacctttcatgtttttcatcttccaattaatatttgggggggaggggtttcaaatttatacgaattatgcaataccaagttttgcctatgtaggtagtgcttttagctgtattggttattataggtaagtacacagattt

SEQ ID NO: 313170 - DNA, 1850 bp, Homo sapiens
tcccgcgcccccctccccgccttttttgaaaaagcattttaccaccaaccaccaccccaatccaacccacaccgaaccttcgcgcaccccctacaccccaacaacaacaacaactgcaaaatagaaaacaaatccccaaacccaggcgaaaagcagccaacaccggcggcggcggcggcctcggcaagcacggccagcgcgctcggactgcaagagggttaaaagtgtagattggatttcacccctggaactctagcacgccgagtgaacttgaatctttggctatttaaggaggactgggtttgttgtgaagttgcggtgatccagcgcagagccccgtcctgattgatcgcatcgcggggctcagatgactgtaaaatgaatagatgaaattcttgcttctcgaagattttcttgggcatctcccggaaagtgcgttttaaggcgaagtcatgatgtattctcccatctgtctcactcaggatgaatttcacccattcatcgaggcacttcttccacatgtccgtgcaattgcctatacttggttcaacctgcaggctcgaaaacgcaagtactttaaaaagcatgagaagcgaatgtcaaaggatgaagaaagagcagtcaaagatgagcttctcagtgaaaagcctgaaatcaaacagaagtgggcatccaggctccttgccaaactgcgcaaagatattcgccaggagtatcgagaggactttgtgctcaccgtgactggcaagaagcacccgtgctgtgtcttatccaatcccgaccagaagggtaagattaggagaatcgactgcctgcgacaggcagacaaagtctggcgtctggatctagtcatggtgatcctgttcaaaggcatccccttggaaagtaccgatggagagcggctcatgaaatccccacattgcacaaacccagcactttgtgtccagccacatcatatcacagtatcagttaaggagcttgatttgtttttggcatactacgtgcaggagcaagattctggacaatcaggaagtccaagccacaatgatcctgccaagaatcctccaggttaccttgaggatagttttgtaaaatctggagtcttcaatgtatcagaacttgtaagagtatccagaacgcccataacccagggaactggagtcaacttcccaattggagaaatcccaagccaaccatactatcatgacatgaactcgggggtcaatcttcagaggtctctgtcttctccaccaagcagcaaaagacccaaaactatatccatagatgaaaatatggaaccaagtcctacaggagacttttacccctctccaagttcaccagctgctggaagtcgaacatggcacgaaagagatcaagatatgtcttctccgactactatgaagaagcctgaaaagccattgttcagctctgcatctccacaggattcttccccaagactgagcactttcccccagcaccaccatcccggaatacctggagttgcacacagtgtcatctcaactcgaactccacctccaccttcaccgttgccatttccaacacaagctatccttcctccagccccatcgagctacttttctcatccaacaatcagatatcctccccacctgaatcctcaggatactctgaagaactatgtaccttcttatgacccatccagtccacaaaccagccagtcctgggtacctgggtagctggggcctttcccagtgtcgaaagggaacccctttttacggacagtccaaatccggttgacctatggggaacttccttagagaaaagcactggggaagacacccagttgaaatttttcaaacacaaaggaggag

SEQ ID NO: 313171 - DNA, 1226 bp, Homo sapiens
ctagtcattatttgctgtcgggtttccagtttcaccgtgtgttagggtgagggatgattgtaaaattgctcctcaaaggaatcaggccagactcaattttggagggcaagacagggaggaggccgcttcatcccagactctcttctagggcttcccaccatcagcccctcccacttgagactggtctttgggaggcaataggccaccatgcctggtcagcaccaattcaagccatgccaggaatctgcctacctgccaggttcagttcttttaaggtgcctcttcagggacacagtgtgtctctctgattgggcttctaaatcaaaagcctgatgttcgtgtccctctcatagggggagctttggacacaggaccagtttggaaaagggtcaggtaagggtttccactctgcacattgtagagggaacactctgtaggcccatgggtcccttactagagaggttgagtgaatttgccttcagttaacatgggaccttctgtttagcttcctcttgcttcccaaagattttaagcattttgtaaatgtataaactcacctctggtaacagtggcccagacgctgctttgtgctaaaagcatgggaaatgtaaaggcagtctttctctgggaaatggatgctattctattctgctgcccctacctgttcctgaggcctcatttagaaagaaaatcccctcagaaggctgtctggcacccagtgtcctagccaggccaagtatatgagaaaggtaagtccattttccccttcaggtcctcagtggattacttaaccactgctgtccctcggtccctttttcctaaacgggtttagttctgtcttttttctccttttttctaaatgctggtaaatatttacattcagccagggaagaggaggccagaggtcgggccagctgccccattcttttaacgttgtagggcctgcccatggagcggaccctcctctttgggcctcgtgagcttttttgcttatcatgttccatttcgtgccgctttcccccttcaagatgccatttggagggtaggggatctgcttcccactgtgactgggctatgggattctgactaccttgcttacagattcatggtttgataaatttgttgtattcaaaaacttgaaatgcaggacgccattaagtgtctgtttatatttttggaatatttgtattacttacaattaattaataaaagtgggtttaaaaaac

SEQ ID NO: 313172 - DNA, 1247 bp, Homo sapiens
ctagtcattatttgctgtcgggtttccagtttcaccgtgtgttagggtgagggatgattgtaaaattgctcctcaaaggaatcaggccagactcaattttggagggcaagacagggaggaggccgcttcatcccagactctcttctagggcttcccaccatcagcccctcccacttgagactggtctttgggaggcaataggccaccatgcctggtcagcaccaattcaagccatgccaggaatctgcctacctgccaggttcagttcttttaaggtgcctcttcagggacacagtgtgtctctctgattgggcttctaaatcaaaagcctgatgttcgtgtccctctcatagggggagctttggacacaggaccagtttggaaaagggtcaggtaagggtttccactctgcacattgtagagggaacactctgtaggcccatgggtcccttactagagaggttgagtgaatttgccttcagttaacatgggaccttctgtttagcttcctcttgcttcccaaagattttaagcattttgtaaatgtataaactcacctctggtaacagtggcccagacgctgctttgtgctaaaagcatgggaaatgtaaaggcagtctttctctgggaaatggatgctattctattctgctgcccctacctgttcctgaggcctcatttagaaagaaaatcccctcagaaggctgtctggcacccagtgtcctagccaggccaagtatatgagaaaggtaagtccattttccccttcaggtcctcagtggattacttaaccactgctgtccctcggtccctttttcctaaacgggtttagttctgtcttttttctccttttttctaaatgctggtaaatatttacattcagccagggaagaggaggccagaggtcgggccagctgccccattcttttaacgttgtagggcctgcccatggagcggaccctcctctttgggcctcgtgagcttttttgcttatcatgttccatttcgtgccgctttcccccttcaagatgccatttggagggtaggggatctgcttcccactgtgactgggctatgggattctgactaccttgcttacagattcatggtttgataaatttgttgtattcaaaaacttgaaatgcaggacgccattaagtgtctgtttatatttttggaatatttgtattacttacaattaattaataaaagtgggtttaaaaaacctttccaggaaaaaaaaaaaa

SEQ ID NO: 313173 - DNA, 447 bp, Homo sapiens
ataagtctgcttttcagggattctctgctggtgctggtgcaaggacttctgttccaaaggctgggaaaaactaagctgtcccagcccctcccatttcttgggcagggctcttttcctgttgtgtcttcccccaagctgccccattcttttaacgttgtagggcctgcccatggagcggaccctcctctttgggcctcgtgagcttttttgcttatcatgttccatttcgtgccgctttcccccttcaagatgccatttggagggtaggggatctgcttcccactgtgactgggctatgggattctgactaccttgcttacagattcatggtttgataaatttgttgtattcaaaaacttgaaatgcaggacgccattaagtgtctgtttatatttttggaatatttgtattacttacaattaattaataaaagtgggtttaaaaaac

SEQ ID NO: 313174 - DNA, 700 bp, Homo sapiens
gggacagcagtggttaagtaatccactgaggacctgaaggggaaaatggacttacctttctcatatacttggcctggctaggacactgggtgccagacagccttctgaggggattttctttctaaatgaggcctcaggaacaggtaggggcagcagaatagaatagcatccatttcccagagaaagactgcctttacatttagctgccccattcttttaacgttgtagggcctgcccatggagcggaccctcctctttgggcctcgtgagcttttttgcttatcatgttccatttcgtgccgctttcccccttcaagatgccatttggagggtaggggatctgcttcccactgtgactgggctatgggattctgactaccttgcttacagattcatggtttgataaatttgttgtattcaaaaacttgaaatgcaggacgccattaagtgtctgtttatatttttggaatatttgtattacttacaattaattaataaaagtgggtttaaaaaacaaaaaagaaaaacaaaaaagaaaaaaaaaataaagaaaaaagaaaaaacaaaaaagacaacaaacacagcagaggagggggggcggcccacaagtgacacccccgcgcggcccgcacgctgaagcgccgccagcgctttgtcgtgaacagagggcgcgcccaaagagggacgcgtagtaatacac

SEQ ID NO: 313175 - DNA, 334 bp, Homo sapiens
cctgcttccaagcgacggccatcccagtaggggactttcccacactgtgcctttacgatcagcgtgagcttttttgcttatcatgttccatttcgtgccgctttcccccttcaagatgccatttggagggtaggggatctgcttcccactgtgactgggctatgggattctgactaccttgcttacagattcatggtttgataaatttgttgtattcaaaaacttgaaatgcaggacgccattaagtgtctgtttatatttttggaatatttgtattacttacaattaattaataaaagtgggtttaaaaaacctttccaggaaaaaaaaaaaa

SEQ ID NO: 313176 - DNA, 760 bp, Homo sapiens
acgtagccagggtccattcatgtggaccagagcccgcctagtcattatttgctgtcgggtttccagtttcaccgtgtgttagggtgagggatgattgtaaaattgctcctcaaaggaatcaggccagactcaattttggagggcaagacagggaggaggccgcttcatcccagactctcttctagggcttcccaccatcagcccctcccacttgagactggtctttgggaggcaataggccaccatgcctggtcagcaccaattcaagccatgccaggaatctgcctacctgccaggttcagttcttttaaggtgcctcttcagggacacagtgtgtctctctgattgggcttctaaatcaaaagcctgatgttcgtgtccctctcatagggggagctttggacacaggaccagtttggaaaagggtcaggtaagggtttccactctgcacattgtagagggaacactctgtaggcccatgggtcccttactagagaggttgagtgaatttgccttcagttaacatgggaccttctgtttagcttcctcttgcttcccaaagattttaagcattttgtaaatgtataaactcacctctggtaacagtggcccagacgctgctttgtgctaaaagcatgggaaatgtaaaggcagtctttctctgggaaatggatgctattctattctgctgcccctacctgttcctgaggcctcatttagaaagaaaatcccctcagaaggctgtctggcacccagtgtc

SEQ ID NO: 313177 - DNA, 497 bp, Homo sapiens
  misc_feature (85)..(85): n is a, c, g, or t
gagctcgctgcgtataaggaggaagcaaacaccattgctaagtcggatctgctccagtgtctccagtaccagttctaccagatcncagggacctgcctgctcccagaggtgacagaggaagatcaaggaaggatctgtgtggtcattgacctcgatgaaacccttgtgcatagctcctttaagccaatcaacaatgctgacttcatagtgcctatagagattgagcggaccctcctctttgggcctcgtgagcttttttgcttatcatgttccatttcgtgccgctttcccccttcaagatgccatttggagggtaggggatctgcttcccactgtgactgggctatgggattctgactaccttgcttacagattcatggtttgataaatttgttgtattcaaaaacttgaaatgcaggacgccattaagtgtctgtttatatttttggaatatttgtattacttacaattaattaataaaagtgggtttaaaaaac

SEQ ID NO: 313178 - DNA, 7453 bp, Homo sapiens
tctgcggcgctcggagcctcccttgcgatcccacggccgggactgcccggagtgcatgggcgcgggccagggacgctgagcggtcgcgccatggagggcgccgagccccgcgcgcggcccgagcgcctggccgaggccgagacgcgggcggcggacggcgggcgcctggtggaggtgcagctgagcggcggcgccccgtggggcttcaccctgaagggcggccgcgagcacggcgagccgctggtcatcaccaagattgaagagggcagtaaagccgcggcggtcgacaagttactggctggagatgagatcgtcggcatcaatgacattggtctctcagggtttagacaggaagcgatttgcctggtgaaggggtcccataagaccctgaagctggtcgtcaaaaggaggagcgagctgggctggaggcctcactcctggcatgccaccaagttctctgacagccaccccgagctagcggcctccccattcacctccaccagcggctgtccttcctggtccggccgacaccacgcgagttcttcctcccacgacctgtccagttcctgggagcagacgaacctacagcgcaccttagatcacttcagctccttggggagcgttgacagcctggaccacccctccagtcgcctctcggtggccaagtccaacagcagcatcgaccacctgggcagccacagcaagcgcgactcggcctacggctccttctccaccagctctagcactcctgaccacaccttgtccaaagccgacacgtcctccgcagagaacatcctctacactgtgggcctctgggaggctcccaggcagggtggccggcaggcccaggccgcaggcgaccctcagggctcggaggagaagctcagttgtttcccgcccagggtccccggtgacagcggcaaaggccccaggccagagtacaatgccgagcccaagctggctgcccctgggaggtccaattttgggccagtctggtatgttcccgataagaagaaagcaccatcatccccacctcctccccctccccctctccgcagtgacagctttgctgccaccaagagccacgagaaggcccagggccctgtgttctcagaggcggctgcggcacagcactttacggccctggcccaggctcagcctcgtggtgaccggagaccagagctcaccgatcggccttggaggtcagcacacccggggagcctcgggaagggatcgggaggcccgggctgcccacaggaggcccacgcagacggcagctggccgccctccaaggatggagcttccagtaggctgcaggcctctctgtccagctcagatgtgcgcttccctcagtctcctcatagcggccgacaccctcccctatacagcgaccacagccccctctgtgctgacagccttgggcaggagccaggggctgccagcttccagaacgacagccctcctcaggtgagggggctcagcagctgtgaccagaagctggggagcggctggcagggtccccggccctgtgtgcagggagacctgcaagcagcacagctctgggcgggatgctggccttctgacacagcccttggagccctcgagagtcttcccccacccacggtgggccagagcccacgccatcacctacctcagcctgagggtcctccggatgcccgcgagacaggacggtgttacccgctggacaaaggggccgagggctgctccgcgggagcccaggagcctcccagggccagccgtgcagaaaaagccagccagaggctggcagccagcatcacgtgggcagatggggagagcagcaggatctgcccgcaggagacgcccctgttgcactccctgacccaggaggggaagcgccggcctgagagcagtccagaggacagcgccaccagaccgccaccgttcgacgcccacgtgggcaagcccacccgaagaagcgaccgctttgccaccaccctgcggaatgagatccagatgcatagagccaagctgcagaagagccggagcacagtggctctgactgcagcaggggaggcggaggatggcaccggccgctggagggccgggttgggaggtggcacccaggaaggacccctcgctggcacctataaagaccacctgaaagaggcccaagcccgggtcctgagggccacgtccttcaagcgccgcgacttggaccccaacccaggagacctatacccggagtcactggaacaccggatgggggatccagacactgtcccccacttctgggaggcaggcctggcccagccaccctcatctacaagtggcgggccccacccgccccgcatcggaggccggagacggttcacagctgagcagaaattgaagtcctactcggaacctgagaagatgaacgaggtgggcctcacgaggggctacagtcctcaccagcaccccaggacatctgaggatactgtgggcacgtttgctgacaggtggaagttttttgaggaaacgagcaaacctgttccccagaggcctgcccagaagcaagctcttcacggaatcccgagagacaagccagagaggccgcggacagcgggccgcacatgtgagggcacggagccctggtcgcgcaccacctcccttggggacagcctcaacgctcacagcgcagcggagaaggcagggacttcagacctgccgcggaggctcggcacctttgcagagtatcaggcctcttggaaggaacagaggaaacctctggaggccaggagctctgggcgctgccactcagcggatgacatcctggatgtgagcctggacccacaggagaggccgcagcacgttcatgggaggtcccggtcttcaccgtccacagaccactacaagcaggaagcttctgtcgaactgcgaaggcaggcaggggaccccggcgagcccagagaagagcttccctccgcagtccgggccgaggagggacagtccacgccgagacaagcagatgcccagtgtcgggaaggcagcccaggatcacagcagcacccaccgagtcagaaggcaccgaacccacccacattctctgaactatctcactgccggggagccccagagctgccccgggagggccggggccgagcgggaaccctacctcgagattatagatactcggaggagagcaccccagcagacttgggaccccgagcccagagccctggctcacccctgcatgctcgaggacaagactcgtggccagtgagctcagccctgctctccaagaggccagccccacagaggccaccgccacccaagcgcgagcccaggagatacagggccacagacggcgcacctgctgacgcccccgtgggcgtcctcggcaggcccttcccaacgccatcccctgcgtccctggatgtgtatgtggcccgcctgtccctctcccacagcccctctgtgttcagcagtgcccagccccaggacaccccgaaggccactgtctgtgagcgtggaagccagcatgtgagcggggacgcatcacgtcctctgccagaagcactgctccctcccaagcagcagcacctgcgcctgcagacggccaccatggagacctcgcgctccccctcgccccagttcgccccccagaaactgacggacaaacctcccctgctcatccaggatgaggattcaaccagaattgagcgggtgatggacaacaacaccacggtgaagatggtgcccatcaagatcgtgcactcggagagccagccagagaaggagagccgccagagcctggcatgccccgccgagccacctgccctgccccacgggctggagaaagaccagatcaagacgctgagcacatctgagcagttctactcgcgcttctgtctgtacacgcggcagggtgctgagcccgaggccccacatagggcccagccggctgagccccagcccctgggcacccaggtgccccccgagaaagaccgctgcacctcccctccagggctcagctacatgaaggccaaagagaagactgtggaagacctgaagtcggaggagctggccagggagatcgtggggaaggataagtccctggccgacatcctggatcccagtgtgaagatcaaaaccactatggacttgatggaaggcatcttccccaaagacgagcacctcctggaagaagcccagcaacggaggaagctgctccccaaaatcccctctcctagaagcacagaggagaggaaagaggagcccagcgtgcctgcggccgtgtccctggccaccaattctacctactacagcacgtcggcccccaaggcggagctgctgatcaagatgaaggacctgcaggagcagcaggagcacgaagaggattcgggaagcgacttggaccacgacctgtcggtgaagaagcaggagctcatcgagagcatcagccgcaagctgcaggtgctccgggaggcccgcgagagcctgctggaggacgtgcaggccaacaccgtgctgggggccgaggtggaggccatcgtgaaaggcgtctgcaagcccagcgagtttgacaagttccggatgttcattggagacctggacaaagtggtgaacctcctgctgtcgctgtcaggccgcctggcccgggtggagaatgccctcaataatttggacgacggcgcttctcccggtgatcggcaatcactgcttgagaagcagagagtcctgatccagcagcacgaggacgccaaggagctcaaggagaacctggaccgccgcgagcgcatcgtctttgacattttggccaactatctgagcgaggagagcctcgcggactatgagcacttcgtgaagatgaagtcggccctcatcatcgagcagcgggagctggaagataaaatccaccttggtgaagagcagctgaagtgcttattggacagccttcagcccgaaaggggcaaataagagaccagtccccggtggaggaggggcacggggcctccgagctccagctccgttcccaaggatactcgtgaagaccccatctgtgttcatggcctggaaagagacttctcccatagcaaagaggctgttataaaagcaataacttttgtgtttgtgtgggatgatttatttaattttttagtttcccctttgattgctgagagccattttcctttacacataactacacctgacaccaggctctgctggatgtgagtttccactgcatgggctgtgggctgggcctgtggtgcctgccgagtggtcactgtcagtgggaaacccgttgttcctcccgtcttcagatgctgagccaactgcttggacagcagccagcgcgtcatgacgtgcatgagagggggaccctggtgctcatcttctcttgtcattcatccaggcatgggctgccaggttttgtccctgctcgttcaacagtgtgagcatttgtctctgttatctaatgatgttctctgacccagcagaaatcatcatcatgatgatgataatttattaactttttggaagggtgaatagtttcctaatggttaaaaaccaactgtgaaaggaaccacctgtgtggttgggttcactcattctcagattaaattgccacttaaagaaataacgtgcatgctttaaaaaacacagtcacgcaccaagcaggcaaatagctttagtccttctcacctcacatcacagttgttctgcaaagtaaaattttttggttaagagcgtgtccagtagtaatgtgcttgttagctgtttctcaagaccaacagaagattttttcagttactttccccccatgtattttgtatgcatatgattgtccgtgataattggctacttttccattgtttcctccttaaatcgtttagcatggcatgagggccacattccatggacgggaagaccccttcctcttcagaggtcccgtggactacacagctcctgagcttgatctttttctgccatgaagtttaaagattctatgcccatttccttgattgaaatggcaggattctaaagagagcctggtttgttaaaagaaaacactgtcatgctgtcagttcccaattgacaagtcacagactgggagaaaatatttgcaaatcgtgtatctgacaaaaggtttgtgtccaggatgtacaaagaactctcaaaccggatagtaagaaaacaaacagcccaagtgaaaagcaggcaaaagacttgaatagacacttcaccaaagagcatacacgcgtggcaaacaagcacacgaaaagacgttcagccgccgatggcttggttataatttataacttacttatttttatctaataattgtagattcagtgtatttcttcaaaaaatgtttaattaaatgcatgttaatggtgagtgaatcccttgggtgacttcgtgtttaggtcgtattagggcatttgttggatcaacggatcattttaaccctgacttccccttattcccataaaagaagttttccagtggaatggagatttcattttgtcagcagcagtgaccacagccttaccaaagcagacgcgtgcgcgtgcacagatgcacacacacagatgtcttaaaagactagaatccacacttcctgagccagaggggccgtgttgacggtaatgcattctctatagagccaagtccaaactggcaagctcaatgatgcaggcaataaaccgcctttttggcagcctaccaatgccaaaaggataaatgtctttccaaaagtgtgtattcctgttaaattaagctcttgctaacttgaaaaatccctgttctgccagcgaagcttcctcctcctctccagctggtagtcacttgcgtgaatgctggtcagtctgaaaaggtgaagctggctgtgcacttacccccatctttctccctcggggagacgacccaaggaatttcagagtattttgtttggcagagcttttacctgttattctttgccctcaaatacagtattgtggtcattttgatgatatgtgtgtaaaatgtgaataatccaattggtgtctgtactcagccttttgatgtctttttaggactttctcttctacacagcaatacgtcgtgctcgagtatccttgtagcaaagcacatagagccagctgtcctgtcagttcccctgtttgcctctgaaacgtctggttagtggggacccaaagattctagtgagtcaacatccataactctgtatctagttgtattattcatagaaaatcaatctggtgctaatggttggccctggtgttgttgggtggcagctgctccttcgccctcttgtagtgtggctgtggagggctctgcctatggggggtggcctgtggcttgtatccttcagtccaccacagcaaatgtgtgtagatttcatgctcgacacttaccactcacctatcaacagatcatcctgcttgactgtaacaaaataaatagtgtctcttcaagtgaatggaga

SEQ ID NO: 313179 - DNA, 7399 bp, Homo sapiens
tctgcggcgctcggagcctcccttgcgatcccacggccgggactgcccggagtgcatgggcgcgggccagggacgctgagcggtcgcgccatggagggcgccgagccccgcgcgcggcccgagcgcctggccgaggccgagacgcgggcggcggacggcgggcgcctggtggaggtgcagctgagcggcggcgccccgtggggcttcaccctgaagggcggccgcgagcacggcgagccgctggtcatcaccaagattgaagagggcagtaaagccgcggcggtcgacaagttactggctggagatgagatcgtcggcatcaatgacattggtctctcagggtttagacaggaagcgatttgcctggtgaaggggtcccataagaccctgaagctggtcgtcaaaaggaggagcgagctgggctggaggcctcactcctggcatgccaccaagttctctgacagccaccccgagctagcggcctccccattcacctccaccagcggctgtccttcctggtccggccgacaccacgcgagttcttcctcccacgacctgtccagttcctgggagcagacgaacctacagcgcaccttagatcacttcagctccttggggagcgttgacagcctggaccacccctccagtcgcctctcggtggccaagtccaacagcagcatcgaccacctgggcagccacagcaagcgcgactcggcctacggctccttctccaccagctctagcactcctgaccacaccttgtccaaagccgacacgtcctccgcagagaacatcctctacactgtgggcctctgggaggctcccaggcagggtggccggcaggcccaggccgcaggcgaccctcagggctcggaggagaagctcagttgtttcccgcccagggtccccggtgacagcggcaaaggccccaggccagagtacaatgccgagcccaagctggctgcccctgggaggtccaattttgggccagtctggtatgttcccgataagaagaaagcaccatcatccccacctcctccccctccccctctccgcagtgacagctttgctgccaccaagagccacgagaaggcccagggccctgtgttctcagaggcggctgcggcacagcactttacggccctggcccaggctcagcctcgtggtgaccggagaccagagctcaccgatcggccttggaggtcagcacacccggggagcctcgggaagggatcgggaggcccgggctgcccacaggaggcccacgcagacggcagctggccgccctccaaggatggagcttccagtaggctgcaggcctctctgtccagctcagatgtgcgcttccctcagtctcctcatagcggccgacaccctcccctatacagcgaccacagccccctctgtgctgacagccttgggcaggagccaggggctgccagcttccagaacgacagccctcctcaggtgagggggctcagcagctgtgaccagaagctggggagcggctggcagggtccccggccctgtgtgcagggagacctgcaagcagcacagctctgggcgggatgctggccttctgacacagcccttggagccctcgagagtcttcccccacccacggtgggccagagcccacgccatcacctacctcagcctgagggtcctccggatgcccgcgagacaggacggtgttacccgctggacaaaggggccgagggctgctccgcgggagcccaggagcctcccagggccagccgtgcagaaaaagccagccagaggctggcagccagcatcacgtgggcagatggggagagcagcaggatctgcccgcaggagacgcccctgttgcactccctgacccaggaggggaagcgccggcctgagagcagtccagaggacagcgccaccagaccgccaccgttcgacgcccacgtgggcaagcccacccgaagaagcgaccgctttgccaccaccctgcggaatgagatccagatgcatagagccaagctgcagaagagccggagcacagtggctctgactgcagcaggggaggcggaggatggcaccggccgctggagggccgggttgggaggtggcacccaggaaggacccctcgctggcacctataaagaccacctgaaagaggcccaagcccgggtcctgagggccacgtccttcaagcgccgcgacttggaccccaacccaggagacctatacccggagtcactggaacaccggatgggggatccagacactgtcccccacttctgggaggcaggcctggcccagccaccctcatctacaagtggcgggccccacccgccccgcatcggaggccggagacggttcacagctgagcagaaattgaagtcctactcggaacctgagaagatgaacgaggtgggcctcacgaggggctacagtcctcaccagcaccccaggacatctgaggatactgtgggcacgtttgctgacaggtggaagttttttgaggaaacgagcaaacctgttccccagaggcctgcccagaagcaagctcttcacggaatcccgagagacaagccagagaggccgcggacagcgggccgcacatgtgagggcacggagccctggtcgcgcaccacctcccttggggacagcctcaacgctcacagcgcagcggagaaggcagggacttcagacctgccgcggaggctcggcacctttgcagagtatcaggcctcttggaaggaacagaggaaacctctggaggccaggagctctgggcgctgccactcagcggatgacatcctggatgtgagcctggacccacaggagaggccgcagcacgttcatgggaggtcccggtcttcaccgtccacagaccactacaagcaggaagcttctgtcgaactgcgaaggcaggcaggggaccccggcgagcccagagaagagcttccctccgcagtccgggccgaggagggacagtccacgccgagacaagcagatgcccagtgtcgggaaggcagcccaggatcacagcagcacccaccgagtcagaaggcaccgaacccacccacattctctgaactatctcactgccggggagccccagagctgccccgggagggccggggccgagcgggaaccctacctcgagattatagatactcggaggagagcaccccagcagacttgggaccccgagcccagagccctggctcacccctgcatgctcgaggacaagactcgtggccagtgagctcagccctgctctccaagaggccagccccacagaggccaccgccacccaagcgcgagcccaggagatacagggccacagacggcgcacctgctgacgcccccgtgggcgtcctcggcaggcccttcccaacgccatcccctgcgtccctggatgtgtatgtggcccgcctgtccctctcccacagcccctctgtgttcagcagtgcccagccccaggacaccccgaaggccactgtctgtgagcgtggaagccagcatgtgagcggggacgcatcacgtcctctgccagaagcactgctccctcccaagcagcagcacctgcgcctgcagacggccaccatggagacctcgcgctccccctcgccccagttcgccccccagaaactgacggacaaacctcccctgctcatccaggatgaggattcaaccagaattgagcgggtgatggacaacaacaccacggtgaagatggtgcccatcaagatcgtgcactcggagagccagccagagaaggagagccgccagagcctggcatgccccgccgagccacctgccctgccccacgggctggagaaagaccagatcaagacgctgagcacatctgagcagttctactcgcgcttctgtctgtacacgcggcagggtgctgagcccgaggccccacatagggcccagccggctgagccccagcccctgggcacccaggtgccccccgagaaagaccgctgcacctcccctccagggctcagctacatgaaggccaaagagaagactgtggaagacctgaagtcggaggagctggccagggagatcgtggggaaggataagtccctggccgacatcctggatcccagtgtgaagatcaaaaccactatggacttgatggaaggcatcttccccaaagacgagcacctcctggaagaagcccagcaacggaggaagctgctccccaaaatcccctctcctagaagcacagaggagaggaaagaggagcccagcgtgcctgcggccgtgtccctggccaccaattctacctactacagcacgtcggcccccaaggcggagctgctgatcaagatgaaggacctgcaggagcagcaggagcacgaagaggattcgggaagcgacttggaccacgacctgtcggtgaagaagcaggagctcatcgagagcatcagccgcaagctgcaggtgctccgggaggcccgcgagagcctgctggaggacgtgcaggccaacaccgtgctgggggccgaggtggaggccatcgtgaaaggcgtctgcaagcccagcgagtttgacaagttccggatgttcattggagacctggacaaagtggtgaacctcctgctgtcgctgtcaggccgcctggcccgggtggagaatgccctcaataatttggacgacggcgcttctcccggtgatcggcaatcactgcttgagaagcagagagtcctgatccagcagcacgaggacgccaaggagctcaaggagaacctggaccgccgcgagcgcatcgtctttgacattttggccaactatctgagcgaggagagcctcgcggactatgagcacttcgtgaagatgaagtcggccctcatcatcgagcagcgggagctggaagataaaatccaccttggtgaagagcagctgaagtgcttattggacagccttcagcccgaaaggggcaaataagagaccagtccccggtggaggaggggcacggggcctccgagctccagctccgttcccaaggatactcgtgaagaccccatctgtgttcatggcctggaaagagacttctcccatagcaaagaggctgttataaaagcaataacttttgtgtttgtgtgggatgatttatttaattttttagtttcccctttgattgctgagagccattttcctttacacataactacacctgacaccaggctctgctggatgtgagtttccactgcatgggctgtgggctgggcctgtggtgcctgccgagtggtcactgtcagtgggaaacccgttgttcctcccgtcttcagatgctgagccaactgcttggacagcagccagcgcgtcatgacgtgcatgagagggggaccctggtgctcatcttctcttgtcattcatccaggcatgggctgccaggttttgtccctgctcgttcaacagtgtgagcatttgtctctgttatctaatgatgttctctgacccagcagaaatcatcatcatgatgatgataatttattaactttttggaagggtgaatagtttcctaatggttaaaaaccaactgtgaaaggaaccacctgtgtggttgggttcactcattctcagattaaattgccacttaaagaaataacgtgcatgctttaaaaaacacagtcacgcaccaagcaggcaaatagctttagtccttctcacctcacatcacagttgttctgcaaagtaaaattttttggttaagagcgtgtccagtagtaatgtgcttgttagctgtttctcaagaccaacagaagattttttcagttactttccccccatgtattttgtatgcatatgattgtccgtgataattggctacttttccattgtttcctccttaaatcgtttagcatggcatgagggccacattccatggacgggaagaccccttcctcttcagaggtcccgtggactacacagctcctgagcttgatctttttctgccatgaagtttaaagattctatgcccatttccttgattgaaatggcaggattctaaagagagcctggtttgttaaaagaaaacactgtcatgctgtcagttcccaattgacaagtcacagactgggagaaaatatttgcaaatcgtgtatctgacaaaaggtttgtgtccaggatgtacaaagaactctcaaaccggatagtaagaaaacaaacagcccaagtgaaaagcaggcaaaagacttgaatagacacttcaccaaagagcatacacgcgtggcaaacaagcacacgaaaagacgttcagccgccgatggcttggttataatttataacttacttatttttatctaataattgtagattcagtgtatttcttcaaaaaatgtttaattaaatgcatgttaatggtgagtgaatcccttgggtgacttcgtgtttaggtcgtattagggcatttgttggatcaacggatcattttaaccctgacttccccttattcccataaaagaagttttccagtggaatggagatttcattttgtcagcagcagtgaccacagccttaccaaagcagacgcgtgcgcgtgcacagatgcacacacacagatgtcttaaaagactagaatccacacttcctgagccagaggggccgtgttgacggtaatgcattctctatagagccaagtccaaactggcaagctcaatgatgcaggcaataaaccgcctttttggcagcctaccaatgccaaaaggataaatgtctttccaaaagtgtgtattcctgttaaattaagctcttgctaacttgaaaaatccctgttctgccagcgaagcttcctcctcctctccagctggtagtcacttgcgtgaatgctggtcagtctgcccaaggaatttcagagtattttgtttggcagagcttttacctgttattctttgccctcaaatacagtattgtggtcattttgatgatatgtgtgtaaaatgtgaataatccaattggtgtctgtactcagccttttgatgtctttttaggactttctcttctacacagcaatacgtcgtgctcgagtatccttgtagcaaagcacatagagccagctgtcctgtcagttcccctgtttgcctctgaaacgtctggttagtggggacccaaagattctagtgagtcaacatccataactctgtatctagttgtattattcatagaaaatcaatctggtgctaatggttggccctggtgttgttgggtggcagctgctccttcgccctcttgtagtgtggctgtggagggctctgcctatggggggtggcctgtggcttgtatccttcagtccaccacagcaaatgtgtgtagatttcatgctcgacacttaccactcacctatcaacagatcatcctgcttgactgtaacaaaataaatagtgtctcttcaagtgaatggaga

SEQ ID NO: 313180 - DNA, 4365 bp, Homo sapiens
tctgcggcgctcggagcctcccttgcgatcccacggccgggactgcccggagtgcatgggcgcgggccagggacgctgagcggtcgcgccatggagggcgccgagccccgcgcgcggcccgagcgcctggccgaggccgagacgcgggcggcggacggcgggcgcctggtggaggtgcagctgagcggcggcgccccgtggggcttcaccctgaagggcggccgcgagcacggcgagccgctggtcatcaccaagattgaagagggcagtaaagccgcggcggtcgacaagttactggctggagatgagatcgtcggcatcaatgacattggtctctcagggtttagacaggaagcgatttgcctggtgaaggggtcccataagaccctgaagctggtcgtcaaaaggaggagcgagctgggctggaggcctcactcctggcatgccaccaagttctctgacagccaccccgagctagcggcctccccattcacctccaccagcggctgtccttcctggtccggccgacaccacgcgagttcttcctcccacgacctgtccagttcctgggagcagacgaacctacagcgcaccttagatcacttcagctccttggggagcgttgacagcctggaccacccctccagtcgcctctcggtggccaagtccaacagcagcatcgaccacctgggcagccacagcaagcgcgactcggcctacggctccttctccaccagctctagcactcctgaccacaccttgtccaaagccgacacgtcctccgcagagaacatcctctacactgtgggcctctgggaggctcccaggcagggtggccggcaggcccaggccgcaggcgaccctcagggctcggaggagaagctcagttgtttcccgcccagggtccccggtgacagcggcaaaggccccaggccagagtacaatgccgagcccaagctggctgcccctgggaggtccaattttgggccagtctggtatgttcccgataagaagaaagcaccatcatccccacctcctccccctccccctctccgcagtgacagctttgctgccaccaagagccacgagaaggcccagggccctgtgttctcagaggcggctgcggcacagcactttacggccctggcccaggctcagcctcgtggtgaccggagaccagagctcaccgatcggccttggaggtcagcacacccggggagcctcgggaagggatcgggaggcccgggctgcccacaggaggcccacgcagacggcagctggccgccctccaaggatggagcttccagtaggctgcaggcctctctgtccagctcagatgtgcgcttccctcagtctcctcatagcggccgacaccctcccctatacagcgaccacagccccctctgtgctgacagccttgggcaggagccaggggctgccagcttccagaacgacagccctcctcaggtgagggggctcagcagctgtgaccagaagctggggagcggctggcagggtccccggccctgtgtgcagggagacctgcaagcagcacagctctgggcgggatgctggccttctgacacagcccttggagccctcgagagtcttcccccacccacggtgggccagagcccacgccatcacctacctcagcctgagggtcctccggatgcccgcgagacaggacggtgttacccgctggacaaaggggccgagggctgctccgcgggagcccaggagcctcccagggccagccgtgcagaaaaagccagccagaggctggcagccagcatcacgtgggcagatggggagagcagcaggatctgcccgcaggagacgcccctgttgcactccctgacccaggaggggaagcgccggcctgagagcagtccagaggacagcgccaccagaccgccaccgttcgacgcccacgtgggcaagcccacccgaagaagcgaccgctttgccaccaccctgcggaatgagatccagatgcatagagccaagctgcagaagagccggagcacagtggctctgactgcagcaggggaggcggaggatggcaccggccgctggagggccgggttgggaggtggcacccaggaaggacccctcgctggcacctataaagaccacctgaaagaggcccaagcccgggtcctgagggccacgtccttcaagcgccgcgacttggaccccaacccaggagacctatacccggagtcactggaacaccggatgggggatccagacactgtcccccacttctgggaggcaggcctggcccagccaccctcatctacaagtggcgggccccacccgccccgcatcggaggccggagacggttcacagctgagcagaaattgaagtcctactcggaacctgagaagatgaacgaggtgggcctcacgaggggctacagtcctcaccagcaccccaggacatctgaggatactgtgggcacgtttgctgacaggtggaagttttttgaggaaacgagcaaacctgttccccagaggcctgcccagaagcaagctcttcacggaatcccgagagacaagccagagaggccgcggacagcgggccgcacatgtgagggcacggagccctggtcgcgcaccacctcccttggggacagcctcaacgctcacagcgcagcggagaaggcagggacttcagacctgccgcggaggctcggcacctttgcagagtatcaggcctcttggaaggaacagaggaaacctctggaggccaggagctctgggcgctgccactcagcggatgacatcctggatgtgagcctggacccacaggagaggccgcagcacgttcatgggaggtcccggtcttcaccgtccacagaccactacaagcaggaagcttctgtcgaactgcgaaggcaggcaggggaccccggcgagcccagagaagagcttccctccgcagtccgggccgaggagggacagtccacgccgagacaagcagatgcccagtgtcgggaaggcagcccaggatcacagcagcacccaccgagtcagaaggcaccgaacccacccacattctctgaactatctcactgccggggagccccagagctgccccgggagggccggggccgagcgggaaccctacctcgagattatagatactcggaggagagcaccccagcagacttgggaccccgagcccagagccctggctcacccctgcatgctcgaggacaagactcgtggccagtgagctcagccctgctctccaagaggccagccccacagaggccaccgccacccaagcgcgagcccaggagatacagggccacagacggcgcacctgctgacgcccccgtgggcgtcctcggcaggcccttcccaacgccatcccctgcgtccctggatgtgtatgtggcccgcctgtccctctcccacagcccctctgtgttcagcagtgcccagccccaggacaccccgaaggccactgtctgtgagcgtggaagccagcatgtgagcggggacgcatcacgtcctctgccagaagcactgctccctcccaagcagcagcacctgcgcctgcagacggccaccatggagacctcgcgctccccctcgccccagttcgccccccagaaactgacggacaaacctcccctgctcatccaggatgaggattcaaccagaattgagcgggtgatggacaacaacaccacggtgaagatggtgcccatcaagatcgtgcactcggagagccagccagagaaggagagccgccagagcctggcatgccccgccgagccacctgccctgccccacgggctggagaaagaccagatcaagacgctgagcacatctgagcagttctactcgcgcttctgtctgtacacgcggcagggtgctgagcccgaggccccacatagggcccagccggctgagccccagcccctgggcacccaggtgccccccgagaaagaccgctgcacctcccctccagggctcagctacatgaagcacatagagccagctgtcctgtcagttcccctgtttgcctctgaaacgtctggttagtggggacccaaagattctagtgagtcaacatccataactctgtatctagttgtattattcatagaaaatcaatctggtgctaatggttggccctggtgttgttgggtggcagctgctccttcgccctcttgtagtgtggctgtggagggctctgcctatggggggtggcctgtggcttgtatccttcagtccaccacagcaaatgtgtgtagatttcatgctcgacacttaccactcacctatcaacagatcatcctgcttgactgtaacaaaataaatagtgtctcttcaagtgaatggaga

SEQ ID NO: 313181 - DNA, 4552 bp, Homo sapiens
gagagctgcagcagaggcgggctgtgggtccctgaagcacatcgctgccttcacagctgggcgaactcccatccagcacgacaagcagatgcccagtgtcgggaaggcagcccaggatcacagcagcacccaccgagtcagaaggcaccgaacccacccacattctctgaactatctcactgccggggagccccagagctgccccgggagggccggggccgagcgggaaccctacctcgagattatagatactcggaggagagcaccccagcagacttgggaccccgagcccagagccctggctcacccctgcatgctcgaggacaagactcgtggccagtgagctcagccctgctctccaagaggccagccccacagaggccaccgccacccaagcgcgagcccaggagatacagggccacagacggcgcacctgctgacgcccccgtgggcgtcctcggcaggcccttcccaacgccatcccctgcgtccctggatgtgtatgtggcccgcctgtccctctcccacagcccctctgtgttcagcagtgcccagccccaggacaccccgaaggccactgtctgtgagcgtggaagccagcatgtgagcggggacgcatcacgtcctctgccagaagcactgctccctcccaagcagcagcacctgcgcctgcagacggccaccatggagacctcgcgctccccctcgccccagttcgccccccagaaactgacggacaaacctcccctgctcatccaggatgaggattcaaccagaattgagcgggtgatggacaacaacaccacggtgaagatggtgcccatcaagatcgtgcactcggagagccagccagagaaggagagccgccagagcctggcatgccccgccgagccacctgccctgccccacgggctggagaaagaccagatcaagacgctgagcacatctgagcagttctactcgcgcttctgtctgtacacgcggcagggtgctgagcccgaggccccacatagggcccagccggctgagccccagcccctgggcacccaggtgccccccgagaaagaccgctgcacctcccctccagggctcagctacatgaaggccaaagagaagactgtggaagacctgaagtcggaggagctggccagggagatcgtggggaaggataagtccctggccgacatcctggatcccagtgtgaagatcaaaaccactatggacttgatggaaggcatcttccccaaagacgagcacctcctggaagaagcccagcaacggaggaagctgctccccaaaatcccctctcctagaagcacagaggagaggaaagaggagcccagcgtgcctgcggccgtgtccctggccaccaattctacctactacagcacgtcggcccccaaggcggagctgctgatcaagatgaaggacctgcaggagcagcaggagcacgaagaggattcgggaagcgacttggaccacgacctgtcggtgaagaagcaggagctcatcgagagcatcagccgcaagctgcaggtgctccgggaggcccgcgagagcctgctggaggacgtgcaggccaacaccgtgctgggggccgaggtggaggccatcgtgaaaggcgtctgcaagcccagcgagtttgacaagttccggatgttcattggagacctggacaaagtggtgaacctcctgctgtcgctgtcaggccgcctggcccgggtggagaatgccctcaataatttggacgacggcgcttctcccggtgatcggcaatcactgcttgagaagcagagagtcctgatccagcagcacgaggacgccaaggagctcaaggagaacctggaccgccgcgagcgcatcgtctttgacattttggccaactatctgagcgaggagagcctcgcggactatgagcacttcgtgaagatgaagtcggccctcatcatcgagcagcgggagctggaagataaaatccaccttggtgaagagcagctgaagtgcttattggacagccttcagcccgaaaggggcaaataagagaccagtccccggtggaggaggggcacggggcctccgagctccagctccgttcccaaggatactcgtgaagaccccatctgtgttcatggcctggaaagagacttctcccatagcaaagaggctgttataaaagcaataacttttgtgtttgtgtgggatgatttatttaattttttagtttcccctttgattgctgagagccattttcctttacacataactacacctgacaccaggctctgctggatgtgagtttccactgcatgggctgtgggctgggcctgtggtgcctgccgagtggtcactgtcagtgggaaacccgttgttcctcccgtcttcagatgctgagccaactgcttggacagcagccagcgcgtcatgacgtgcatgagagggggaccctggtgctcatcttctcttgtcattcatccaggcatgggctgccaggttttgtccctgctcgttcaacagtgtgagcatttgtctctgttatctaatgatgttctctgacccagcagaaatcatcatcatgatgatgataatttattaactttttggaagggtgaatagtttcctaatggttaaaaaccaactgtgaaaggaaccacctgtgtggttgggttcactcattctcagattaaattgccacttaaagaaataacgtgcatgctttaaaaaacacagtcacgcaccaagcaggcaaatagctttagtccttctcacctcacatcacagttgttctgcaaagtaaaattttttggttaagagcgtgtccagtagtaatgtgcttgttagctgtttctcaagaccaacagaagattttttcagttactttccccccatgtattttgtatgcatatgattgtccgtgataattggctacttttccattgtttcctccttaaatcgtttagcatggcatgagggccacattccatggacgggaagaccccttcctcttcagaggtcccgtggactacacagctcctgagcttgatctttttctgccatgaagtttaaagattctatgcccatttccttgattgaaatggcaggattctaaagagagcctggtttgttaaaagaaaacactgtcatgctgtcagttcccaattgacaagtcacagactgggagaaaatatttgcaaatcgtgtatctgacaaaaggtttgtgtccaggatgtacaaagaactctcaaaccggatagtaagaaaacaaacagcccaagtgaaaagcaggcaaaagacttgaatagacacttcaccaaagagcatacacgcgtggcaaacaagcacacgaaaagacgttcagccgccgatggcttggttataatttataacttacttatttttatctaataattgtagattcagtgtatttcttcaaaaaatgtttaattaaatgcatgttaatggtgagtgaatcccttgggtgacttcgtgtttaggtcgtattagggcatttgttggatcaacggatcattttaaccctgacttccccttattcccataaaagaagttttccagtggaatggagatttcattttgtcagcagcagtgaccacagccttaccaaagcagacgcgtgcgcgtgcacagatgcacacacacagatgtcttaaaagactagaatccacacttcctgagccagaggggccgtgttgacggtaatgcattctctatagagccaagtccaaactggcaagctcaatgatgcaggcaataaaccgcctttttggcagcctaccaatgccaaaaggataaatgtctttccaaaagtgtgtattcctgttaaattaagctcttgctaacttgaaaaatccctgttctgccagcgaagcttcctcctcctctccagctggtagtcacttgcgtgaatgctggtcagtctgaaaaggtgaagctggctgtgcacttacccccatctttctccctcggggagacgacccaaggaatttcagagtattttgtttggcagagcttttacctgttattctttgccctcaaatacagtattgtggtcattttgatgatatgtgtgtaaaatgtgaataatccaattggtgtctgtactcagccttttgatgtctttttaggactttctcttctacacagcaatacgtcgtgctcgagtatccttgtagcaaagcacatagagccagctgtcctgtcagttcccctgtttgcctctgaaacgtctggttagtggggacccaaagattctagtgagtcaacatccataactctgtatctagttgtattattcatagaaaatcaatctggtgctaatggttggccctggtgttgttgggtggcagctgctccttcgccctcttgtagtgtggctgtggagggctctgcctatggggggtggcctgtggcttgtatccttcagtccaccacagcaaatgtgtgtagatttcatgctcgacacttaccactcacctatcaacagatcatcctgcttgactgtaacaaaataaatagtgtctcttcaagtgaatggaga

SEQ ID NO: 313182 - DNA, 6206 bp, Homo sapiens
  misc_feature (4148)..(4148): n is a, c, g, or t
  misc_feature (4167)..(4167): n is a, c, g, or t
  misc_feature (4172)..(4173): n is a, c, g, or t
  misc_feature (4192)..(4192): n is a, c, g, or t
  misc_feature (4210)..(4210): n is a, c, g, or t
  misc_feature (4226)..(4226): n is a, c, g, or t
  misc_feature (4273)..(4273): n is a, c, g, or t
  misc_feature (4276)..(4276): n is a, c, g, or t
  misc_feature (4279)..(4280): n is a, c, g, or t
  misc_feature (4290)..(4290): n is a, c, g, or t
  misc_feature (4293)..(4293): n is a, c, g, or t
  misc_feature (4301)..(4302): n is a, c, g, or t
  misc_feature (4327)..(4327): n is a, c, g, or t
  misc_feature (4358)..(4358): n is a, c, g, or t
  misc_feature (5333)..(5333): n is a, c, g, or t
  misc_feature (5957)..(5957): n is a, c, g, or t
  misc_feature (5960)..(5960): n is a, c, g, or t
  misc_feature (5974)..(5974): n is a, c, g, or t
  misc_feature (5982)..(5982): n is a, c, g, or t
  misc_feature (5997)..(5997): n is a, c, g, or t
  misc_feature (6000)..(6000): n is a, c, g, or t
  misc_feature (6011)..(6011): n is a, c, g, or t
  misc_feature (6023)..(6023): n is a, c, g, or t
  misc_feature (6028)..(6029): n is a, c, g, or t
  misc_feature (6042)..(6042): n is a, c, g, or t
  misc_feature (6045)..(6046): n is a, c, g, or t
  misc_feature (6086)..(6086): n is a, c, g, or t
  misc_feature (6122)..(6122): n is a, c, g, or t
  misc_feature (6127)..(6128): n is a, c, g, or t
  misc_feature (6139)..(6139): n is a, c, g, or t
  misc_feature (6148)..(6148): n is a, c, g, or t
  misc_feature (6159)..(6159): n is a, c, g, or t
  misc_feature (6162)..(6162): n is a, c, g, or t
  misc_feature (6170)..(6170): n is a, c, g, or t
  misc_feature (6177)..(6177): n is a, c, g, or t
ccccgttcccgattcctgtagtagcggctgtattgcagccgcctgccgaactgacccgggtctggggactggcccctctggcgccgttcggtttctcttattgccttcactgaggatgagtccctttgtggctctatgtggaccctgcggaatccaccggcgcagtttcatctagcgactggtcacccttgcaattatggatatttaaaagggtcagacagtgtggagggggagttcccctcctcactcccccttggtgcttgactccaggaataatttataaactgtggaatttttttaaatgaagaacttgtatttgatatgaactttatagagctatttataatttttttgatttaagtgccaaaaaattgtataaagatatatagttttatactattgtcaggaggatttaaattatcctaaaaaggtaatttattctctgtaacttcctcaatagcacctttgtgtcctggctttttcattttttaaaattagttttcacgattctgaagtaagtggtataaaaacagttaggatgagttcacccatgcctgactgcacatcaaagtgtcgatccctgaagcatgctttggatgtcctttctgtggtaacaaaggggagcgaaaaccagattaaggcctttctctccagtcattgttacaatgctgcaactatcaaggatgtttttggcaggaatgccctccaccttgtttcctcctgtggaaagaaaggagtgttagattggcttattcagaaaggagtggatctgttggtgaaagacaaagagtctggatggacagcattgcacagaagcattttttatggacatattgattgtgtttggtctctattgaagcatggtgttagtctgtatattcaagataaagaaggcttgtcagctttggatcttgtaatgaaggatagaccaactcatgtagtattcaagaatactgatcctacagatgtttatacttggggcgataatacaaattttaccctgggtcatggaagccagaatagcaaacatcatccagagttggtggatctgttctccaggagtgggatttatatcaagcaggtggtgctttgtaaatttcactccgtgtttctgtctcagaaagggcaggtttatacctgtggtcatggtcctggagggcgattaggacatggagatgaacagacatgcttggtccctcggcttgtggaaggactgaatggtcataattgttcccaagtggcagctgctaaggatcatactgttgtattaactgaagatggatgtgtttatacatttggtctaaacatttttcatcaattaggaattattccaccgccttccagttgtaatgtacccagacagatacaggcaaaatatctgaaaggaaggacaatcattggcgttgcagcaggcaggtttcatacagtcctatggactagagaagctgtttacactatgggactaaatggtggacaactgggttgtttgctagatcccaatggagaaaagtgtgtaactgctcctcgtcaggtctctgcccttcaccataaagacattgctctgtctttggttgctgcaagtgatggagctacagtctgtgttaccacaaggggagatatttacttacttgcagactatcagtgcaagaagatggcttctaaacagttgaacttgaaaaaagttcttgtgtctgggggtcatatggaatacaaggttgatcctgaacatttgaaagaaaatgggggtcaaaaaatttgcattcttgcaatggatggagctggaagggtgttttgctggagatcagtcaacagttctctgaagcagtgtcgatgggcctatccacgtcaggtcttcatttctgatattgctttaaatagaaatgaaattctatttgttacgcaagatggagaaggatttagagggagatggtttgaagagaaaagaaagagttctgaaaagaaagagattttatcaaaccttcacaattcctcatcagatgtgtcttatgtctctgatataaatagtgtgtatgaaagaattcgacttgagaaacttacctttgcacatagagctgttagtgtcagcacagatccaagtggatgcaactttgcaatcctgcagtcagatcctaaaacaagcctttatgaaattccagctgtgtcctcatcatccttttttgaagagtttggcaaactgttgagggaagcagatgaaatggacagcattcatgatgtgacatttcaagttggcaatagactcttccctgcacataaatatattttggcagtgcattctgatttttttcagaaattgtttctttcagatggtaatacttcagaatttacagatatttaccagaaagatgaagattctgcagggtgccatctctttgtggtagagaaggttcatcctgacatgtttgaataccttttacaatttatatacacagatacttgtgactttttaactcatggcttcaaaccaagaatacacttaaacaaaaacccagaagaatatcagggaactctgaattctcatttgaataaagtgaatttccatgaagatgataaccagaagtctgcatttgaagtttacaaaagtaatcaagctcaaacagttagtgagaggcagaagagcaaacctaaatcttgtaaaaaaggaaaaaatattagggaagatgatcctgtaagaatgttgcaaactgttgcaaagaaattcgacttcagtaatttgagtagtaggttagatggagtcagatttgaaaatgaaaaaattaatgttattgccaagaacactggtaataaactgaagctaagtcagaaaaaatgttcatttctgtgtgacgtgaccatgaaatcagtggatggaaaggaatttccttgtcataaatgtgttctttgtgctagacttgaatattttcatagtatgctgagtagctcatggattgaggcttccagttgtgcagctctggaaatgccaatacattctgatatattaaaagttattttggactacctctatactgatgaagctgtggtgataaaagaatctcaaaatgtagattttatttgtagtgttcttgtggtggctgatcaacttctcataacccggttgaaagagatttgtgaagtagcattaactgaaaaacttaccctgaagaatgctgctatgctactggaatttgcagcaatgtatagtgcaaaacagttgaaactgtcttgtttacagtttataggattgaatatggcagctttacttgaagcaaggtctcttgatgttttaagcgatggtgttttgaaggatctttctgagttttaccggaaaatgattccagcaatggatagaagagtcattacaccatatcaagatggaccagatattagctatttggaagtagaagatggagatatcttcttgaaagaagaaataaatatggaacaaaatcattcggaaactatgttcaagaaagcaaaaacaaaagctaaaaagaagccacgtaaacgttcagatagttctggaggttataacctttcagatattattcagagtccatcatctacaggattattaaagtctggtaagaccaattctgtggaatctcttccagaactgttgacatcagactctgaaggaagctatgcaggagtgggtagtcctagagatttacagtcccctgatttcacaacaggatttcattcagataagattgaggcgaaagtcaaaccgtatgttaatggtacatctcctgtgtattctagggaagatttaaaaccatgggaaaagtcaccaatacttaaaatatctgctccacagcctattcccagtaacagaattgatactaccagctctgccagttgggttgctggttctttcagtcctgtcagccctcctgttgtggatctcagaactatcatggaaatagaagaaagtagacaaaaatgtggagctacaccaaagtcacatttaggcaaaacagtttctcatggagttaaactttctcagaagcaacgaaaaatgattgcattgactaccaaggaaaacaattcaggaatgaatagcatggaaacagttttattcactccttcaaaagcccccaaaccagtgaatgcatgatggagtctcaccctgttgttcaggtttgagtgcngtggtgcgatcttggttcnctgcnncctccgcctcctaggttcnagcgattcttctgtctcngcctcctgaatagctnggattacagatgcctaccaccacacccggctaatttttgtatttttngtnganncatggtttcnccntgttggcnnggctggtctcgaactcctgacctcnagtgatctgcctgcctcagcctcccaaagtnctggaattacaggtgtgagccactacactttttcttttctattgtccacatatatgccttttaattctactttctggaacatttgcctgactttttccaatcattaaaatctttatcaagagctttttttggtttgtttgttgatgatacctttttctatagtattgttttaatattctaatgttgaagatctctgtactctgtaggcattttcactctttagtatatacccaacagaaacacacacgtatgtaccacgcaacaagtataagaatgttcataatttattatctgtaatagcccaaactgaaaacaatctagatgtctatcagcagtcagtggataaattaatttatttttatagtagaatactacagagtaatgaaaaagaataaatcatgactaaatacaacagtgtggatgaatcttaccaatatgatattgaacaaaataaaccaatcaaccaaaaaaaagaaagctaaaaatagccattgatttacatccatgttttattcattctactctatatgtgttttattttatttcattttgtcaatttattgattgattgttttctcttaagttctgactggaagctctgtgtgcctatgttgtacaaatagactgataggtgtgactatagggtaacgtatcagattccttagggacccctgaatctccccatatgttggttatctccatatcttttctccttggtctctttagtctgtcagtttttctaaagagcagccttttaatttttttttgctgttaaggtgtacattttgttgctagcattctggaagcgtatctcagtgtagggaggttagagctgggactgaacttgtcaccatttgtaataggttttcacatttagtgtatagactttgtacacaacagttcactcccgccatcctctattactagtgactttgaatcaaattttccttctgccagagtaaaggagatgtagtnatatgaccatatggagatagggagtacatctggcactttcagcccctccttaaataaactgaaacaattttcatgctcatgtcgacttcaggatttgatacatactctgtctccagtatatgcccctttccagagttctcagcttccctctttactgtcacccacctgatgactgctagtatttctttttgtccactcggcgacatcagtttttatcattccatctcttttgctatccttcaaaaatgtgttgctgtttttagactgccattgtcttaatagcttattatttttgcccttgtgggtttatacctttctgattactttgctgtacactttaggatttcagaggaaggtattcaagtggtcatttatctgaaacttctgactaattttcaaacataggaaaaatttttccttggtaatagcaacatgagcttagagtgccacattgaagggactatctatccaaattttaagagtctattatggcatattaaggagaattctagaaagatgggaagaaagatgccataaattttgaccaaaaacataggttatttttctttgaaaagaatttgataattatctggctgggcatgatggctcatgcctgtaattcangcnctttgggaggccanggcaggcngatcacctgaggtcnggngtttgagaccngcctggccaacntggannaaccccgtctctnctnnaaatacaaaaattagctgagcatggtgttgcatgcctgtnatcccagctacttgggaggctgaggcaggagaatcncttgnncctgggaggcngaggttgcngtgagttgagntcntgccaccncactccngcctgggcaacagagcaaaaatccttctc

SEQ ID NO: 313183 - DNA, 5787 bp, Homo sapiens
ccccgttcccgattcctgtagtagcggctgtattgcagccgcctgccgaactgacccgggtctggggactggcccctctggcgccgttcggtttctcttattgccttcactgaggatgagtccctttgtggctctatgtggaccctgcggaatccaccggcgcagtttcatctagcgactggtcacccttgcaattatggatatttaaaagggtcagacagtgtggagggggagttcccctcctcactcccccttggtgcttgactccaggaataatttataaactgtggaatttttttaaatgaagaacttgtatttgatatgaactttatagagctatttataatttttttgatttaagtgccaaaaaattgtataaagatatatagttttatactattgtcaggaggatttaaattatcctaaaaaggtaatttattctctgtaacttcctcaatagcacctttgtgtcctggctttttcattttttaaaattagttttcacgattctgaagtaagtggtataaaaacagttaggatgagttcacccatgcctgactgcacatcaaagtgtcgatccctgaagcatgctttggatgtcctttctgtggtaacaaaggggagcgaaaaccagattaaggcctttctctccagtcattgttacaatgctgcaactatcaaggatgtttttggcaggaatgccctccaccttgtttcctcctgtggaaagaaaggagtgttagattggcttattcagaaaggagtggatctgttggtgaaagacaaagagtctggatggacagcattgcacagaagcattttttatggacatattgattgtgtttggtctctattgaagcatggtgttagtctgtatattcaagataaagaaggcttgtcagctttggatcttgtaatgaaggatagaccaactcatgtagtattcaagaatactgatcctacagatgtttatacttggggcgataatacaaattttaccctgggtcatggaagccagaatagcaaacatcatccagagttggtggatctgttctccaggagtgggatttatatcaagcaggtggtgctttgtaaatttcactccgtgtttctgtctcagaaagggcaggtttatacctgtggtcatggtcctggagggcgattaggacatggagatgaacagacatgcttggtccctcggcttgtggaaggactgaatggtcataattgttcccaagtggcagctgctaaggatcatactgttgtattaactgaagatggatgtgtttatacatttggtctaaacatttttcatcaattaggaattattccaccgccttccagttgtaatgtacccagacagatacaggcaaaatatctgaaaggaaggacaatcattggcgttgcagcaggcaggtttcatacagtcctatggactagagaagctgtttacactatgggactaaatggtggacaactgggttgtttgctagatcccaatggagaaaagtgtgtaactgctcctcgtcaggtctctgcccttcaccataaagacattgctctgtctttggttgctgcaagtgatggagctacagtctgtgttaccacaaggggagatatttacttacttgcagactatcagtgcaagaagatggcttctaaacagttgaacttgaaaaaagttcttgtgtctgggggtcatatggaatacaaggttgatcctgaacatttgaaagaaaatgggggtcaaaaaatttgcattcttgcaatggatggagctggaagggtgttttgctggagatcagtcaacagttctctgaagcagtgtcgatgggcctatccacgtcaggtcttcatttctgatattgctttaaatagaaatgaaattctatttgttacgcaagatggagaaggatttagagggagatggtttgaagagaaaagaaagagttctgaaaagaaagagattttatcaaaccttcacaattcctcatcagatgtgtcttatgtctctgatataaatagtgtgtatgaaagaattcgacttgagaaacttacctttgcacatagagctgttagtgtcagcacagatccaagtggatgcaactttgcaatcctgcagtcagatcctaaaacaagcctttatgaaattccagctgtgtcctcatcatccttttttgaagagtttggcaaactgttgagggaagcagatgaaatggacagcattcatgatgtgacatttcaagttggcaatagactcttccctgcacataaatatattttggcagtgcattctgatttttttcagaaattgtttctttcagatggtaatacttcagaatttacagatatttaccagaaagatgaagattctgcagggtgccatctctttgtggtagagaaggttcatcctgacatgtttgaataccttttacaatttatatacacagatacttgtgactttttaactcatggcttcaaaccaagaatacacttaaacaaaaacccagaagaatatcagggaactctgaattctcatttgaataaagtgaatttccatgaagatgataaccagaagtctgcatttgaagtttacaaaagtaatcaagctcaaacagttagtgagaggcagaagagcaaacctaaatcttgtaaaaaaggaaaaaatattagggaagatgatcctgtaagaatgttgcaaactgttgcaaagaaattcgacttcagtaatttgagtagtaggttagatggagtcagatttgaaaatgaaaaaattaatgttattgccaagaacactggtaataaactgaagctaagtcagaaaaaatgttcatttctgtgtgacgtgaccatgaaatcagtggatggaaaggaatttccttgtcataaatgtgttctttgtgctagacttgaatattttcatagtatgctgagtagctcatggattgaggcttccagttgtgcagctctggaaatgccaatacattctgatatattaaaagttattttggactacctctatactgatgaagctgtggtgataaaagaatctcaaaatgtagattttatttgtagtgttcttgtggtggctgatcaacttctcataacccggttgaaagagatttgtgaagtagcattaactgaaaaacttaccctgaagaatgctgctatgctactggaatttgcagcaatgtatagtgcaaaacagttgaaactgtcttgtttacagtttataggattgaatatggcagctttacttgaagcaaggtctcttgatgttttaagcgatggtgttttgaaggatctttctgagttttaccggaaaatgattccagcaatggatagaagagtcattacaccatatcaagatggaccagatattagctatttggaagtagaagatggagatatcttcttgaaagaagaaataaatatggaacaaaatcattcggaaactatgttcaagaaagcaaaaacaaaagctaaaaagaagccacgtaaacgttcagatagttctggaggttataacctttcagatattattcagagtccatcatctacaggattattaaagtctggtaagaccaattctgtggaatctcttccagaactgttgacatcagactctgaaggaagctatgcaggagtgggtagtcctagagatttacagtcccctgatttcacaacaggatttcattcagataagattgaggcgaaagtcaaaccgtatgttaatggtacatctcctgtgtattctagggaagatttaaaaccatgggaaaagtcaccaatacttaaaatatctgctccacagcctattcccagtaacagaattgatactaccagctctgccagttgggttgctggttctttcagtcctgtcagccctcctgttgtggatctcagaactatcatggaaatagaagaaagtagacaaaaatgtggagctacaccaaagtcacatttaggcaaaacagtttctcatggagttaaactttctcagaagcaacgaaaaatgattgcattgactaccaaggaaaacaattcaggaatgaatagcatggaaacagttttattcactccttcaaaagcccccaaaccagtgaatgcatgggcatcttctctgcattcagtttcatccaagtcattccgggatttcttactagaagaaaaaaagtctgttactagccatagttcaggcgatcatgtcaaaaaagtttcttttaaaggaattgaaaattctcaggcaccaaaaattgtcagatgctctacccatggtaccccaggaccagaaggcaaccatatttcagatttaccacttctagacagtcccaatccctggctatcttcttcagtgactgctccatccatggtagccccagtcacttttgcatctattgtagaagaagaactacaacaagaagcagctcttattagaagtcgagaaaaaccgttggctctgattcagattgaggagcatgccatacaagatttattggttttctatgaggcatttggcaaccctgaagagtttgtcattgttgaaaggacaccgcagggaccactggcagtacctatgtggaataagcatggatgctagttcactgtggagttgagatgcattttacataattatgagtttgttcatataaagaaaagctgtggaaaagagtcttagagattttgtaatatcattctaaatagattaagaaaagatataatttctttactgcagttaaatcatataatgtttgtatgattaaaaataaatttctcagaattgtgattttagtaactttatataaaatgtgtgagacaaaaacttattaaggttaaatagaattgtttcttctgaataatctaacaaaggaaaatataagtgattgaatcataagatataaggggggtaaagtattaaaaataacttttttgtttgataacttgagaatttagaagattttgccaagtatgtgttgttgcttgacttcttaaatatggcattgatgaatttaaagtaggagcatcagttattacttctgattcattaatggccagaattttgtgtttggtgtaatagttgtgtcaccattcttgttgctttttaaaaatcaggctaatcatgtggtccatgtctcttcaaagcttgacctgcacaaatgccatatttctatttggaccacatattctccattttgcattgagcagtagagtacagtggaaagggaataagaatactgattattctgaacagtttagtcccaagagaatagcgttttaaaaaagaaaaacaagatttggagtcattgtgggttatttttggtgggatggaggatcttaaaaatgcctaattgtgagagaatcaattgctgaaagtgttaaaatttctgaaaataaatgcttaattacatatacaggaattaaatagtttggaagagggttggattatcattacctttacaatactgtataatcagaagttctctgaacctcaattgtatatctagacataaaaattgttttctgtataggatgttgtttggtttgtttctgagtgtttaaattttgcaaaaacaaatgttaaatttgtgcttcagtacctagataaattggaaaggttaatgttctagtttctggaaggtaagcctgggagacacataagcaattcactgctataatttagttgatgtaaaatgacggaaactgactcaatatgtcaggtttaactctgcccaaaagcagcagacatgtaagcagatgtgcaataaaaaatgatcttgatccatttca

SEQ ID NO: 313184 - DNA, 6292 bp, Homo sapiens
ccccgttcccgattcctgtagtagcggctgtattgcagccgcctgccgaactgacccgggtctggggactggcccctctggcgccgttcggtttctcttattgccttcactgaggatgagtccctttgtggctctatgtggaccctgcggaatccaccggcgcagtttcatctagcgactggtcacccttgcaattatggatatttaaaagggtcagacagtgtggagggggagttcccctcctcactcccccttggtgcttgactccaggaataatttataaactgtggaatttttttaaatgaagaacttgtatttgatatgaactttatagagctatttataatttttttgatttaagtgccaaaaaattgtataaagatatatagttttatactattgtcaggaggatttaaattatcctaaaaaggtaatttattctctgtaacttcctcaatagcacctttgtgtcctggctttttcattttttaaaattagttttcacgattctgaagtaagtggtataaaaacagttaggatgagttcacccatgcctgactgcacatcaaagtgtcgatccctgaagcatgctttggatgtcctttctgtggtaacaaaggggagcgaaaaccagattaaggcctttctctccagtcattgttacaatgctgcaactatcaaggatgtttttggcaggaatgccctccaccttgtttcctcctgtggaaagaaaggagtgttagattggcttattcagaaaggagtggatctgttggtgaaagacaaagagtctggatggacagcattgcacagaagcattttttatggacatattgattgtgtttggtctctattgaagcatggtgttagtctgtatattcaagataaagaaggcttgtcagctttggatcttgtaatgaaggatagaccaactcatgtagtattcaagaatactgatcctacagatgtttatacttggggcgataatacaaattttaccctgggtcatggaagccagaatagcaaacatcatccagagttggtggatctgttctccaggagtgggatttatatcaagcaggtggtgctttgtaaatttcactccgtgtttctgtctcagaaagggcaggtttatacctgtggtcatggtcctggagggcgattaggacatggagatgaacagacatgcttggtccctcggcttgtggaaggactgaatggtcataattgttcccaagtggcagctgctaaggatcatactgttgtattaactgaagatggatgtgtttatacatttggtctaaacatttttcatcaattaggaattattccaccgccttccagttgtaatgtacccagacagatacaggcaaaatatctgaaaggaaggacaatcattggcgttgcagcaggcaggtttcatacagtcctatggactagagaagctgtttacactatgggactaaatggtggacaactgggttgtttgctagatcccaatggagaaaagtgtgtaactgctcctcgtcaggtctctgcccttcaccataaagacattgctctgtctttggttgctgcaagtgatggagctacagtctgtgttaccacaaggggagatatttacttacttgcagactatcagtgcaagaagatggcttctaaacagttgaacttgaaaaaagttcttgtgtctgggggtcatatggaatacaaggttgatcctgaacatttgaaagaaaatgggggtcaaaaaatttgcattcttgcaatggatggagctggaagggtgttttgctggagatcagtcaacagttctctgaagcagtgtcgatgggcctatccacgtcaggtcttcatttctgatattgctttaaatagaaatgaaattctatttgttacgcaagatggagaaggatttagagggagatggtttgaagagaaaagaaagagttctgaaaagaaagagattttatcaaaccttcacaattcctcatcagatgtgtcttatgtctctgatataaatagtgtgtatgaaagaattcgacttgagaaacttacctttgcacatagagctgttagtgtcagcacagatccaagtggatgcaactttgcaatcctgcagtcagatcctaaaacaagcctttatgaaattccagctgtgtcctcatcatccttttttgaagagtttggcaaactgttgagggaagcagatgaaatggacagcattcatgatgtgacatttcaagttggcaatagactcttccctgcacataaatatattttggcagtgcattctgatttttttcagaaattgtttctttcagatggtaatacttcagaatttacagatatttaccagaaagatgaagattctgcagggtgccatctctttgtggtagagaaggttcatcctgacatgtttgaataccttttacaatttatatacacagatacttgtgactttttaactcatggcttcaaaccaagaatacacttaaacaaaaacccagaagaatatcagggaactctgaattctcatttgaataaagtgaatttccatgaagatgataaccagaagtctgcatttgaagtttacaaaagtaatcaagctcaaacagttagtgagaggcagaagagcaaacctaaatcttgtaaaaaaggaaaaaatattagggaagatgatcctgtaagaatgttgcaaactgttgcaaagaaattcgacttcagtaatttgagtagtaggttagatggagtcagatttgaaaatgaaaaaattaatgttattgccaagaacactggtaataaactgaagctaagtcagaaaaaatgttcatttctgtgtgacgtgaccatgaaatcagtggatggaaaggaatttccttgtcataaatgtgttctttgtgctagacttgaatattttcatagtatgctgagtagctcatggattgaggcttccagttgtgcagctctggaaatgccaatacattctgatatattaaaagttattttggactacctctatactgatgaagctgtggtgataaaagaatctcaaaatgtagattttatttgtagtgttcttgtggtggctgatcaacttctcataacccggttgaaagagatttgtgaagtagcattaactgaaaaacttaccctgaagaatgctgctatgctactggaatttgcagcaatgtatagtgcaaaacagttgaaactgtcttgtttacagtttataggattgaatatggcagctttacttgaagcaaggtctcttgatgttttaagcgatggtgttttgaaggatctttctgagttttaccggaaaatgattccagcaatggatagaagagtcattacaccatatcaagatggaccagatattagctatttggaagtagaagatggagatatcttcttgaaagaagaaataaatatggaacaaaatcattcggaaactatgttcaagaaagcaaaaacaaaagctaaaaagaagccacgtaaacgttcagatagttctggaggttataacctttcagatattattcagagtccatcatctacaggattattaaagtctggtaagaccaattctgtggaatctcttccagaactgttgacatcagactctgaaggaagctatgcaggagtgggtagtcctagagatttacagtcccctgatttcacaacaggatttcattcagataagattgaggcgaaagtcaaaccgtatgttaatggtacatctcctgtgtattctagggaagatttaaaaccatgggaaaagtcaccaatacttaaaatatctgctccacagcctattcccagtaacagaattgatactaccagctctgccagttgggttgctggttctttcagtcctgtcagccctcctgttgtggatctcagaactatcatggaaatagaagaaagtagacaaaaatgtggagctacaccaaagtcacatttaggcaaaacagtttctcatggagttaaactttctcagaagcaacgaaaaatgattgcattgactaccaaggaaaacaattcaggaatgaatagcatggaaacagttttattcactccttcaaaagcccccaaaccagtgaatgcatgggcatcttctctgcattcagtttcatccaagtcattccgggatttcttactagaagaaaaaaagtctgttactagccatagttcaggcgatcatgtcaaaaaagtttcttttaaaggaattgaaaattctcaggcaccaaaaattgtcagttttgtaggaggagagagaaggtgacatttgagccaactgtaaaagagtgagaagacatttgaagtggaatatattccagaataaggggaatagtaaaaataaagatgctctacccatggtaccccaggaccagaaggcaaccatatttcagatttaccacttctagacagtcccaatccctggctatcttcttcagtgactgctccatccatggtagccccagtcacttttgcatctattgtagaagaagaactacaacaagaagcagctcttattagaagtcgagaaaaaccgttggctctgattcagattgaggagcatgccatacaagatttattggttttctatgaggcatttggcaaccctgaagagtttgtcattgttgaaaggacaccgcagggaccactggcagtacctatgtggaataagcatggatgctagttcactgtggagttgagatgcattttacataattatgagtttgttcatataaagaaaagctgtggaaaagagtcttagagattttgtaatatcattctaaatagattaagaaaagatataatttctttactgcagttaaatcatataatgtttgtatgattaaaaataaatttctcagaattgtgattttagtaactttatataaaatgtgtgagacaaaaacttattaaggttaaatagaattgtttcttctgaataatctaacaaaggaaaatataagtgattgaatcataagatataaggggggtaaagtattaaaaataacttttttgtttgataacttgagaatttagaagattttgccaagtatgtgttgttgcttgacttcttaaatatggcattgatgaatttaaagtaggagcatcagttattacttctgattcattaatggccagaattttgtgtttggtgtaatagttgtgtcaccattcttgttgctttttaaaaatcaggctaatcatgtggtccatgtctcttcaaagcttgacctgcacaaatgccatatttctatttggaccacatattctccattttgcattgagcagtagagtacagtggaaagggaataagaatactgattattctgaacagtttagtcccaagagaatagcgttttaaaaaagaaaaacaagatttggagtcattgtgggttatttttggtgggatggaggatcttaaaaatgcctaattgtgagagaatcaattgctgaaagtgttaaaatttctgaaaataaatgcttaattacatatacaggaattaaatagtttggaagagggttggattatcattacctttacaatactgtataatcagaagttctctgaacctcaattgtatatctagacataaaaattgttttctgtataggatgttgtttggtttgtttctgagtgtttaaattttgcaaaaacaaatgttaaatttgtgcttcagtacctagataaattggaaaggttaatgttctagtttctggaaggtaagcctgggagacacataagcaattcactgctataatttagttgatgtaaaatgacggaaactgactcaatatgtcaggtttaactctgcccaaaagcagcagacatgtaagcagatgtgcaataaaaaatgatcttgatccatttcaaaaaaaaacaagcaaagaaaacaataaaaaaaaaaaagacaaaaaaaaagaagcaaacaaaagaacagaaacaagaacaaaaagggggggggggagcaaaaaaaatcccacccaggggggacacaatgaagggtcacacaatttttagaaaaagagggccccaatagagaggcgtaaataaaagagaagaggggcgcgtaaaaaacgagcaaaggggaaaacatgacacagaaggaaactctagaagaagaacccacactaagcggggggagagcaacaagtggagaacaaaccgacagaaaacgttacacccgaggagagaaatatacaaaggacggaatataaggatgacaacacaagacaattatgcgcgaaaaaaaagcgcaccagagatattgaa

SEQ ID NO: 313185 - DNA, 6037 bp, Homo sapiens
ccccgttcccgattcctgtagtagcggctgtattgcagccgcctgccgaactgacccgggtctggggactggcccctctggcgccgttcggtttctcttattgccttcactgaggatgagtccctttgtggctctatgtggaccctgcggaatccaccggcgcagtttcatctagcgactggtcacccttgcaattatggatatttaaaagggtcagacagtgtggagggggagttcccctcctcactcccccttggtgcttgactccaggaataatttataaactgtggaatttttttaaatgaagaacttgtatttgatatgaactttatagagctatttataatttttttgatttaagtgccaaaaaattgtataaagatatatagttttatactattgtcaggaggatttaaattatcctaaaaaggtaatttattctctgtaacttcctcaatagcacctttgtgtcctggctttttcattttttaaaattagttttcacgattctgaagtaagtggtataaaaacagttaggatgagttcacccatgcctgactgcacatcaaagtgtcgatccctgaagcatgctttggatgtcctttctgtggtaacaaaggggagcgaaaaccagattaaggcctttctctccagtcattgttacaatgctgcaactatcaaggatgtttttggcaggaatgccctccaccttgtttcctcctgtggaaagaaaggagtgttagattggcttattcagaaaggagtggatctgttggtgaaagacaaagagtctggatggacagcattgcacagaagcattttttatggacatattgattgtgtttggtctctattgaagcatggtgttagtctgtatattcaagataaagaaggcttgtcagctttggatcttgtaatgaaggatagaccaactcatgtagtattcaagaatactgatcctacagatgtttatacttggggcgataatacaaattttaccctgggtcatggaagccagaatagcaaacatcatccagagttggtggatctgttctccaggagtgggatttatatcaagcaggtggtgctttgtaaatttcactccgtgtttctgtctcagaaagggcaggtttatacctgtggtcatggtcctggagggcgattaggacatggagatgaacagacatgcttggtccctcggcttgtggaaggactgaatggtcataattgttcccaagtggcagctgctaaggatcatactgttgtattaactgaagatggatgtgtttatacatttggtctaaacatttttcatcaattaggaattattccaccgccttccagttgtaatgtacccagacagatacaggcaaaatatctgaaaggaaggacaatcattggcgttgcagcaggcaggtttcatacagtcctatggactagagaagctgtttacactatgggactaaatggtggacaactgggttgtttgctagatcccaatggagaaaagtgtgtaactgctcctcgtcaggtctctgcccttcaccataaagacattgctctgtctttggttgctgcaagtgatggagctacagtctgtgttaccacaaggggagatatttacttacttgcagactatcagtgcaagaagatggcttctaaacagttgaacttgaaaaaagttcttgtgtctgggggtcatatggaatacaaggttgatcctgaacatttgaaagaaaatgggggtcaaaaaatttgcattcttgcaatggatggagctggaagggtgttttgctggagatcagtcaacagttctctgaagcagtgtcgatgggcctatccacgtcaggtcttcatttctgatattgctttaaatagaaatgaaattctatttgttacgcaagatggagaaggatttagagggagatggtttgaagagaaaagaaagagttctgaaaagaaagagattttatcaaaccttcacaattcctcatcagatgtgtcttatgtctctgatataaatagtgtgtatgaaagaattcgacttgagaaacttacctttgcacatagagctgttagtgtcagcacagatccaagtggatgcaactttgcaatcctgcagtcagatcctaaaacaagcctttatgaaattccagctgtgtcctcatcatccttttttgaagagtttggcaaactgttgagggaagcagatgaaatggacagcattcatgatgtgacatttcaagttggcaatagactcttccctgcacataaatatattttggcagtgcattctgatttttttcagaaattgtttctttcagatggtaatacttcagaatttacagatatttaccagaaagatgaagattctgcagggtgccatctctttgtggtagagaaggttcatcctgacatgtttgaataccttttacaatttatatacacagatacttgtgactttttaactcatggcttcaaaccaagaatacacttaaacaaaaacccagaagaatatcagggaactctgaattctcatttgaataaagtgaatttccatgaagatgataaccagaagtctgcatttgaagtttacaaaagtaatcaagctcaaacagttagtgagaggcagaagagcaaacctaaatcttgtaaaaaaggaaaaaatattagggaagatgatcctgtaagaatgttgcaaactgttgcaaagaaattcgacttcagtaatttgagtagtaggttagatggagtcagatttgaaaatgaaaaaattaatgttattgccaagaacactggtaataaactgaagctaagtcagaaaaaatgttcatttctgtgtgacgtgaccatgaaatcagtggatggaaaggaatttccttgtcataaatgtgttctttgtgctagacttgaatattttcatagtatgctgagtagctcatggattgaggcttccagttgtgcagctctggaaatgccaatacattctgatatattaaaagttattttggactacctctatactgatgaagctgtggtgataaaagaatctcaaaatgtagattttatttgtagtgttcttgtggtggctgatcaacttctcataacccggttgaaagagatttgtgaagtagcattaactgaaaaacttaccctgaagaatgctgctatgctactggaatttgcagcaatgtatagtgcaaaacagttgaaactgtcttgtttacagtttataggattgaatatggcagctttacttgaagcaaggtctcttgatgttttaagcgatggtgttttgaaggatctttctgagttttaccggaaaatgattccagcaatggatagaagagtcattacaccatatcaagatggaccagatattagctatttggaagtagaagatggagatatcttcttgaaagaagaaataaatatggaacaaaatcattcggaaactatgttcaagaaagcaaaaacaaaagctaaaaagaagccacgtaaacgttcagatagttctggaggttataacctttcagatattattcagagtccatcatctacaggattattaaagtctggtaagaccaattctgtggaatctcttccagaactgttgacatcagactctgaaggaagctatgcaggagtgggtagtcctagagatttacagtcccctgatttcacaacaggatttcattcagataagattgaggcgaaagtcaaaccgtatgttaatggtacatctcctgtgtattctagggaagatttaaaaccatgggaaaagtcaccaatacttaaaatatctgctccacagcctattcccagtaacagaattgatactaccagctctgccagttgggttgctggttctttcagtcctgtcagccctcctgttgtggatctcagaactatcatggaaatagaagaaagtagacaaaaatgtggagctacaccaaagtcacatttaggcaaaacagtttctcatggagttaaactttctcagaagcaacgaaaaatgattgcattgactaccaaggaaaacaattcaggaatgaatagcatggaaacagttttattcactccttcaaaagcccccaaaccagtgaatgcatgggcatcttctctgcattcagtttcatccaagtcattccgggatttcttactagaagaaaaaaagtctgttactagccatagttcaggcgatcatgtcaaaaaagtttcttttaaaggaattgaaaattctcaggcaccaaaaattgtcagatgctctacccatggtaccccaggaccagaaggcaaccatatttcagatttaccacttctagacagtcccaatccctggctatcttcttcagtgactgctccatccatggtagccccagtcacttttgcatctattgtagaagaagaactacaacaagaagcagctcttattagaagtcgagaaaaaccgttggctctgattcagattgaggagcatgccatacaagatttattggttttctatgaggcatttggcaaccctgaagagtttgtcattgttgaaaggacaccgcagggaccactggcagtacctatgtggaataagcatggatgctagttcactgtggagttgagatgcattttacataattatgagtttgttcatataaagaaaagctgtggaaaagagtcttagagattttgtaatatcattctaaatagattaagaaaagatataatttctttactgcagttaaatcatataatgtttgtatgattaaaaataaatttctcagaattgtgattttagtaactttatataaaatgtgtgagacaaaaacttattaaggttaaatagaattgtttcttctgaataatctaacaaaggaaaatataagtgattgaatcataagatataaggggggtaaagtattaaaaataacttttttgtttgataacttgagaatttagaagattttgccaagtatgtgttgttgcttgacttcttaaatatggcattgatgaatttaaagtaggagcatcagttattacttctgattcattaatggccagaattttgtgtttggtgtaatagttgtgtcaccattcttgttgctttttaaaaatcaggctaatcatgtggtccatgtctcttcaaagcttgacctgcacaaatgccatatttctatttggaccacatattctccattttgcattgagcagtagagtacagtggaaagggaataagaatactgattattctgaacagtttagtcccaagagaatagcgttttaaaaaagaaaaacaagatttggagtcattgtgggttatttttggtgggatggaggatcttaaaaatgcctaattgtgagagaatcaattgctgaaagtgttaaaatttctgaaaataaatgcttaattacatatacaggaattaaatagtttggaagagggttggattatcattacctttacaatactgtataatcagaagttctctgaacctcaattgtatatctagacataaaaattgttttctgtataggatgttgtttggtttgtttctgagtgtttaaattttgcaaaaacaaatgttaaatttgtgcttcagtacctagataaattggaaaggttaatgttctagtttctggaaggtaagcctgggagacacataagcaattcactgctataatttagttgatgtaaaatgacggaaactgactcaatatgtcaggtttaactctgcccaaaagcagcagacatgtaagcagatgtgcaataaaaaatgatcttgatccatttcactaatgtgtgcttgacattttttactatattgacatttattatggaaagagttaataattattttttctgatgtgctacactagtggccagtatatggttaagttgatgctgtatttattctaagacggatttaaaaaggcagttttctaaatatgaacttgtgaatttttgtatgtgtgtttgagtaaattgagaaatgaattttataaatgttctattgatgttgcagtaaagaagccttttgaagta

SEQ ID NO: 313186 - DNA, 1747 bp, Homo sapiens
  misc_feature (2)..(2): n is a, c, g, or t
  misc_feature (20)..(20): n is a, c, g, or t
  misc_feature (25)..(25): n is a, c, g, or t
gnggatcccttgggctgtangaatncggattgaggagcatgccatacaagatttattggttttctatgaggcatttggcaaccctgaagagtttgtcattgttgaaaggacaccgcagggaccactggcagtacctatgtggaataagcatggatgctagttcactgtggagttgagatgcattttacataattatgagtttgttcatataaagaaaagctgtggaaaagagtcttagagattttgtaatatcattctaaatagattaagaaaagatataatttctttactgcagttaaatcatataatgtttgtatgattaaaaataaatttctcagaattgtgattttagtaactttatataaaatgtgtgagacaaaaacttattaaggttaaatagaattgtttcttctgaataatctaacaaaggaaaatataagtgattgaatcataagatataaggggggtaaagtattaaaaataacttttttgtttgataacttgagaatttagaagattttgccaagtatgtgttgttgcttgacttcttaaatatggcattgatgaatttaaagtaggagcatcagttattacttctgattcattaatggccagaattttgtgtttggtgtaatagttgtgtcaccattcttgttgctttttaaaaatcaggctaatcatgtggtccatgtctcttcaaagcttgacctgcacaaatgccatatttctatttggaccacatattctccattttgcattgagcagtagagtacagtggaaagggaataagaatactgattattctgaacagtttagtcccaagagaatagcgttttaaaaaagaaaaacaagatttggagtcattgtgggttatttttggtgggatggaggatcttaaaaatgcctaattgtgagagaatcaattgctgaaagtgttaaaatttctgaaaataaatgcttaattacatatacaggaattaaatagtttggaagagggttggattatcattacctttacaatactgtataatcagaagttctctgaacctcaattgtatatctagacataaaaattgttttctgtataggatgttgtttggtttgtttctgagtgtttaaattttgcaaaaacaaatgttaaatttgtgcttcagtacctagataaattggaaaggttaatgttctagtttctggaaggtaagcctgggagacacataagcaattcactgctataatttagttgatgtaaaatgacggaaactgactcaatatgtcaggtttaactctgcccaaaagcagcagacatgtaagcagatgtgcaataaaaaatgatcttgatccatttcaaaaaaaaacaagcaaagaaaacaataaaaaaaaaaaagacaaaaaaaaagaagcaaacaaaagaacagaaacaagaacaaaaagggggggggggagcaaaaaaaatcccacccaggggggacacaatgaagggtcacacaatttttagaaaaagagggccccaatagagaggcgtaaataaaagagaagaggggcgcgtaaaaaacgagcaaaggggaaaacatgacacagaaggaaactctagaagaagaacccacactaagcggggggagagcaacaagtggagaacaaaccgacagaaaacgttacacccgaggagagaaatatacaaaggacggaatataaggatgacaacacaagacaattatgcgcgaaaaaaaagcgcaccagagatattgaa

SEQ ID NO: 313187 - DNA, 1087 bp, Homo sapiens
gggaataatcagtattcttattccctttccactgtactctactgctcaatgcaaaatggagaatatgtggtccaaatagaaatatggcattgtgcaggtcaagcttgaagagacatggaaagggaataagaatactgattattctgaacagtttagtcccaagagaatagcgttttaaaaaagaaaaacaagatttggagtcattgtgggttatttttggtgggatggaggatcttaaaaatgcctaattgtgagagaatcaattgctgaaagtgttaaaatttctgaaaataaatgcttaattacatatacaggaattaaatagtttggaagagggttggattatcattacctttacaatactgtataatcagaagttctctgaacctcaattgtatatctagacataaaaattgttttctgtataggatgttgtttggtttgtttctgagtgtttaaattttgcaaaaacaaatgttaaatttgtgcttcagtacctagataaattggaaaggttaatgttctagtttctggaaggtaagcctgggagacacataagcaattcactgctataatttagttgatgtaaaatgacggaaactgactcaatatgtcaggtttaactctgcccaaaagcagcagacatgtaagcagatgtgcaataaaaaatgatcttgatccatttcaaaaaaaaacaagcaaagaaaacaataaaaaaaaaaaagacaaaaaaaaagaagcaaacaaaagaacagaaacaagaacaaaaagggggggggggagcaaaaaaaatcccacccaggggggacacaatgaagggtcacacaatttttagaaaaagagggccccaatagagaggcgtaaataaaagagaagaggggcgcgtaaaaaacgagcaaaggggaaaacatgacacagaaggaaactctagaagaagaacccacactaagcggggggagagcaacaagtggagaacaaaccgacagaaaacgttacacccgaggagagaaatatacaaaggacggaatataaggatgacaacacaagacaattatgcgcgaaaaaaaagcgcaccagagatattgaa

SEQ ID NO: 313188 - DNA, 1575 bp, Homo sapiens
ccccgttcccgattcctgtagtagcggctgtattgcagccgcctgccgaactgacccgggtctggggactggcccctctggcgccgttcggtttctcttattgccttcactgaggatgagtccctttgtggctctatgtggaccctgcggaatccaccggcgcagtttcatctagcgactggtcacccttgcaattatggatatttaaaagggtcagacagtgtggagggggagttcccctcctcactcccccttggtgcttgactccaggaataatttataaactgtggaatttttttaaatgaagaacttgtatttgatatgaactttatagagctatttataatttttttgatttaagtgccaaaaaattgtataaagatatatagttttatactattgtcaggaggatttaaattatcctaaaaaggtaatttattctctgtaacttcctcaatagcacctttgtgtcctggctttttcattttttaaaattagttttcacgattctgaagtaagtggtataaaaacagttaggatgagttcacccatgcctgactgcacatcaaagtgtcgatccctgaagcatgctttggatgtcctttctgtggtaacaaaggggagcgaaaaccagattaaggcctttctctccagtcattgttacaatgctgcaactatcaaggatgtttttggcaggaatgccctccaccttgtttcctcctgtggaaagaaaggagtgttagattggcttattcagaaaggagtggatctgttggtgaaagacaaagagtctggatggacagcattgcacagaagcattttttatggacatattgattgtgtttggtctctattgaagcatggtgttagtctgtatattcaagataaagaaggcttgtcagctttggatcttgtaatgaaggatagaccaactcatgtagtattcaagaatactgatcctacagatgtttatacttggggcgataatacaaattttaccctgggtcatggaagccagaatagcaaacatcatccagagttggtggatctgttctccaggagtgggatttatatcaagcaggtggtgctttgtaaatttcactccgtgtttctgtctcagaaagggcaggtttatacctgtggtcatggtcctggagggcgattaggacatggagatgaacagacatgcttggtccctcggcttgtggaaggactgaatggtcataattgttcccaagtggcagctgctaaggatcatactgttgtattaactgaagatggatgtgtttatacatttggtctaaacatttttcatcaattaggaattattccaccgccttccagttgtaatgtacccagacagatacaggcaaaatatctgaaaggaaggacaatcattggcgttgcagcaggcaggtttcatacagtcctatggactagagaagctgtttacactatgggactaaatggtggacaactgggttgttttgctgagaatccccagatggaagaaaaacatgttgtagctgcctcctcgtacaggtactctcgccccttccacccatcacaaggaca

SEQ ID NO: 313189 - DNA, 405 bp, Homo sapiens
ttttgctgtggtaatgtgccttttatctaattttgcaaatcttttctttctttgtagttaccctgaagaatgctgctatgctactggaatttgcagcaatgtatagtgcaaaacagttgaaactgtcttgtttacagtttataggattgaatatggcagctttacttgaagcaaggtaggtgaggtgcatatgttgtaagattgttgcaaaaggagatatttatatataatagcagatattattagtgatttaaatgtgaataatgatgtttacctggatggaaagaatttgatcaatgctgatgatttagaagttatgtacattttagaattagagagctcttgaaaacttttgaatgtttttaacagtgatctttttaaaatgaaataaatgtatactttttt

SEQ ID NO: 313190 - DNA, 2218 bp, Homo sapiens
  misc_feature (137)..(137): n is a, c, g, or t
  misc_feature (146)..(146): n is a, c, g, or t
  misc_feature (367)..(367): n is a, c, g, or t
cagacttactgcatctttcttattatttttctgcatttgatgttatagttaattatacatccttttctgggcaatttagcctccataatattatttcttaaatatgtgctaaagatagagttgagttgataatccanctcttgtanaatacagtattacatcccagaaacttgactctaaaatgatcattgtggactattggctacaaaagccaaagagttaaggcttgtgatgcaagttctttttgaaatttgtgatatgttggagggctcatatgtagctattacttgatcattgttagtataaactgatattttcattgttgaaacttgtgagcattttgatccaataatggtaaaataacatnaaataaatagaaaacattattattaccagtaacctttattaagcagaaattaatgttaattgatataatttctagaaaaatgattgcattgactaccaaggaaaacaattcaggaatgaatagcatggaaacagttttattcactccttcaaaagcccccaaaccagtgaatgcatgggcatcttctctgcattcagtttcatccaagtcattccgggatttcttactagaagaaaaaaagtctgttactagccatagttcaggcgatcatgtcaaaaaagtttcttttaaaggaattgaaaattctcaggcaccaaaaattgtcagatgctctacccatggtaccccaggaccagaaggcaaccatatttcagatttaccacttctagacagtcccaatccctggctatcttcttcagtgactgctccatccatggtagccccagtcacttttgcatctattgtagaagaagaactacaacaagaagcagctcttattagaagtcgagaaaaaccgttggctctgattcagattgaggagcatgccatacaagatttattggttttctatgaggcatttggcaaccctgaagagtttgtcattgttgaaaggacaccgcagggaccactggcagtacctatgtggaataagcatggatgctagttcactgtggagttgagatgcattttacataattatgagtttgttcatataaagaaaagctgtggaaaagagtcttagagattttgtaatatcattctaaatagattaagaaaagatataatttctttactgcagttaaatcatataatgtttgtatgattaaaaataaatttctcagaattgtgattttagtaactttatataaaatgtgtgagacaaaaacttattaaggttaaatagaattgtttcttctgaataatctaacaaaggaaaatataagtgattgaatcataagatataaggggggtaaagtattaaaaataacttttttgtttgataacttgagaatttagaagattttgccaagtatgtgttgttgcttgacttcttaaatatggcattgatgaatttaaagtaggagcatcagttattacttctgattcattaatggccagaattttgtgtttggtgtaatagttgtgtcaccattcttgttgctttttaaaaatcaggctaatcatgtggtccatgtctcttcaaagcttgacctgcacaaatgccatatttctatttggaccacatattctccattttgcattgagcagtagagtacagtggaaagggaataagaatactgattattctgaacagtttagtcccaagagaatagcgttttaaaaaagaaaaacaagatttggagtcattgtgggttatttttggtgggatggaggatcttaaaaatgcctaattgtgagagaatcaattgctgaaagtgttaaaatttctgaaaataaatgcttaattacatatacaggaattaaatagtttggaagagggttggattatcattacctttacaatactgtataatcagaagttctctgaacctcaattgtatatctagacataaaaattgttttctgtataggatgttgtttggtttgtttctgagtgtttaaattttgcaaaaacaaatgttaaatttgtgcttcagtacctagataaattggaaaggttaatgttctagtttctggaaggtaagcctgggagacacataagcaattcactgctataatttagttgatgtaaaatgacggaaactgactcaatatgtcaggtttaactctgcccaaaagcagcagacatgtaagcagatgtgcaataaaaaatgatcttgatccatttca

SEQ ID NO: 313191 - DNA, 6187 bp, Homo sapiens
ccccgttcccgattcctgtagtagcggctgtattgcagccgcctgccgaactgacccgggtctggggactggcccctctggcgccgttcggtttctcttattgccttcactgaggatgagtccctttgtggctctatgtggaccctgcggaatccaccggcgcagtttcatctagcgactggtcacccttgcaattatggatatttaaaagggtcagacagtgtggagggggagttcccctcctcactcccccttggtgcttgactccaggaataatttataaactgtggaatttttttaaatgaagaacttgtatttgatatgaactttatagagctatttataatttttttgatttaagtgccaaaaaattgtataaagatatatagttttatactattgtcaggaggatttaaattatcctaaaaaggtaatttattctctgtaacttcctcaatagcacctttgtgtcctggctttttcattttttaaaattagttttcacgattctgaagtaagtggtataaaaacagttaggatgagttcacccatgcctgactgcacatcaaagtgtcgatccctgaagcatgctttggatgtcctttctgtggtaacaaaggggagcgaaaaccagattaaggcctttctctccagtcattgttacaatgctgcaactatcaaggatgtttttggcaggaatgccctccaccttgtttcctcctgtggaaagaaaggagtgttagattggcttattcagaaaggagtggatctgttggtgaaagacaaagagtctggatggacagcattgcacagaagcattttttatggacatattgattgtgtttggtctctattgaagcatggtgttagtctgtatattcaagataaagaaggcttgtcagctttggatcttgtaatgaaggatagaccaactcatgtagtattcaagaatactgatcctacagatgtttatacttggggcgataatacaaattttaccctgggtcatggaagccagaatagcaaacatcatccagagttggtggatctgttctccaggagtgggatttatatcaagcaggtggtgctttgtaaatttcactccgtgtttctgtctcagaaagggcaggtttatacctgtggtcatggtcctggagggcgattaggacatggagatgaacagacatgcttggtccctcggcttgtggaaggactgaatggtcataattgttcccaagtggcagctgctaaggatcatactgttgtattaactgaagatggatgtgtttatacatttggtctaaacatttttcatcaattaggaattattccaccgccttccagttgtaatgtacccagacagatacaggcaaaatatctgaaaggaaggacaatcattggcgttgcagcaggcaggtttcatacagtcctatggactagagaagctgtttacactatgggactaaatggtggacaactgggttgtttgctagatcccaatggagaaaagtgtgtaactgctcctcgtcaggtctctgcccttcaccataaagacattgctctgtctttggttgctgcaagtgatggagctacagtctgtgttaccacaaggggagatatttacttacttgcagactatcagtgcaagaagatggcttctaaacagttgaacttgaaaaaagttcttgtgtctgggggtcatatggaatacaaggttgatcctgaacatttgaaagaaaatgggggtcaaaaaatttgcattcttgcaatggatggagctggaagggtgttttgctggagatcagtcaacagttctctgaagcagtgtcgatgggcctatccacgtcaggtcttcatttctgatattgctttaaatagaaatgaaattctatttgttacgcaagatggagaaggatttagagggagatggtttgaagagaaaagaaagagttctgaaaagaaagagattttatcaaaccttcacaattcctcatcagatgtgtcttatgtctctgatataaatagtgtgtatgaaagaattcgacttgagaaacttacctttgcacatagagctgttagtgtcagcacagatccaagtggatgcaactttgcaatcctgcagtcagatcctaaaacaagcctttatgaaattccagctgtgtcctcatcatccttttttgaagagtttggcaaactgttgagggaagcagatgaaatggacagcattcatgatgtgacatttcaagttggcaatagactcttccctgcacataaatatattttggcagtgcattctgatttttttcagaaattgtttctttcagatggtaatacttcagaatttacagatatttaccagaaagatgaagattctgcagggtgccatctctttgtggtagagaaggttcatcctgacatgtttgaataccttttacaatttatatacacagatacttgtgactttttaactcatggcttcaaaccaagaatacacttaaacaaaaacccagaagaatatcagggaactctgaattctcatttgaataaagtgaatttccatgaagatgataaccagaagtctgcatttgaagtttacaaaagtaatcaagctcaaacagttagtgagaggcagaagagcaaacctaaatcttgtaaaaaaggaaaaaatattagggaagatgatcctgtaagaatgttgcaaactgttgcaaagaaattcgacttcagtaatttgagtagtaggttagatggagtcagatttgaaaatgaaaaaattaatgttattgccaagaacactggtaataaactgaagctaagtcagaaaaaatgttcatttctgtgtgacgtgaccatgaaatcagtggatggaaaggaatttccttgtcataaatgtgttctttgtgctagacttgaatattttcatagtatgctgagtagctcatggattgaggcttccagttgtgcagctctggaaatgccaatacattctgatatattaaaagttattttggactacctctatactgatgaagctgtggtgataaaagaatctcaaaatgtagattttatttgtagtgttcttgtggtggctgatcaacttctcataacccggttgaaagagatttgtgaagtagcattaactgaaaaacttaccctgaagaatgctgctatgctactggaatttgcagcaatgtatagtgcaaaacagttgaaactgtcttgtttacagtttataggattgaatatggcagctttacttgaagcaaggtctcttgatgttttaagcgatggtgttttgaaggatctttctgagttttaccggaaaatgattccagcaatggatagaagagtcattacaccatatcaagatggaccagatattagctatttggaagtagaagatggagatatcttcttgaaagaagaaataaatatggaacaaaatcattcggaaactatgttcaagaaagcaaaaacaaaagctaaaaagaagccacgtaaacgttcagatagttctggaggttataacctttcagatattattcagagtccatcatctacaggattattaaagtctggtaagaccaattctgtggaatctcttccagaactgttgacatcagactctgaaggaagctatgcaggagtgggtagtcctagagatttacagtcccctgatttcacaacaggatttcattcagataagattgaggcgaaagtcaaaccgtatgttaatggtacatctcctgtgtattctagggaagatttaaaaccatgggaaaagtcaccaatacttaaaatatctgctccacagcctattcccagtaacagaattgatactaccagctctgccagttgggttgctggttctttcagtcctgtcagccctcctgttgtggatctcagaactatcatggaaatagaagaaagtagacaaaaatgtggagctacaccaaagtcacatttaggcaaaacagtttctcatggagttaaactttctcagaagcaacgaaaaatgattgcattgactaccaaggaaaacaattcaggaatgaatagcatggaaacagttttattcactccttcaaaagcccccaaaccagtgaatgcatgggcatcttctctgcattcagtttcatccaagtcattccgggatttcttactagaagaaaaaaagtctgttactagccatagttcaggcgatcatgtcaaaaaagtttcttttaaaggaattgaaaattctcaggcaccaaaaattgtcagatgctctacccatggtaccccaggaccagaaggcaaccatatttcagatttaccacttctagacagtcccaatccctggctatcttcttcagtgactgctccatccatggtagccccagtcacttttgcatctattgtagaagaagaactacaacaagaagcagctcttattagaagtcgagaaaaaccgttggctctgattcagattgaggagcatgccatacaagatttattggttttctatgaggcatttggcaaccctgaagagtttgtcattgttgaaaggacaccgcagggaccactggcagtacctatgtggaataagcatggatgctagttcactgtggagttgagatgcattttacataattatgagtttgttcatataaagaaaagctgtggaaaagagtcttagagattttgtaatatcattctaaatagattaagaaaagatataatttctttactgcagttaaatcatataatgtttgtatgattaaaaataaatttctcagaattgtgattttagtaactttatataaaatgtgtgagacaaaaacttattaaggttaaatagaattgtttcttctgaataatctaacaaaggaaaatataagtgattgaatcataagatataaggggggtaaagtattaaaaataacttttttgtttgataacttgagaatttagaagattttgccaagtatgtgttgttgcttgacttcttaaatatggcattgatgaatttaaagtaggagcatcagttattacttctgattcattaatggccagaattttgtgtttggtgtaatagttgtgtcaccattcttgttgctttttaaaaatcaggctaatcatgtggtccatgtctcttcaaagcttgacctgcacaaatgccatatttctatttggaccacatattctccattttgcattgagcagtagagtacagtggaaagggaataagaatactgattattctgaacagtttagtcccaagagaatagcgttttaaaaaagaaaaacaagatttggagtcattgtgggttatttttggtgggatggaggatcttaaaaatgcctaattgtgagagaatcaattgctgaaagtgttaaaatttctgaaaataaatgcttaattacatatacaggaattaaatagtttggaagagggttggattatcattacctttacaatactgtataatcagaagttctctgaacctcaattgtatatctagacataaaaattgttttctgtataggatgttgtttggtttgtttctgagtgtttaaattttgcaaaaacaaatgttaaatttgtgcttcagtacctagataaattggaaaggttaatgttctagtttctggaaggtaagcctgggagacacataagcaattcactgctataatttagttgatgtaaaatgacggaaactgactcaatatgtcaggtttaactctgcccaaaagcagcagacatgtaagcagatgtgcaataaaaaatgatcttgatccatttcaaaaaaaaacaagcaaagaaaacaataaaaaaaaaaaagacaaaaaaaaagaagcaaacaaaagaacagaaacaagaacaaaaagggggggggggagcaaaaaaaatcccacccaggggggacacaatgaagggtcacacaatttttagaaaaagagggccccaatagagaggcgtaaataaaagagaagaggggcgcgtaaaaaacgagcaaaggggaaaacatgacacagaaggaaactctagaagaagaacccacactaagcggggggagagcaacaagtggagaacaaaccgacagaaaacgttacacccgaggagagaaatatacaaaggacggaatataaggatgacaacacaagacaattatgcgcgaaaaaaaagcgcaccagagatattgaa

SEQ ID NO: 313192 - DNA, 6139 bp, Homo sapiens
ccccgttcccgattcctgtagtagcggctgtattgcagccgcctgccgaactgacccgggtctggggactggcccctctggcgccgttcggtttctcttattgccttcactgaggatgagtccctttgtggctctatgtggaccctgcggaatccaccggcgcagtttcatctagcgactggtcacccttgcaattatggatatttaaaagggtcagacagtgtggagggggagttcccctcctcactcccccttggtgcttgactccaggaataatttataaactgtggaatttttttaaatgaagaacttgtatttgatatgaactttatagagctatttataatttttttgatttaagtgccaaaaaattgtataaagatatatagttttatactattgtcaggaggatttaaattatcctaaaaaggtaatttattctctgtaacttcctcaatagcacctttgtgtcctggctttttcattttttaaaattagttttcacgattctgaagtaagtggtataaaaacagttaggatgagttcacccatgcctgactgcacatcaaagtgtcgatccctgaagcatgctttggatgtcctttctgtggtaacaaaggggagcgaaaaccagattaaggcctttctctccagtcattgttacaatgctgcaactatcaaggatgtttttggcaggaatgccctccaccttgtttcctcctgtggaaagaaaggagtgttagattggcttattcagaaaggagtggatctgttggtgaaagacaaagagtctggatggacagcattgcacagaagcattttttatggacatattgattgtgtttggtctctattgaagcatggtgttagtctgtatattcaagataaagaaggcttgtcagctttggatcttgtaatgaaggatagaccaactcatgtagtattcaagaatactgatcctacagatgtttatacttggggcgataatacaaattttaccctgggtcatggaagccagaatagcaaacatcatccagagttggtggatctgttctccaggagtgggatttatatcaagcaggtggtgctttgtaaatttcactccgtgtttctgtctcagaaagggcaggtttatacctgtggtcatggtcctggagggcgattaggacatggagatgaacagacatgcttggtccctcggcttgtggaaggactgaatggtcataattgttcccaagtggcagctgctaaggatcatactgttgtattaactgaagatggatgtgtttatacatttggtctaaacatttttcatcaattaggaattattccaccgccttccagttgtaatgtacccagacagatacaggcaaaatatctgaaaggaaggacaatcattggcgttgcagcaggcaggtttcatacagtcctatggactagagaagctgtttacactatgggactaaatggtggacaactgggttgtttgctagatcccaatggagaaaagtgtgtaactgctcctcgtcaggtctctgcccttcaccataaagacattgctctgtctttggttgctgcaagtgatggagctacagtctgtgttaccacaaggggagatatttacttacttgcagactatcagtgcaagaagatggcttctaaacagttgaacttgaaaaaagttcttgtgtctgggggtcatatggaatacaaggttgatcctgaacatttgaaagaaaatgggggtcaaaaaatttgcattcttgcaatggatggagctggaagggtgttttgctggagatcagtcaacagttctctgaagcagtgtcgatgggcctatccacgtcaggtcttcatttctgatattgctttaaatagaaatgaaattctatttgttacgcaagatggagaaggatttagagggagatggtttgaagagaaaagaaagagttctgaaaagaaagagattttatcaaaccttcacaattcctcatcagatgtgtcttatgtctctgatataaatagtgtgtatgaaagaattcgacttgagaaacttacctttgcacatagagctgttagtgtcagcacagatccaagtggatgcaactttgcaatcctgcagtcagatcctaaaacaagcctttatgaaattccagctgtgtcctcatcatccttttttgaagagtttggcaaactgttgagggaagcagatgaaatggacagcattcatgatgtgacatttcaagttggcaatagactcttccctgcacataaatatattttggcagtgcattctgatttttttcagaaattgtttctttcagatggtaatacttcagaatttacagatatttaccagaaagatgaagattctgcagggtgccatctctttgtggtagagaaggttcatcctgacatgtttgaataccttttacaatttatatacacagatacttgtgactttttaactcatggcttcaaaccaagaatacacttaaacaaaaacccagaagaatatcagggaactctgaattctcatttgaataaagtgaatttccatgaagatgataaccagaagtctgcatttgaagtttacaaaagtaatcaagctcaaacagttagtgagaggcagaagagcaaacctaaatcttgtaaaaaaggaaaaaatattagggaagatgatcctgtaagaatgttgcaaactgttgcaaagaaattcgacttcagtaatttgagtagtaggttagatggagtcagatttgaaaatgaaaaaattaatgttattgccaagaacactggtaataaactgaagctaagtcagaaaaaatgttcatttctgtgtgacgtgaccatgaaatcagtggatggaaaggaatttccttgtcataaatgtgttctttgtgctagacttgaatattttcatagtatgctgagtagctcatggattgaggcttccagttgtgcagctctggaaatgccaatacattctgatatattaaaagttattttggactacctctatactgatgaagctgtggtgataaaagaatctcaaaatgtagattttatttgtagtgttcttgtggtggctgatcaacttctcataacccggttgaaagagatttgtgaagtagcattaactgaaaaacttaccctgaagaatgctgctatgctactggaatttgcagcaatgtatagtgcaaaacagttgaaactgtcttgtttacagtttataggattgaatatggcagctttacttgaagcaaggtctcttgatgttttaagcgatggtgttttgaaggatctttctgagttttaccggaaaatgattccagcaatggatagaagagtcattacaccatatcaagatggaccagatattagctatttggaagtagaagatggagatatcttcttgaaagaagaaataaatatggaacaaaatcattcggaaactatgttcaagaaagcaaaaacaaaagctaaaaagaagccacgtaaacgttcagatagttctggaggttataacctttcagatattattcagagtccatcatctacaggattattaaagtctggtaagaccaattctgtggaatctcttccagaactgttgacatcagactctgaaggaagctatgcaggagtgggtagtcctagagatttacagtcccctgatttcacaacaggatttcattcagataagattgaggcgaaagtcaaaccgtatgttaatggtacatctcctgtgtattctagggaagatttaaaaccatgggaaaagtcaccaatacttaaaatatctgctccacagcctattcccagtaacagaattgatactaccagctctgccagttgggttgctggttctttcagtcctgtcagccctcctgttgtggatctcagaactatcatggaaatagaagaaagtagacaaaaatgtggagctacaccaaagtcacatttaggcaaaacagtttctcatggagttaaactttctcagaagcaacgaaaaatgattgcattgactaccaaggaaaacaattcaggaatgaatagcatggaaacagttttattcactccttcaaaagcccccaaaccagtgaatgcatgggcatcttctctgcattcagtttcatccaagtcattccgggatttcttactagaagaaaaaaagtctgttactagccatagttcaggcgatcatgtcaaaaaagtttcttttaaaggaattgaaaattctcaggcaccaaaaattgtcagatgctctacccatggtaccccaggaccagaaggcaaccatatttcagatttaccacttctagacagtcccaatccctggctatcttcttcagtgactgctccatccatggtagccccagtcacttttgcatctattgtagaagaagaactacaacaagaagcagctcttattagaagtcgagaaaaaccgttggctctgattcagattgaggagcatgccatacaagatttattggttttctatgaggcatttggcaaccctgaagagtttgtcattgttgaaaggacaccgcagggaccactggcagtacctatgtggaataagcatggatgctagttcactgtggagttgagatgcattttacataattatgagtttgttcatataaagaaaagctgtggaaaagagtcttagagattttgtaatatcattctaaatagattaagaaaagatataatttctttactgcagttaaatcatataatgtttgtatgattaaaaataaatttctcagaattgtgattttagtaactttatataaaatgtgtgagacaaaaacttattaaggttaaatagaattgtttcttctgaataatctaacaaaggaaaatataagtgattgaatcataagatataaggggggtaaagtattaaaaataacttttttgtttgataacttgagaatttagaagattttgccaagtatgtgttgttgcttgacttcttaaatatggcattgatgaatttaaagtaggagcatcagttattacttctgattcattaatggccagaattttgtgtttggtgtaatagttgtgtcaccattcttgttgctttttaaaaatcaggctaatcatgtggtccatgtctcttcaaagcttgacctgcacaaatgccatatttctatttggaccacatattctccattttgcattgagcagtagagtacagtggaaagggaataagaatactgattattctgaacagtttagtcccaagagaatagcgttttaaaaaagaaaaacaagatttggagtcattgtgggttatttttggtgggatggaggatcttaaaaatgcctaattgtgagagaatcaattgctgaaagtgttaaaatttctgaaaataaatgcttaattacatatacaggaattaaatagtttggaagagggttggattatcattacctttacaatactgtataatcagaagttctctgaacctcaattgtatatctagacataaaaattgttttctgtataggatgttgtttggtttgtttctgagtgtttaaattttgcaaaaacaaatgttaaatttgtgcttcagtacctagataaattggaaaggttaatgttctagtttctggaaggtaagcctgggagacacataagcaattcactgctataatttagttgatgtaaaatgacggaaactgactcaatatgtcaggtttaactctgcccaaaagcagcagacatgtaagcagatgtgcaataaaaaatgatcttgatccatttcaaaaaaaaaccacacacaccaacaaaacaaaaaaccacacacacacccatcaccaaaaacccacccacaaacgcgacagaccaacagacacaaaccacgaccaaaacggcgcccccaatatacagacgcgagcgacagcaacacaccagctaacgacgacacccacactgaagaaataacagcaacgccccaaaaccaacgagaaaacaacgaccataactcgaacaccatggtcgacagaagcacacacaaacccgacaaaatcagtggaaccacatcgcgaacgcgacaaacccgcgcacgccggaagagcagaaaccaacacgagacaccgacactgtcccccatatccc

SEQ ID NO: 313193 - DNA, 1987 bp, Homo sapiens
acctctgcctcctgggttcaagcgattctcctgcctccgccaccctagtagctgggattacagatgctctacccatggtaccccaggaccagaaggcaaccatatttcagatttaccacttctagacagtcccaatccctggctatcttcttcagtgactgctccatccatggtagccccagtcacttttgcatctattgtagaagaagaactacaacaagaagcagctcttattagaagtcgagaaaaaccgttggctctgattcagattgaggagcatgccatacaagatttattggttttctatgaggcatttggcaaccctgaagagtttgtcattgttgaaaggacaccgcagggaccactggcagtacctatgtggaataagcatggatgctagttcactgtggagttgagatgcattttacataattatgagtttgttcatataaagaaaagctgtggaaaagagtcttagagattttgtaatatcattctaaatagattaagaaaagatataatttctttactgcagttaaatcatataatgtttgtatgattaaaaataaatttctcagaattgtgattttagtaactttatataaaatgtgtgagacaaaaacttattaaggttaaatagaattgtttcttctgaataatctaacaaaggaaaatataagtgattgaatcataagatataaggggggtaaagtattaaaaataacttttttgtttgataacttgagaatttagaagattttgccaagtatgtgttgttgcttgacttcttaaatatggcattgatgaatttaaagtaggagcatcagttattacttctgattcattaatggccagaattttgtgtttggtgtaatagttgtgtcaccattcttgttgctttttaaaaatcaggctaatcatgtggtccatgtctcttcaaagcttgacctgcacaaatgccatatttctatttggaccacatattctccattttgcattgagcagtagagtacagtggaaagggaataagaatactgattattctgaacagtttagtcccaagagaatagcgttttaaaaaagaaaaacaagatttggagtcattgtgggttatttttggtgggatggaggatcttaaaaatgcctaattgtgagagaatcaattgctgaaagtgttaaaatttctgaaaataaatgcttaattacatatacaggaattaaatagtttggaagagggttggattatcattacctttacaatactgtataatcagaagttctctgaacctcaattgtatatctagacataaaaattgttttctgtataggatgttgtttggtttgtttctgagtgtttaaattttgcaaaaacaaatgttaaatttgtgcttcagtacctagataaattggaaaggttaatgttctagtttctggaaggtaagcctgggagacacataagcaattcactgctataatttagttgatgtaaaatgacggaaactgactcaatatgtcaggtttaactctgcccaaaagcagcagacatgtaagcagatgtgcaataaaaaatgatcttgatccatttcaaaaaaaaacaagcaaagaaaacaataaaaaaaaaaaagacaaaaaaaaagaagcaaacaaaagaacagaaacaagaacaaaaagggggggggggagcaaaaaaaatcccacccaggggggacacaatgaagggtcacacaatttttagaaaaagagggccccaatagagaggcgtaaataaaagagaagaggggcgcgtaaaaaacgagcaaaggggaaaacatgacacagaaggaaactctagaagaagaacccacactaagcggggggagagcaacaagtggagaacaaaccgacagaaaacgttacacccgaggagagaaatatacaaaggacggaatataaggatgacaacacaagacaattatgcgcgaaaaaaaagcgcaccagagatattgaa

SEQ ID NO: 313194 - DNA, 749 bp, Homo sapiens
  misc_feature (18)..(18): n is a, c, g, or t
  misc_feature (20)..(20): n is a, c, g, or t
atccttaattaaattaancncccccccccgaggggagcagggcggggcctgagcactaggcggcggcggctggcgtggggctgcttagatgcgccacggtttcggtagcgacggtagctctagccgggcctgagctgtgctagcacctcccccaggagaccgttgcagtcggccagcccccttctccacggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatgtg

SEQ ID NO: 313195 - DNA, 721 bp, Homo sapiens
  misc_feature (18)..(18): n is a, c, g, or t
  misc_feature (20)..(20): n is a, c, g, or t
atccttaattaaattaancncccccccccgagcacggtttcggtagcgacggtagctctagccgggcctgagctgtgctagcacctcccccaggagaccgttgcagtcggccagcccccttctccacggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatgtgaactggccgtccgttacaacgtcgggctgggcct

SEQ ID NO: 313196 - DNA, 687 bp, Homo sapiens
  misc_feature (18)..(18): n is a, c, g, or t
  misc_feature (20)..(20): n is a, c, g, or t
atccttaattaaattaancncccccccccgagcacggtttcggtagcgacggtagctctagccgggcctgagctgtgctagcacctcccccaggagaccgttgcagtcggccagcccccttctccacggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatgtg

SEQ ID NO: 313197 - DNA, 708 bp, Homo sapiens
ggacgcgtgggtcgacccacgcgtccggacccacgcgtgcgcggacgcgtgggcacggtttcggtagcgacggtagctctagccgggcctgagctgtgctagcacctcccccaggagaccgttgcagtcggccagcccccttctccacggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatgtg

SEQ ID NO: 313198 - DNA, 678 bp, Homo sapiens
acggagtaagtaaatggggctcgtcacaattggcacagggcggaccacggctaacgggcttaactgtgctagcacctcccccaggagaccgttgcagtcggccagcccccttctccacggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatgtg

SEQ ID NO: 313199 - DNA, 775 bp, Homo sapiens
  misc_feature (18)..(18): n is a, c, g, or t
  misc_feature (20)..(20): n is a, c, g, or t
atccttaattaaattaancncccccccccgagcacggtttcggtagcgacggtagctctagccgggcctgagctgtgctagcacctcccccaggagaccgttgcagtcggccagcccccttctccacggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatgtgcacaacacaaaacaaacaaaaaaattgtgggcgccggccgaaaagttttaaacactccgggggggggggccaagttatgaaagggtcg

SEQ ID NO: 313200 - DNA, 815 bp, Homo sapiens
gctgagcagggagagcctggggccgggccgtgtggatgccatccccgagcgcggttcgcgctcggctgaggcgctggacaagtggcttgggctcccgcgcctcagtttctctctgtggcgccgcctacctcacagacttgtgagcactcactgacgtgggtagcgcccagggcctgcggggcgcaggagagctggagtcaggcggagaccgcaggctgaccccgcagcggccgggctgtcgcggcccccacctcaggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatgtg

SEQ ID NO: 313201 - DNA, 659 bp, Homo sapiens
ggctgacctttcgtcctttgacctcctcagcctccattcccatcttcgctcagactgcaagtatgtttgtattaatgtactatgtaggcggcttggagctggggaacattctttcattctaagaatttgcagatgctgacgttcctcctttctgcccctacaggctctggcttatccaagaggcaaacactgacctctggtaattaaaatcctagttcttttcttttgtcttttccaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatgtg

SEQ ID NO: 313202 - DNA, 407 bp, Homo sapiens
  misc_feature (13)..(13): n is a, c, g, or t
  misc_feature (36)..(36): n is a, c, g, or t
  misc_feature (44)..(44): n is a, c, g, or t
gcacgaggtttgncgtggttataaaacaattagcangaatcccntgtacaaaacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatgtg

SEQ ID NO: 313203 - DNA, 338 bp, Homo sapiens
gcggccgcctactactactactactgctcgaattcaagcttctaacgatgtacggggacatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatgtg

SEQ ID NO: 313204 - DNA, 429 bp, Homo sapiens
ccgcctactactactaaattcgcggccgcgtcgaccacatagagaaggacattgcggctcaaatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctaaaaaaaaaagtcgacgcggccgcgaat

SEQ ID NO: 313205 - DNA, 783 bp, Homo sapiens
  misc_feature (18)..(18): n is a, c, g, or t
  misc_feature (20)..(20): n is a, c, g, or t
atccttaattaaattaancncccccccccgaggggagcagggcggggcctgagcactaggcggcggcggctggcgtggggctgcttagatgcgccacggtttcggtagcgacggtagctctagccgggcctgagctgtgctagcacctcccccaggagaccgttgcagtcggccagcccccttctccacggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatgtgaactggccgtccgttacaacgtcgggctgggcct

SEQ ID NO: 313206 - DNA, 784 bp, Homo sapiens
  misc_feature (18)..(18): n is a, c, g, or t
  misc_feature (20)..(20): n is a, c, g, or t
atccttaattaaattaancncccccccccgaggggagcagggcggggcctgagcactaggcggcggcggctggcgtggggctgcttagatgcgccacggtttcggtagcgacggtagctctagccgggcctgagctgtgctagcacctcccccaggagaccgttgcagtcggccagcccccttctccacggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatgtgaaaaaacaaaaatacattaatattcctgcggccga

SEQ ID NO: 313207 - DNA, 1464 bp, Homo sapiens
  misc_feature (18)..(18): n is a, c, g, or t
  misc_feature (20)..(20): n is a, c, g, or t
atccttaattaaattaancncccccccccgaggggagcagggcggggcctgagcactaggcggcggcggctggcgtggggctgcttagatgcgccacggtttcggtagcgacggtagctctagccgggcctgagctgtgctagcacctcccccaggagaccgttgcagtcggccagcccccttctccacggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatgtgaaaaaaaaaaaacaaacaaaacaaaaaaaaaaaaaaaaacaaaaaaaaaaacataaacaaacaaacacaaacaacaaaaagaaccaaagaaagaaaaaaacaaaaaacaaaaaaacagaacaaaaagaaagaagcagcgggagtgccagactgatgaaaaccagctacgagagacacgggagaccatgacagactccaaacaacagacactgatgaagaagagagggcgacgagtgctgacacaaaagcgtgtctaacaacaaacaaagcgaaggcagcgcaggggtacgtcaatagctacagtgaggggacgagagacgaacagacaacaaaagagtagaaagagaggacaaggaaagagagcaagacgacctagaaatgtctagggagtgaggcagaaaggagaaagaagaagacaaaaacaggaagagaaaaataacgagtaggaacgagagaaaccaaaaaagaaagagagaacagaacttaaaaaaaaagagagcaaacaacacaacgaaagactacaatagaaaaagcgatcgcaagcacgacacagcaatgtaagagtaaaagagagactaaaagtaacagttaacaagatacatactaacactagacagcgggccgcggtagagagaatagaaaaagaaaagcaagaaacatgacaaacaaaacaaaaaaatactaaccacccggaagacaagacggacaggaagga

SEQ ID NO: 313208 - DNA, 795 bp, Homo sapiens
  misc_feature (18)..(18): n is a, c, g, or t
  misc_feature (20)..(20): n is a, c, g, or t
atccttaattaaattaancncccccccccgaggggagcagggcggggcctgagcactaggcggcggcggctggcgtggggctgcttagatgcgccacggtttcggtagcgacggtagctctagccgggcctgagctgtgctagcacctcccccaggagaccgttgcagtcggccagcccccttctccacggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatgtgaacaaaaaaaataaataaacttgaggggggggcccggtaccccaaa

SEQ ID NO: 313209 - DNA, 837 bp, Homo sapiens
  misc_feature (18)..(18): n is a, c, g, or t
  misc_feature (20)..(20): n is a, c, g, or t
atccttaattaaattaancncccccccccgaggggagcagggcggggcctgagcactaggcggcggcggctggcgtggggctgcttagatgcgccacggtttcggtagcgacggtagctctagccgggcctgagctgtgctagcacctcccccaggagaccgttgcagtcggccagcccccttctccacggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatgtgcacaacacaaaacaaacaaaaaaattgtgggcgccggccgaaaagttttaaacactccgggggggggggccaagttatgaaagggtcg

SEQ ID NO: 313210 - DNA, 1227 bp, Homo sapiens
  misc_feature (18)..(18): n is a, c, g, or t
  misc_feature (20)..(20): n is a, c, g, or t
atccttaattaaattaancncccccccccgaggggagcagggcggggcctgagcactaggcggcggcggctggcgtggggctgcttagatgcgccacggtttcggtagcgacggtagctctagccgggcctgagctgtgctagcacctcccccaggagaccgttgcagtcggccagcccccttctccacggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatgtgaaaaaaagaaaaaaacaagagtaacgaaatagcagagacacgaaacaaacatacacaaaacgaaagagaaatatatagagggggagggacaagagaacaccacgtggaggagaccaaacaagagcatcgacagctaggtagaagagaggaacgaaagcaggcgagcagaaaacgacacacggcagcaaacaggacgcagcagaacaaacagaccagggacgagggaaaaaaacacaagaagagcgaaagtcaagctgagcaaagcaacccaaaacaacacgagtggaagcgaaacacactacactacgcacaccaacaccccccacgaagagaagaattaacaggcgcacggagcacggacaaaacaaacaacccagaagcagtatacacagtagcacacaccaacaaagagacagaacaccacagcagagaaaaacagtgcgctaaccacagtctaccaacaaagagacaactaccg

SEQ ID NO: 313211 - DNA, 780 bp, Homo sapiens
  misc_feature (18)..(18): n is a, c, g, or t
  misc_feature (20)..(20): n is a, c, g, or t
atccttaattaaattaancncccccccccgaggggagcagggcggggcctgagcactaggcggcggcggctggcgtggggctgcttagatgcgccacggtttcggtagcgacggtagctctagccgggcctgagctgtgctagcacctcccccaggagaccgttgcagtcggccagcccccttctccacggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatgtgaaaaaaaaatacacaagtaataacaaacact

SEQ ID NO: 313212 - DNA, 1496 bp, Homo sapiens
  misc_feature (18)..(18): n is a, c, g, or t
  misc_feature (20)..(20): n is a, c, g, or t
atccttaattaaattaancncccccccccgaggggagcagggcggggcctgagcactaggcggcggcggctggcgtggggctgcttagatgcgccacggtttcggtagcgacggtagctctagccgggcctgagctgtgctagcacctcccccaggagaccgttgcagtcggccagcccccttctccacggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatgtgctgaaacaacaagagaaccaaaaaagagaaacaaaaaaaaaaaacaaacaaaacaaaaaaaaaaaaaaaaacaaaaaaaaaaacataaacaaacaaacacaaacaacaaaaagaaccaaagaaagaaaaaaacaaaaaacaaaaaaacagaacaaaaagaaagaagcagcgggagtgccagactgatgaaaaccagctacgagagacacgggagaccatgacagactccaaacaacagacactgatgaagaagagagggcgacgagtgctgacacaaaagcgtgtctaacaacaaacaaagcgaaggcagcgcaggggtacgtcaatagctacagtgaggggacgagagacgaacagacaacaaaagagtagaaagagaggacaaggaaagagagcaagacgacctagaaatgtctagggagtgaggcagaaaggagaaagaagaagacaaaaacaggaagagaaaaataacgagtaggaacgagagaaaccaaaaaagaaagagagaacagaacttaaaaaaaaagagagcaaacaacacaacgaaagactacaatagaaaaagcgatcgcaagcacgacacagcaatgtaagagtaaaagagagactaaaagtaacagttaacaagatacatactaacactagacagcgggccgcggtagagagaatagaaaaagaaaagcaagaaacatgacaaacaaaacaaaaaaatactaaccacccggaagacaagacggacaggaagga

SEQ ID NO: 313213 - DNA, 878 bp, Homo sapiens
  misc_feature (18)..(18): n is a, c, g, or t
  misc_feature (20)..(20): n is a, c, g, or t
atccttaattaaattaancncccccccccgaggggagcagggcggggcctgagcactaggcggcggcggctggcgtggggctgcttagatgcgccacggtttcggtagcgacggtagctctagccgggcctgagctgtgctagcacctcccccaggagaccgttgcagtcggccagcccccttctccacggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatgtgaaaaaaaaaaaaaaaaaaaaaggggggggggttaaaaaatttccctcggggggccccagttaagggtaccccttttttgttccaagggggccctaaagggaggcgtataaagagggaggggccgggtta

SEQ ID NO: 313214 - DNA, 1052 bp, Homo sapiens
  misc_feature (18)..(18): n is a, c, g, or t
  misc_feature (20)..(20): n is a, c, g, or t
atccttaattaaattaancncccccccccgaggggagcagggcggggcctgagcactaggcggcggcggctggcgtggggctgcttagatgcgccacggtttcggtagcgacggtagctctagccgggcctgagctgtgctagcacctcccccaggagaccgttgcagtcggccagcccccttctccacggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatgtgaaagaagagaagagaagaaagaaagagagaaagaagacaagaaggggggcaaggagaaaacagaaaggacaaggacgagtggggggcaaagggcgcaccagaagagagggtcaaagaacagaggggggagcggagacaccaaagggaagagaagaaagagaagggaggcaacgaaagaaacgggggagaaaagaggacgcaggacccaaccaaaaaaaaaagagccgggagacaagaggaggtgtaaaaaaaacgaaggagaaaaaggagaaccagaggaaaaacaaagggcacagaaagaac

SEQ ID NO: 313215 - DNA, 833 bp, Homo sapiens
  misc_feature (18)..(18): n is a, c, g, or t
  misc_feature (20)..(20): n is a, c, g, or t
atccttaattaaattaancncccccccccgaggggagcagggcggggcctgagcactaggcggcggcggctggcgtggggctgcttagatgcgccacggtttcggtagcgacggtagctctagccgggcctgagctgtgctagcacctcccccaggagaccgttgcagtcggccagcccccttctccacggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatgtgcatcctcagccgagtgcaagcaaggcacactcccggggggccggaaccgcgacagagggtcgtacgataggggcggttacgtgg

SEQ ID NO: 313216 - DNA, 1103 bp, Homo sapiens
  misc_feature (18)..(18): n is a, c, g, or t
  misc_feature (20)..(20): n is a, c, g, or t
atccttaattaaattaancncccccccccgaggggagcagggcggggcctgagcactaggcggcggcggctggcgtggggctgcttagatgcgccacggtttcggtagcgacggtagctctagccgggcctgagctgtgctagcacctcccccaggagaccgttgcagtcggccagcccccttctccacggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatgtgaaaataaaccaaattatagagataaaaagacatgaagacaagcatgatcttgagccttcaggactagatccaaaagcctgtaggccgactggatcaaggggtcacttagtgcatacatagctaagccatgcgaggaaattttgaactgcctggacgactacgacctatatattgaggaaaacctttagattgccggtattttaagagtttccgatctggaaaggccgggaggtttccaaactatgtaacctaccggacagaacggctttaaccaatttaggaactatcggattgccagaacctatcgcctttacatcagttggcaaaccttaatgtgggcgctgggcttttttg

SEQ ID NO: 313217 - DNA, 858 bp, Homo sapiens
  misc_feature (18)..(18): n is a, c, g, or t
  misc_feature (20)..(20): n is a, c, g, or t
atccttaattaaattaancncccccccccgaggggagcagggcggggcctgagcactaggcggcggcggctggcgtggggctgcttagatgcgccacggtttcggtagcgacggtagctctagccgggcctgagctgtgctagcacctcccccaggagaccgttgcagtcggccagcccccttctccacggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatgtgggacatgtcggaagagatgcaacaggactcggtggagtgcgctactcaggcgctggagaaataccacatagagaaggacattgcggctcatatccagaaggaatctgat

SEQ ID NO: 313218 - DNA, 781 bp, Homo sapiens
  misc_feature (18)..(18): n is a, c, g, or t
  misc_feature (20)..(20): n is a, c, g, or t
atccttaattaaattaancncccccccccgaggggagcagggcggggcctgagcactaggcggcggcggctggcgtggggctgcttagatgcgccacggtttcggtagcgacggtagctctagccgggcctgagctgtgctagcacctcccccaggagaccgttgcagtcggccagcccccttctccacggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatgtgtggaaatgctgacccgtgctggaaatgctgac

SEQ ID NO: 313219 - DNA, 948 bp, Homo sapiens
  misc_feature (18)..(18): n is a, c, g, or t
  misc_feature (20)..(20): n is a, c, g, or t
atccttaattaaattaancncccccccccgaggggagcagggcggggcctgagcactaggcggcggcggctggcgtggggctgcttagatgcgccacggtttcggtagcgacggtagctctagccgggcctgagctgtgctagcacctcccccaggagaccgttgcagtcggccagcccccttctccacggtgagaaactcggggggccagggggtgtcctcgctgccttatttcgccccactccggacttagccctccgcgtagcccgcgcttcctgagaagtggggtggggggcgtcgtcccgtggtggcgccggccggggtgggggcagttagtgcctggggggcgcggcccaactcaaccccttaccccaggccttgcccactaggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatgtg

SEQ ID NO: 313220 - DNA, 719 bp, Homo sapiens
  misc_feature (18)..(18): n is a, c, g, or t
  misc_feature (20)..(20): n is a, c, g, or t
atccttaattaaattaancncccccccccgaggggagcagggcggggcctgagcactaggcggcggcggctggcgtggggctgcttagatgcgccacggtttcggtagcgacggtagctctagccgggcctgagctgtgctagcacctcccccaggagaccgttgcagtcggccagcccccttctccacggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccagcataaggtggggtaccgagctga

SEQ ID NO: 313221 - DNA, 1229 bp, Homo sapiens
gctgagcagggagagcctggggccgggccgtgtggatgccatccccgagcgcggttcgcgctcggctgaggcgctggacaagtggcttgggctcccgcgcctcagtttctctctgtggcgccgcctacctcacagacttgtgagcactcactgacgtgggtagcgcccagggcctgcggggcgcaggagagctggagtcaggcggagaccgcaggctgaccccgcagcggccgggctgtcgcggcccccacctcagagccactggtggccgcagaagacagtccacgtgtcttaaccaggcttacaagactccaaagatgggtgccttgtatcaagcaggtgctcaacaaatgtctgctgaaaaaatgatgcagggtgcggtggctcacgcagtaaagatggggtttcaccatgttagccaggatggtcttgatctcctgacctcgtgatccgcctgcctcggcctcccaaagtgctgggattacaggcgtgagccaccacacccggccatataaggaaagactgcctcacctgagcaagaagcttcaccctggacaaaaaccccggggctcaacactcccaaatccacccggatccccatcaccaaccccttaaaggatgtccgcattgcttggcagagaccccactcttggggataatcccttaattcgtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatgtg

SEQ ID NO: 313222 - DNA, 1029 bp, Homo sapiens
gctgagcagggagagcctggggccgggccgtgtggatgccatccccgagcgcggttcgcgctcggctgaggcgctggacaagtggcttgggctcccgcgcctcagtttctctctgtggcgccgcctacctcacagacttgtgagcactcactgacgtgggtagcgcccagggcctgcggggcgcaggagagctggagtcaggcggagaccgcaggctgaccccgcagcggccgggctgtcgcggcccccacctcagggtcttattctgttgctcaggctggagtgcaatggcgcgaacacggctcactgcagtctcgatctcgctggactcagagccactggtggccgcagaagacagtccacgtgtcttaaccaggcttacaagactccaaagatgggtgccttgtatcaagcaggtgctcaacaaatgtctgctgaaaaaatgatgcagggtgcggtggctcacgcaggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatgtg

SEQ ID NO: 313223 - DNA, 716 bp, Homo sapiens
  misc_feature (18)..(18): n is a, c, g, or t
  misc_feature (20)..(20): n is a, c, g, or t
atccttaattaaattaancncccccccccgaggggagcagggcggggcctgagcactaggcggcggcggctggcgtggggctgcttagatgcgccacggtttcggtagcgacggtagctctagccgggcctgagctgtgctagcacctcccccaggagaccgttgcagtcggccagcccccttctccacggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccacgccccggcataagtggggac

SEQ ID NO: 313224 - DNA, 534 bp, Homo sapiens
ccgcctactactactaaattcgcggccgcgtcgaccaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatgtg

SEQ ID NO: 313225 - DNA, 667 bp, Homo sapiens
gaataggcggcaatgcagtgtgaatcgaggcgtagcctctatggcggggctgggactgatgattgcactcatacctccgcaggacaccgttggtagtcggacaatctgcttctactacggtacaccatgttcgatcgaaatgcctatgatgcgaccgagtgcggcgagcaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatgtg

SEQ ID NO: 313226 - DNA, 654 bp, Homo sapiens
  misc_feature (18)..(18): n is a, c, g, or t
  misc_feature (20)..(20): n is a, c, g, or t
  misc_feature (619)..(619): n is a, c, g, or t
atccttaattaaattaancncccccccccgaggggagcagggcggggcctgagcactaggcggcggcggctggcgtggggctgcttagatgcgccacggtttcggtagcgacggtagctctagccgggcctgagctgtgctagcacctcccccaggagaccgttgcagtcggccagcccccttctccacggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctcgcacnacttgtcgaattcgggtaccggctcgattcgtata

SEQ ID NO: 313227 - DNA, 690 bp, Homo sapiens
  misc_feature (257)..(257): n is a, c, g, or t
  misc_feature (261)..(261): n is a, c, g, or t
agaggatccaacgtcagcacatacttgatatgagccgcaagtccttctctatgttgtatttctccagcgcctgagatagcgcactccaccgagtcctgatgcatctcttccgacatgtccgcatttttgatcacggcctctcagtcgcacatggttaccgtggagaagggggctggccgactgcaaagatctcctgggggaggtgctagcacagctcaggcccggctagagctaccgtcgctaccgaaaccgtggcncatntcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatgtg

SEQ ID NO: 313228 - DNA, 672 bp, Homo sapiens
  misc_feature (18)..(18): n is a, c, g, or t
  misc_feature (20)..(20): n is a, c, g, or t
atccttaattaaattaancncccccccccgaggggagcagggcggggcctgagcactaggcggcggcggctggcgtggggctgcttagatgcgccacggtttcggtagcgacggtagctctagccgggcctgagctgtgctagcacctcccccaggagaccgttgcagtcggccagcccccttctccacggtaaccatgtgcgaccgaaaggccgtgatcaaaaatgcggacatgtcggaagagatgcaacgaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatgtg

SEQ ID NO: 313229 - DNA, 645 bp, Homo sapiens
ctctgacttgggaccgtcactctacgatggcatctgctgtgtcgtaaggcgttgctctgttgctctgacatgtgttaccacgtctctcgactatctgccgtagaacgattctcagtagatgcgtgctccttatacagacacatcacaccatgagcattataacgccaccgtccatgctagcccccataagcttgctgagggagactgcggcctatatcgagagggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatgtg

SEQ ID NO: 313230 - DNA, 695 bp, Homo sapiens
  misc_feature (18)..(18): n is a, c, g, or t
  misc_feature (20)..(20): n is a, c, g, or t
atccttaattaaattaancncccccccccgaggggagcagggcggggcctgagcactaggcggcggcggctggcgtggggctgcttagatgcgccacggtttcggtagcgacggtagctctagccgggcctgagctgtgctagcacctcccccaggagaccgttgcagtcggccagcccccttctccacggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatgtg

SEQ ID NO: 313231 - DNA, 1464 bp, Homo sapiens
gctgagcagggagagcctggggccgggccgtgtggatgccatccccgagcgcggttcgcgctcggctgaggcgctggacaagtggcttgggctcccgcgcctcagtttctctctgtggcgccgcctacctcacagacttgtgagcactcactgacgtgggtagcgcccagggcctgcggggcgcaggagagctggagtcaggcggagaccgcaggctgaccccgcagcggccgggctgtcgcggcccccacctcagagccactggtggccgcagaagacagtccacgtgtcttaaccaggcttacaagactccaaagatgggtgccttgtatcaagcaggtgctcaacaaatgtctgctgaaaaaatgatgcagggtgcggtggctcacgcagtaaagatggggtttcaccatgttagccaggatggtcttgatctcctgacctcgtgatccgcctgcctcggcctcccaaagtgctgggattacaggcgtgagccaccacacccggccatataaggaaagactgcctcacctgagcaagaagcttcaccctggacaaaaaccccggggctcaacactcccaaatccacccggatccccatcaccaaccccttaaaggatgtccgcattgcttggcagagaccccactcttggggataatcccttaattcgtaaccatgtgcgaccgaaaggccgtgatcaaaaatgcggacatgtcggaagagatgcaacgaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatgtgcaaaaaacaaaaaagaagaaagcgaaggaacaaaacaccttttggggcgcttgggccccgggaaagtttttgaacacccttcggtggggccccgggggcccaatagggaatgtgaaccatgggcccaaagcggttccccagagagaagaaccggggacacagaacagcgggcgcgggattctctccaccatttaaaaaacgccgggggggaaacaccggagagtgtcttggaacaaattcagagagggagttcgaggggaccacggggggtccattcacgaggagttcacagagagctcggatttaaatagc

SEQ ID NO: 313232 - DNA, 457 bp, Homo sapiens
  misc_feature (18)..(18): n is a, c, g, or t
  misc_feature (20)..(20): n is a, c, g, or t
atccttaattaaattaancncccccccccgaggggagcagggcggggcctgagcactaggcggcggcggctggcgtggggctgcttagatgcgccacggtttcggtagcgacggtagctctagccgggcctgagctgtgctagcacctcccccaggagaccgttgcagtcggccagcccccttctccacggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccttagtctacctgggtaccgagcc

SEQ ID NO: 313233 - DNA, 1135 bp, Homo sapiens
  misc_feature (18)..(18): n is a, c, g, or t
  misc_feature (20)..(20): n is a, c, g, or t
atccttaattaaattaancncccccccccgaggggagcagggcggggcctgagcactaggcggcggcggctggcgtggggctgcttagatgcgccacggtttcggtagcgacggtagctctagccgggcctgagctgtgctagcacctcccccaggagaccgttgcagtcggccagcccccttctccacggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggtgaggatgggcgcgggggccgatacgcagccgggagcagggggttccttccccccgatcctgctttcctaagggcgcctgacaggtcccgggaatactgctggcggcttggggcgtagaagcttccagaaaggacgcagatgcattttgcgctcctgtggagaagaccagacccccggcgtccgaagttttttttttttttttttaattacccagctccgcggggggaaagcgccacctagcaacgggtatctaaagatcagggacgccgcggttcccccttctgtgtggttcctgcgccgaggatccatctgggtgttccggaggggggagctgcgtgggtgtttccagccgggccgggaggagatcttgccagccttccagtggggagttgagggaaggtggtgggtggtggcggggctgggggctggggtaggggcttggtaaatggcagtctagaaagccggcaggactgccaacttctcgagcagtgtttgctggaagggaagaaagctggcagcctaagccgtgggagggttccagtcgagaatgggaagatgaaagacttcagatggaacagaaataaatgccttttttgacaaacgcagcagtgcgtgcctctagcttgcaagagcgttactccccttcatagctttaaaaggttttcgcactgcgtgcagttagagtagctaaatcttgtgtgacgctccacaaacacttgtaagaattttgcagagaaagataaccgttgccacccaatgccccccacaggcattctactccccagtacctcttagggtgggagaa

SEQ ID NO: 313234 - DNA, 1334 bp, Homo sapiens
  misc_feature (18)..(18): n is a, c, g, or t
  misc_feature (20)..(20): n is a, c, g, or t
atccttaattaaattaancncccccccccgaggggagcagggcggggcctgagcactaggcggcggcggctggcgtggggctgcttagatgcgccacggtttcggtagcgacggtagctctagccgggcctgagctgtgctagcacctcccccaggagaccgttgcagtcggccagcccccttctccacggtgagaaactcggggggccagggggtgtcctcgctgccttatttcgccccactccggacttagccctccgcgtagcccgcgcttcctgagaagtggggtggggggcgtcgtcccgtggtggcgccggccggggtgggggcagttagtgcctggggggcgcggcccaactcaaccccttaccccaggccttgcccactaggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggtgaggatgggcgcgggggccgatacgcagccgggagcagggggttccttccccccgatcctgctttcctaagggcgcctgacaggtcccgggaatactgctggcggcttggggcgtagaagcttccagaaaggacgcagatgcattttgcgctcctgtggagaagaccagacccccggcgtccgaagttttttttttttttttttaattacccagctccgcggggggaaagcgccacctagcaacgggtatctaaagatcagggacgccgcggttcccccttctgtgtggttcctgcgccgaggatccatctgggtgttccggaggggggagctgcgtgggtgtttccagccgggccgggaggagatcttgccagccttccagtggggagttgagggaaggtggtgggtggtggcggggctgggggctggggtaggggcttggtaaatggcagtctagaaagccggcaggactgccaacttctcgagcagtgtttgctggaagggaagaaagctggcagcctaagccgtgggagggttccagtcgagaatgggaagatgaaagacttcagatggaacagaaataaatgccttttttgacaaacgcagcagtgcgtgcctctagcttgcaagagcgttactccccttcatagctttaaaaggttttcgcactgcgtgcagttagagtagctaaatcttgtgtgacgctccacaaacacttgtaagaattttgcagagaaagataaccgttgccacccaatgccccccacaggcattctactccccagtacctcttagggtgggagaa

SEQ ID NO: 313235 - DNA, 380 bp, Homo sapiens
atgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatgtgatgtgtatgtgtgtgaattacaatttgtt

SEQ ID NO: 313236 - DNA, 938 bp, Homo sapiens
tgaccgttgccaagcaacccagatgtccgttatctaggttgcccaggcacagacttatcccataaccttcactatggcgcccaggtggccgtaactcaggccagctcagaggctcatgaccttcactccactgcttagataaaacaatacttgaagtcactggttacagagaataggaatctataaactcattccataaaacaaaggaaaatttgtttttcttctccctatgttgagggagtactgggagaatctccagagcacattagataatatcatgaagaattttcctgggtctggcctgtgcctattgctgcctctgggacaagtcaccctcatacagaaaaacttatttctctttctttttaattttgcttttctttaatttcccacctcaacagagccactggtggccgcagaagacagtccacgtgtcttaaccaggcttacaagactccaaaggtctggcttctccccacccctactccctgtcttgtctctcccacactcccccaacagcttctctggagccaagtcagccagcctccttccagcttcaggcctttgaacatgctgttctttccacctaaaaagctccctgcacttcccccagcctagttccctgcttgtatagattgttcctctaatgtgactcctggaaaagccttccttgcctctcaggctagagcagagcccccattaacagctctcacaccagcctatctttctcctccactgcatttgtcacatcctgtgatcctgtgtgcatcctgttcaatgtctgtctccacacataaaatctaaactccaaaaggataggaactgtgtctgactcgcttcctttcatgtcccttgtgcctagatgggtgccttgtatcaagcaggtgctcaacaaatgtctgctgaaaaaatgatgcagggtgcggtggctcacgcag

SEQ ID NO: 313237 - DNA, 952 bp, Homo sapiens
gctgagcagggagagcctggggccgggccgtgtggatgccatccccgagcgcggttcgcgctcggctgaggcgctggacaagtggcttgggctcccgcgcctcagtttctctctgtggcgccgcctacctcacagacttgtgagcactcactgacgtgggtagcgcccagggcctgcggggcgcaggagagctggagtcaggcggagaccgcaggctgaccccgcagcggccgggctgtcgcggcccccacctcagagccactggtggccgcagaagacagtccacgtgtcttaaccaggcttacaagactccaaagatgggtgccttgtatcaagcaggtgctcaacaaatgtctgctgaaaaaatgatgcagggtgcggtggctcacgcaggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatgtg

SEQ ID NO: 313238 - DNA, 810 bp, Homo sapiens
  misc_feature (18)..(18): n is a, c, g, or t
  misc_feature (20)..(20): n is a, c, g, or t
  misc_feature (441)..(441): n is a, c, g, or t
  misc_feature (447)..(447): n is a, c, g, or t
atccttaattaaattaancncccccccccgaggggagcagggcggggcctgagcactaggcggcggcggctggcgtggggctgcttagatgcgccacggtttcggtagcgacggtagctctagccgggcctgagctgtgctagcacctcccccaggagaccgttgcagtcggccagcccccttctccacggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccccccccncccctnttttgggggggggggggggggggcccccccccccccaaaaaaaaaagcaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatgtg

SEQ ID NO: 313239 - DNA, 524 bp, Homo sapiens
  misc_feature (18)..(18): n is a, c, g, or t
  misc_feature (20)..(20): n is a, c, g, or t
  misc_feature (465)..(465): n is a, c, g, or t
  misc_feature (471)..(471): n is a, c, g, or t
  misc_feature (509)..(509): n is a, c, g, or t
atccttaattaaattaancncccccccccgaggggagcagggcggggcctgagcactaggcggcggcggctggcgtggggctgcttagatgcgccacggtttcggtagcgacggtagctctagccgggcctgagctgtgctagcacctcccccaggagaccgttgcagtcggccagcccccttctccacggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacactttcaattctttaaaccctttttttttttcccctttttttaaaaaaccccccncccctnttttgggggggggggggcgccctaagtggccattcttntgttcaaatctggtt

SEQ ID NO: 313240 - DNA, 795 bp, Homo sapiens
gtatctgctgctgtctcttgctagataatatacacagttacctccctgcttctgtttatttaaggttacaaatatgcacagagaattttaagggtctggctattccttatctggaacacatcatccatgtttgggaggagacaggctctcggttccacaactgcctgatccagctatactgtgagaaggtgcaaggtctgatgaaggagtatctcctgtccttccctgcaggcaaaaccccagtcccagctggagaggaagagggtgagctgggagaataccggcaaaagctcctcatgttcttggagatttccagctactatgatccaggccggctcatctgtgattttccctttgatggcctcttagaagaacgagctctcctgttggggcgcatggggaaacatgaacaagctcttttcatttatgtccacatcttgaaggatacaaggatggctgaggagtaccgctccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgtcgaccacgaacaaacataaagccctcctggggacttggaatcaaaaaaaacaacatcactaaaaaggg

SEQ ID NO: 313241 - DNA, 722 bp, Homo sapiens
tttttttttttatattttaaaacatgatctgtcatcgctgtcccccctcccacttggccttctcccctctgctgggacactgaaaattagacactttggtggcatgagttcttatggctgccccaaagagtctccctgatttccagagggcaagggcagagctagctgtggggaacaactcaggtcagcagtgcgagcatcctgtccatgaagtagaaggcaggtagcagggcgtgggttcagagcacaggctttagagtcagcctgggtttgcttgtaggctccctcactggctgttacctaactgctttacccctcatgcccctcaaatatgagcttggaataataatacctacttcttgggagtagttgtgagtttacagaaaaaaatatatataaatttttaaaccccgaacccagtatgtagttattgcttcatgatagctgctctgatgatgatgatgataattattctctttttgactcattggtgacttttgaggctgaatatttttgtcatccccagcaaggctgaattcacatgtttttatggtatataactttcttccccttttttgtaacagtgccagcagatgtagcatcacctgaaagcggcagtaagtgtagacgcattgaattgctttagctctggagatgggtttgagtgtttgctctgtctccgtgatacagaacttagttagaatagttgctggaaattagtt

SEQ ID NO: 313242 - DNA, 360 bp, Homo sapiens
ggtttttctatgtatccctgtatttggaactaccagtgtttatttgttttccataggttgcaacagatttgaagtgacactagagaaatccaataagaacttctccaaaaagattcagcaggtaagcagtgatggcagtccttacaagaatatttgacttacatgagaccctgtcagactagaactttggtaatgttatttattaactctgaatcctcttctctttgaccttctatttatgcaggagtgtctgctcatatatcatgtgcctgagatcctctctcacaagcagaaatgataatcacagaaattatagtgcccagaaaaatcagtgagatccctgtaactggataggctccg

SEQ ID NO: 313243 - DNA, 4850 bp, Homo sapiens
ctaactagcaggaagtccggggttgacgatggctgtgttgttgaagggcctgtagccggggggttcctggccggatcccggtctacccttagcccagactcgttccggaccccagcccggcccggaacactctgggcgagacggcggtggcaactctccccttgccgccatgcacgacgctttcgagccagtgccgatcctagaaaagctgcctctgcaaatcgactgtctggctgcctgggaggaatggcttcttgtgggaaccaaacaaggacatcttcttctctataggattcggaaggacgttggttgcaacagatttgaagtgacactagagaaatccaataagaacttctccaaaaagattcagcagatccatgtggtttcccagtttaagattctggtcagcttgttagaaaataacatttatgtccatgacctattgacatttcaacaaatcactacggtttcaaaggcaaagggagcatcactgtttacttgtgacctccagcacacagagaccggtgaggaggtgttacggatgtgtgtggcagtaaaaaagaagctgcagctctatttctggaaggacagggaatttcatgaattgcagggggactttagtgtgccagatgtgcccaagtccatggcgtggtgtgaaaattctatctgtgtgggtttcaagagagactactacctaataagggtggatggaaaggggtccatcaaagagctctttccaacaggaaaacagctggagcccttagttgcacctctggcagatggaaaagtggctgtgggccaggatgatctcaccgtggtactcaatgaggaagggatctgcacacagaaatgtgccctgaactggacggacataccagtggccatggagcaccagcctccctacatcattgcagtgttgcctcgatatgttgagatccgaacatttgaaccgaggcttctggtccaaagcattgaattgcaaaggccccgtttcattacctcaggaggatcaaacattatctatgtggccagcaatcattttgtttggagactcatccctgtccccatggcaacccaaatccaacaacttctccaggacaagcagtttgaattggctctgcagctcgcagaaatgaaagatgattctgacagtgaaaagcagcaacaaattcatcacatcaagaacttgtatgccttcaacctcttctgccagaagcgttttgatgagtccatgcaggtctttgctaaacttggcacagatcccacccatgtgatgggcctgtaccctgacctgctgcccacagactacagaaagcagttgcagtatcccaacccattgcctgtgctctccggggctgaattggagaaggctcacttagctctgattgactacctgacacagaaacgaagtcaattggtaaagaagctgaatgactctgatcaccagtcaagcacctcaccgctcatggaaggcactcccaccatcaaatccaagaagaagctgctacaaatcatcgacaccaccctgctcaagtgctatctccatacaaatgtggccctggtggcccccttgctacgcctggagaacaatcactgccacatcgaggagagcgagcacgtgctaaagaaggctcacaagtacagtgagcttatcatcctgtatgagaagaaggggctccacgagaaagctctgcaggtgctcgtggaccagtccaagaaagccaactcccctctgaaaggccacgagaggacagtgcagtatctgcagcatctgggcacagaaaacctgcatttgattttctcctactcagtgtgggtgctgagagacttcccagaagatggcctgaagatatttactgaagatctcccggaagtggagtctctgccacgtgatcgagtcctcggcttcttaatagagaattttaagggtctggctattccttatctggaacacatcatccatgtttgggaggagacaggctctcggttccacaactgcctgatccagctatactgtgagaaggtgcaaggtctgatgaaggagtatctcctgtccttccctgcaggcaaaaccccagtcccagctggagaggaagagggtgagctgggagaataccggcaaaagctcctcatgttcttggagatttccagctactatgatccaggccggctcatctgtgattttccctttgatggcctcttagaagaacgagctctcctgttggggcgcatggggaaacatgaacaagctcttttcatttatgtccacatcttgaaggatacaaggatggctgaggagtactgccacaaacactatgaccgaaacaaagatggcaacaaagatgtgtatctgtccctgcttcggatgtacctgtcgccccccagcattcactgcctggggccaatcaagctggaactactggagccaaaagccaacctccaggccgctctgcaggtcctcgagctacaccacagcaaactggacaccaccaaggccctcaaccttctgccagcaaacactcagatcaatgacatacgcatcttcctggaaaaggtcttggaagaaaatgcacaaaagaaacggttcaatcaagtgctcaagaaccttctccatgcagaattcctgagggtccaggaagagcggattttacaccagcaggtgaagtgcatcatcacagaggagaaggtgtgcatggtgtgtaagaagaagattgggaacagtgcatttgcaagataccccaatggagtggtcgtccattacttctgttccaaagaggtaaacccagctgacacttgagcccagcatcctggggatccagcggatggacagcttggctctcccagagaggtgaaggagcacctggccttaggaatcctggctgccaccaccacaaggctccccatttggacattactggctatcttgtgccctggaacaactctgaattaattagactcatggtctggcattgccagctttttaatgggaaaagagattagttataccttataccattatgttgtgggcaattccagagaattcagtacctgcttggtcaggaggatgtgcaccatcttgcctttgcacaccagtcacctgaacaaggaaacttgtcacaagtgtttgtaaccatggggttgttcatcaagggcttttctattaagtacatgacttcacaaggaccgctcagcatggctcactggagagttccatgagagaacagcactcaagcttctggccgcatggacccgatggctcgcattctgtgtagtgttttacgtctccatggtaactgtgccctgcacccctcggtagccgccctgttagttttcagtctccttttctttctcaccatttatcacttccctcactgccctacccaggctttctctcccacttccctgactctgggaataactaatatttaagcaaggtaagatgagaagcaaggggtctcagttctaggaatacagtgctagttgattgtcaggtatgttgtaaatagaccctctttggccatacactccatgcctagatgcctcggagagcatcattctctgcctaggcaaggccctgcatcccttgcctcaggccgggctgagtgtgactgcagctcctgaggatgggcctgccctgtctggggtatgcgtgatccctagatacatgttcccacagaggtgcctgctccgtcttcgctcaccagacactcaggcaggctggcttagtctttgtgcgtggcgattttgtgctctgggccctttctctttttccagccagtttccattcacttgccttacagcctgccctggccgtcactccccagctttgttcagcaatggtgtggttggagagttgtgctgggatagcgcaggaaggtgggtcccggcaacacgcaggggatgagtggacctggaactgacaatggcgtgctgccaagtgttcctgagaggtgtttaggcacagcagaggggacgcggggggcaagaacagcaggacgctggtttaaaaataactcaccgccaaacctgtggagcagtgtggggcatcctgccagaggtgcacaggctggagtttcaggcactgcaggctgatgacacacagggagagtggccctgcctcctgtcctccccggggtttttgcagactcgaagtctcactgcaccagtgtctttgatggtggtgagggtgggtgatggtgcccagcaccaacagttttagtggcctgtccttgacctgccgtggtcctttgtaaactatggctccatgctgtgtgacagatcaacgtgctgatggtaagtagactaggcttccccaggcatgccgtccgtgggggcctgaagagacagtgagtgccattggccccattcgcagatgtgggagactctgctcaggcctgtgaggctgggcagcccttcaccagagttcggaggagcagtgtgtggcgccacgtcccgactggccatacccacacagaagcagtgctgcccggggcctcatctgggccagcttggactctgcttcctccaggagcagcagggaagctctgggccacctccctggatagcaggaacttgacctgccatgtgtgccctgccttcctggccagctgtgcttgttatcttccattctcacaaactgtctttgaagcaatagaataaagaatgtgtgttttctttcctggtatacatacatgatcccatgctcccaagctccattcttccttccctcaactctctgccctccacagagctatggagaaggctggagatgaaagctttgtagtgaggactgataaagatctcatcactgctccttataataaacctaataaagcaagaaaccaaaaaaa

SEQ ID NO: 313244 - DNA, 4241 bp, Homo sapiens
acgatgtccgtgtaacagagcagctgcttccacctttcagatatagatgttggaaccacagcagaagttatagagagactactacctaataagggtggatggaaaggggtccatcaaagagctctttccaacaggaaaacagctggagcccttagttgcacctctggcagatggaaaagtggctgtgggccaggatgatctcaccgtggtactcaatgaggaagggatctgcacacagaaatgtgccctgaactggacggacataccagtggccatggagcaccagcctccctacatcattgcagtgttgcctcgatatgttgagatccgaacatttgaaccgaggcttctggtccaaagcattgaattgcaaaggccccgtttcattacctcaggaggatcaaacattatctatgtggccagcaatcattttgtttggagactcatccctgtccccatggcaacccaaatccaacaacttctccaggacaagcagtttgaattggctctgcagctcgcagaaatgaaagatgattctgacagtgaaaagcagcaacaaattcatcacatcaagaacttgtatgccttcaacctcttctgccagaagcgttttgatgagtccatgcaggtctttgctaaacttggcacagatcccacccatgtgatgggcctgtaccctgacctgctgcccacagactacagaaagcagttgcagtatcccaacccattgcctgtgctctccggggctgaattggagaaggctcacttagctctgattgactacctgacacagaaacgaagtcaattggtaaagaagctgaatgactctgatcaccagtcaagcacctcaccgctcatggaaggcactcccaccatcaaatccaagaagaagctgctacaaatcatcgacaccaccctgctcaagtgctatctccatacaaatgtggccctggtggcccccttgctacgcctggagaacaatcactgccacatcgaggagagcgagcacgtgctaaagaaggctcacaagtacagtgagcttatcatcctgtatgagaagaaggggctccacgagaaagctctgcaggtgctcgtggaccagtccaagaaagccaactcccctctgaaaggccacgagaggacagtgcagtatctgcagcatctgggcacagaaaacctgcatttgattttctcctactcagtgtgggtgctgagagacttcccagaagatggcctgaagatatttactgaagatctcccggaagtggagtctctgccacgtgatcgagtcctcggcttcttaatagagaattttaagggtctggctattccttatctggaacacatcatccatgtttgggaggagacaggctctcggttccacaactgcctgatccagctatactgtgagaaggtgcaaggtctgatgaaggagtatctcctgtccttccctgcaggcaaaaccccagtcccagctggagaggaagagggtgagctgggagaataccggcaaaagctcctcatgttcttggagatttccagctactatgatccaggccggctcatctgtgattttccctttgatggcctcttagaagaacgagctctcctgttggggcgcatggggaaacatgaacaagctcttttcatttatgtccacatcttgaaggatacaaggatggctgaggagtactgccacaaacactatgaccgaaacaaagatggcaacaaagatgtgtatctgtccctgcttcggatgtacctgtcgccccccagcattcactgcctggggccaatcaagctggaactactggagccaaaagccaacctccaggccgctctgcaggtcctcgagctacaccacagcaaactggacaccaccaaggccctcaaccttctgccagcaaacactcagatcaatgacatacgcatcttcctggaaaaggtcttggaagaaaatgcacaaaagaaacggttcaatcaagtgctcaagaaccttctccatgcagaattcctgagggtccaggaagagcggattttacaccagcaggtgaagtgcatcatcacagaggagaaggtgtgcatggtgtgtaagaagaagattgggaacagtgcatttgcaagataccccaatggagtggtcgtccattacttctgttccaaagaggtaaacccagctgacacttgagcccagcatcctggggatccagcggatggacagcttggctctcccagagaggtgaaggagcacctggccttaggaatcctggctgccaccaccacaaggctccccatttggacattactggctatcttgtgccctggaacaactctgaattaattagactcatggtctggcattgccagctttttaatgggaaaagagattagttataccttataccattatgttgtgggcaattccagagaattcagtacctgcttggtcaggaggatgtgcaccatcttgcctttgcacaccagtcacctgaacaaggaaacttgtcacaagtgtttgtaaccatggggttgttcatcaagggcttttctattaagtacatgacttcacaaggaccgctcagcatggctcactggagagttccatgagagaacagcactcaagcttctggccgcatggacccgatggctcgcattctgtgtagtgttttacgtctccatggtaactgtgccctgcacccctcggtagccgccctgttagttttcagtctccttttctttctcaccatttatcacttccctcactgccctacccaggctttctctcccacttccctgactctgggaataactaatatttaagcaaggtaagatgagaagcaaggggtctcagttctaggaatacagtgctagttgattgtcaggtatgttgtaaatagaccctctttggccatacactccatgcctagatgcctcggagagcatcattctctgcctaggcaaggccctgcatcccttgcctcaggccgggctgagtgtgactgcagctcctgaggatgggcctgccctgtctggggtatgcgtgatccctagatacatgttcccacagaggtgcctgctccgtcttcgctcaccagacactcaggcaggctggcttagtctttgtgcgtggcgattttgtgctctgggccctttctctttttccagccagtttccattcacttgccttacagcctgccctggccgtcactccccagctttgttcagcaatggtgtggttggagagttgtgctgggatagcgcaggaaggtgggtcccggcaacacgcaggggatgagtggacctggaactgacaatggcgtgctgccaagtgttcctgagaggtgtttaggcacagcagaggggacgcggggggcaagaacagcaggacgctggtttaaaaataactcaccgccaaacctgtggagcagtgtggggcatcctgccagaggtgcacaggctggagtttcaggcactgcaggctgatgacacacagggagagtggccctgcctcctgtcctccccggggtttttgcagactcgaagtctcactgcaccagtgtctttgatggtggtgagggtgggtgatggtgcccagcaccaacagttttagtggcctgtccttgacctgccgtggtcctttgtaaactatggctccatgctgtgtgacagatcaacgtgctgatggtaagtagactaggcttccccaggcatgccgtccgtgggggcctgaagagacagtgagtgccattggccccattcgcagatgtgggagactctgctcaggcctgtgaggctgggcagcccttcaccagagttcggaggagcagtgtgtggcgccacgtcccgactggccatacccacacagaagcagtgctgcccggggcctcatctgggccagcttggactctgcttcctccaggagcagcagggaagctctgggccacctccctggatagcaggaacttgacctgccatgtgtgccctgccttcctggccagctgtgcttgttatcttccattctcacaaactgtctttgaagcaatagaataaagaatgtgtgttttctttcctggtatacatacatgatcccatgctcccaagctccattcttccttccctcaactctctgccctccacagagctatggagaaggctggagatgaaagctttgtagtgaggactgataaagatctcatcactgctccttataataaacctaataaagcaagaaaccaaaaaaa

SEQ ID NO: 313245 - DNA, 4155 bp, Homo sapiens
actacctaataagggtgcacaggctggagtttcaggcactgcaggctgaatgactctgatcaccagtcaagcacctcaccgctcatggaaaagtggctgtgggccaggatgatctcaccgtggtactcaatgaggaagggatctgcacacagaaatgtgccctgaactggacggacataccagtggccatggagcaccagcctccctacatcattgcagtgttgcctcgatatgttgagatccgaacatttgaaccgaggcttctggtccaaagcattgaattgcaaaggccccgtttcattacctcaggaggatcaaacattatctatgtggccagcaatcattttgtttggagactcatccctgtccccatggcaacccaaatccaacaacttctccaggacaagcagtttgaattggctctgcagctcgcagaaatgaaagatgattctgacagtgaaaagcagcaacaaattcatcacatcaagaacttgtatgccttcaacctcttctgccagaagcgttttgatgagtccatgcaggtctttgctaaacttggcacagatcccacccatgtgatgggcctgtaccctgacctgctgcccacagactacagaaagcagttgcagtatcccaacccattgcctgtgctctccggggctgaattggagaaggctcacttagctctgattgactacctgacacagaaacgaagtcaattggtaaagaagctgaatgactctgatcaccagtcaagcacctcaccgctcatggaaggcactcccaccatcaaatccaagaagaagctgctacaaatcatcgacaccaccctgctcaagtgctatctccatacaaatgtggccctggtggcccccttgctacgcctggagaacaatcactgccacatcgaggagagcgagcacgtgctaaagaaggctcacaagtacagtgagcttatcatcctgtatgagaagaaggggctccacgagaaagctctgcaggtgctcgtggaccagtccaagaaagccaactcccctctgaaaggccacgagaggacagtgcagtatctgcagcatctgggcacagaaaacctgcatttgattttctcctactcagtgtgggtgctgagagacttcccagaagatggcctgaagatatttactgaagatctcccggaagtggagtctctgccacgtgatcgagtcctcggcttcttaatagagaattttaagggtctggctattccttatctggaacacatcatccatgtttgggaggagacaggctctcggttccacaactgcctgatccagctatactgtgagaaggtgcaaggtctgatgaaggagtatctcctgtccttccctgcaggcaaaaccccagtcccagctggagaggaagagggtgagctgggagaataccggcaaaagctcctcatgttcttggagatttccagctactatgatccaggccggctcatctgtgattttccctttgatggcctcttagaagaacgagctctcctgttggggcgcatggggaaacatgaacaagctcttttcatttatgtccacatcttgaaggatacaaggatggctgaggagtactgccacaaacactatgaccgaaacaaagatggcaacaaagatgtgtatctgtccctgcttcggatgtacctgtcgccccccagcattcactgcctggggccaatcaagctggaactactggagccaaaagccaacctccaggccgctctgcaggtcctcgagctacaccacagcaaactggacaccaccaaggccctcaaccttctgccagcaaacactcagatcaatgacatacgcatcttcctggaaaaggtcttggaagaaaatgcacaaaagaaacggttcaatcaagtgctcaagaaccttctccatgcagaattcctgagggtccaggaagagcggattttacaccagcaggtgaagtgcatcatcacagaggagaaggtgtgcatggtgtgtaagaagaagattgggaacagtgcatttgcaagataccccaatggagtggtcgtccattacttctgttccaaagaggtaaacccagctgacacttgagcccagcatcctggggatccagcggatggacagcttggctctcccagagaggtgaaggagcacctggccttaggaatcctggctgccaccaccacaaggctccccatttggacattactggctatcttgtgccctggaacaactctgaattaattagactcatggtctggcattgccagctttttaatgggaaaagagattagttataccttataccattatgttgtgggcaattccagagaattcagtacctgcttggtcaggaggatgtgcaccatcttgcctttgcacaccagtcacctgaacaaggaaacttgtcacaagtgtttgtaaccatggggttgttcatcaagggcttttctattaagtacatgacttcacaaggaccgctcagcatggctcactggagagttccatgagagaacagcactcaagcttctggccgcatggacccgatggctcgcattctgtgtagtgttttacgtctccatggtaactgtgccctgcacccctcggtagccgccctgttagttttcagtctccttttctttctcaccatttatcacttccctcactgccctacccaggctttctctcccacttccctgactctgggaataactaatatttaagcaaggtaagatgagaagcaaggggtctcagttctaggaatacagtgctagttgattgtcaggtatgttgtaaatagaccctctttggccatacactccatgcctagatgcctcggagagcatcattctctgcctaggcaaggccctgcatcccttgcctcaggccgggctgagtgtgactgcagctcctgaggatgggcctgccctgtctggggtatgcgtgatccctagatacatgttcccacagaggtgcctgctccgtcttcgctcaccagacactcaggcaggctggcttagtctttgtgcgtggcgattttgtgctctgggccctttctctttttccagccagtttccattcacttgccttacagcctgccctggccgtcactccccagctttgttcagcaatggtgtggttggagagttgtgctgggatagcgcaggaaggtgggtcccggcaacacgcaggggatgagtggacctggaactgacaatggcgtgctgccaagtgttcctgagaggtgtttaggcacagcagaggggacgcggggggcaagaacagcaggacgctggtttaaaaataactcaccgccaaacctgtggagcagtgtggggcatcctgccagaggtgcacaggctggagtttcaggcactgcaggctgatgacacacagggagagtggccctgcctcctgtcctccccggggtttttgcagactcgaagtctcactgcaccagtgtctttgatggtggtgagggtgggtgatggtgcccagcaccaacagttttagtggcctgtccttgacctgccgtggtcctttgtaaactatggctccatgctgtgtgacagatcaacgtgctgatggtaagtagactaggcttccccaggcatgccgtccgtgggggcctgaagagacagtgagtgccattggccccattcgcagatgtgggagactctgctcaggcctgtgaggctgggcagcccttcaccagagttcggaggagcagtgtgtggcgccacgtcccgactggccatacccacacagaagcagtgctgcccggggcctcatctgggccagcttggactctgcttcctccaggagcagcagggaagctctgggccacctccctggatagcaggaacttgacctgccatgtgtgccctgccttcctggccagctgtgcttgttatcttccattctcacaaactgtctttgaagcaatagaataaagaatgtgtgttttctttcctggtatacatacatgatcccatgctcccaagctccattcttccttccctcaactctctgccctccacagagctatggagaaggctggagatgaaagctttgtagtgaggactgataaagatctcatcactgctccttataataaacctaataaagcaagaaaccaaaaaaa

SEQ ID NO: 313246 - DNA, 3990 bp, Homo sapiens
aactgctgtgtatgttctctttcacagagcaccagcctccctacatcattgcagtgttgcctcgatatgttgagatccgaacatttgaaccgaggcttctggtccaaagcattgaattgcaaaggccccgtttcattacctcaggaggatcaaacattatctatgtggccagcaatcattttgtttggagactcatccctgtccccatggcaacccaaatccaacaacttctccaggacaagcagtttgaattggctctgcagctcgcagaaatgaaagatgattctgacagtgaaaagcagcaacaaattcatcacatcaagaacttgtatgccttcaacctcttctgccagaagcgttttgatgagtccatgcaggtctttgctaaacttggcacagatcccacccatgtgatgggcctgtaccctgacctgctgcccacagactacagaaagcagttgcagtatcccaacccattgcctgtgctctccggggctgaattggagaaggctcacttagctctgattgactacctgacacagaaacgaagtcaattggtaaagaagctgaatgactctgatcaccagtcaagcacctcaccgctcatggaaggcactcccaccatcaaatccaagaagaagctgctacaaatcatcgacaccaccctgctcaagtgctatctccatacaaatgtggccctggtggcccccttgctacgcctggagaacaatcactgccacatcgaggagagcgagcacgtgctaaagaaggctcacaagtacagtgagcttatcatcctgtatgagaagaaggggctccacgagaaagctctgcaggtgctcgtggaccagtccaagaaagccaactcccctctgaaaggccacgagaggacagtgcagtatctgcagcatctgggcacagaaaacctgcatttgattttctcctactcagtgtgggtgctgagagacttcccagaagatggcctgaagatatttactgaagatctcccggaagtggagtctctgccacgtgatcgagtcctcggcttcttaatagagaattttaagggtctggctattccttatctggaacacatcatccatgtttgggaggagacaggctctcggttccacaactgcctgatccagctatactgtgagaaggtgcaaggtctgatgaaggagtatctcctgtccttccctgcaggcaaaaccccagtcccagctggagaggaagagggtgagctgggagaataccggcaaaagctcctcatgttcttggagatttccagctactatgatccaggccggctcatctgtgattttccctttgatggcctcttagaagaacgagctctcctgttggggcgcatggggaaacatgaacaagctcttttcatttatgtccacatcttgaaggatacaaggatggctgaggagtactgccacaaacactatgaccgaaacaaagatggcaacaaagatgtgtatctgtccctgcttcggatgtacctgtcgccccccagcattcactgcctggggccaatcaagctggaactactggagccaaaagccaacctccaggccgctctgcaggtcctcgagctacaccacagcaaactggacaccaccaaggccctcaaccttctgccagcaaacactcagatcaatgacatacgcatcttcctggaaaaggtcttggaagaaaatgcacaaaagaaacggttcaatcaagtgctcaagaaccttctccatgcagaattcctgagggtccaggaagagcggattttacaccagcaggtgaagtgcatcatcacagaggagaaggtgtgcatggtgtgtaagaagaagattgggaacagtgcatttgcaagataccccaatggagtggtcgtccattacttctgttccaaagaggtaaacccagctgacacttgagcccagcatcctggggatccagcggatggacagcttggctctcccagagaggtgaaggagcacctggccttaggaatcctggctgccaccaccacaaggctccccatttggacattactggctatcttgtgccctggaacaactctgaattaattagactcatggtctggcattgccagctttttaatgggaaaagagattagttataccttataccattatgttgtgggcaattccagagaattcagtacctgcttggtcaggaggatgtgcaccatcttgcctttgcacaccagtcacctgaacaaggaaacttgtcacaagtgtttgtaaccatggggttgttcatcaagggcttttctattaagtacatgacttcacaaggaccgctcagcatggctcactggagagttccatgagagaacagcactcaagcttctggccgcatggacccgatggctcgcattctgtgtagtgttttacgtctccatggtaactgtgccctgcacccctcggtagccgccctgttagttttcagtctccttttctttctcaccatttatcacttccctcactgccctacccaggctttctctcccacttccctgactctgggaataactaatatttaagcaaggtaagatgagaagcaaggggtctcagttctaggaatacagtgctagttgattgtcaggtatgttgtaaatagaccctctttggccatacactccatgcctagatgcctcggagagcatcattctctgcctaggcaaggccctgcatcccttgcctcaggccgggctgagtgtgactgcagctcctgaggatgggcctgccctgtctggggtatgcgtgatccctagatacatgttcccacagaggtgcctgctccgtcttcgctcaccagacactcaggcaggctggcttagtctttgtgcgtggcgattttgtgctctgggccctttctctttttccagccagtttccattcacttgccttacagcctgccctggccgtcactccccagctttgttcagcaatggtgtggttggagagttgtgctgggatagcgcaggaaggtgggtcccggcaacacgcaggggatgagtggacctggaactgacaatggcgtgctgccaagtgttcctgagaggtgtttaggcacagcagaggggacgcggggggcaagaacagcaggacgctggtttaaaaataactcaccgccaaacctgtggagcagtgtggggcatcctgccagaggtgcacaggctggagtttcaggcactgcaggctgatgacacacagggagagtggccctgcctcctgtcctccccggggtttttgcagactcgaagtctcactgcaccagtgtctttgatggtggtgagggtgggtgatggtgcccagcaccaacagttttagtggcctgtccttgacctgccgtggtcctttgtaaactatggctccatgctgtgtgacagatcaacgtgctgatggtaagtagactaggcttccccaggcatgccgtccgtgggggcctgaagagacagtgagtgccattggccccattcgcagatgtgggagactctgctcaggcctgtgaggctgggcagcccttcaccagagttcggaggagcagtgtgtggcgccacgtcccgactggccatacccacacagaagcagtgctgcccggggcctcatctgggccagcttggactctgcttcctccaggagcagcagggaagctctgggccacctccctggatagcaggaacttgacctgccatgtgtgccctgccttcctggccagctgtgcttgttatcttccattctcacaaactgtctttgaagcaatagaataaagaatgtgtgttttctttcctggtatacatacatgatcccatgctcccaagctccattcttccttccctcaactctctgccctccacagagctatggagaaggctggagatgaaagctttgtagtgaggactgataaagatctcatcactgctccttataataaacctaataaagcaagaaaccaaaaaaa

SEQ ID NO: 313247 - DNA, 3015 bp, Homo sapiens
gtatctgctgctgtctcttgctagataatatacacagttacctccctgcttctgtttatttaaggttacaaatatgcacagagaattttaagggtctggctattccttatctggaacacatcatccatgtttgggaggagacaggctctcggttccacaactgcctgatccagctatactgtgagaaggtgcaaggtctgatgaaggagtatctcctgtccttccctgcaggcaaaaccccagtcccagctggagaggaagagggtgagctgggagaataccggcaaaagctcctcatgttcttggagatttccagctactatgatccaggccggctcatctgtgattttccctttgatggcctcttagaagaacgagctctcctgttggggcgcatggggaaacatgaacaagctcttttcatttatgtccacatcttgaaggatacaaggatggctgaggagtactgccacaaacactatgaccgaaacaaagatggcaacaaagatgtgtatctgtccctgcttcggatgtacctgtcgccccccagcattcactgcctggggccaatcaagctggaactactggagccaaaagccaacctccaggccgctctgcaggtcctcgagctacaccacagcaaactggacaccaccaaggccctcaaccttctgccagcaaacactcagatcaatgacatacgcatcttcctggaaaaggtcttggaagaaaatgcacaaaagaaacggttcaatcaagtgctcaagaaccttctccatgcagaattcctgagggtccaggaagagcggattttacaccagcaggtgaagtgcatcatcacagaggagaaggtgtgcatggtgtgtaagaagaagattgggaacagtgcatttgcaagataccccaatggagtggtcgtccattacttctgttccaaagaggtaaacccagctgacacttgagcccagcatcctggggatccagcggatggacagcttggctctcccagagaggtgaaggagcacctggccttaggaatcctggctgccaccaccacaaggctccccatttggacattactggctatcttgtgccctggaacaactctgaattaattagactcatggtctggcattgccagctttttaatgggaaaagagattagttataccttataccattatgttgtgggcaattccagagaattcagtacctgcttggtcaggaggatgtgcaccatcttgcctttgcacaccagtcacctgaacaaggaaacttgtcacaagtgtttgtaaccatggggttgttcatcaagggcttttctattaagtacatgacttcacaaggaccgctcagcatggctcactggagagttccatgagagaacagcactcaagcttctggccgcatggacccgatggctcgcattctgtgtagtgttttacgtctccatggtaactgtgccctgcacccctcggtagccgccctgttagttttcagtctccttttctttctcaccatttatcacttccctcactgccctacccaggctttctctcccacttccctgactctgggaataactaatatttaagcaaggtaagatgagaagcaaggggtctcagttctaggaatacagtgctagttgattgtcaggtatgttgtaaatagaccctctttggccatacactccatgcctagatgcctcggagagcatcattctctgcctaggcaaggccctgcatcccttgcctcaggccgggctgagtgtgactgcagctcctgaggatgggcctgccctgtctggggtatgcgtgatccctagatacatgttcccacagaggtgcctgctccgtcttcgctcaccagacactcaggcaggctggcttagtctttgtgcgtggcgattttgtgctctgggccctttctctttttccagccagtttccattcacttgccttacagcctgccctggccgtcactccccagctttgttcagcaatggtgtggttggagagttgtgctgggatagcgcaggaaggtgggtcccggcaacacgcaggggatgagtggacctggaactgacaatggcgtgctgccaagtgttcctgagaggtgtttaggcacagcagaggggacgcggggggcaagaacagcaggacgctggtttaaaaataactcaccgccaaacctgtggagcagtgtggggcatcctgccagaggtgcacaggctggagtttcaggcactgcaggctgatgacacacagggagagtggccctgcctcctgtcctccccggggtttttgcagactcgaagtctcactgcaccagtgtctttgatggtggtgagggtgggtgatggtgcccagcaccaacagttttagtggcctgtccttgacctgccgtggtcctttgtaaactatggctccatgctgtgtgacagatcaacgtgctgatggtaagtagactaggcttccccaggcatgccgtccgtgggggcctgaagagacagtgagtgccattggccccattcgcagatgtgggagactctgctcaggcctgtgaggctgggcagcccttcaccagagttcggaggagcagtgtgtggcgccacgtcccgactggccatacccacacagaagcagtgctgcccggggcctcatctgggccagcttggactctgcttcctccaggagcagcagggaagctctgggccacctccctggatagcaggaacttgacctgccatgtgtgccctgccttcctggccagctgtgcttgttatcttccattctcacaaactgtctttgaagcaatagaataaagaatgtgtgttttctttcctggtatacatacatgatcccatgctcccaagctccattcttccttccctcaactctctgccctccacagagctatggagaaggctggagatgaaagctttgtagtgaggactgataaagatctcatcactgctccttataataaacctaataaagcaagaaaccaaaaaaa

SEQ ID NO: 313248 - DNA, 4508 bp, Homo sapiens
ctaactagcaggaagtccggggttgacgatggctgtgttgttgaagggcctgtagccggggggttcctggccggatcccggtctacccttagcccagactcgttccggaccccagcccggcccggaacactctgggcgagacggcggtggcaactctccccttgccgccatgcacgacgctttcgagccagtgccgatcctagaaaagctgcctctgcaaatcgactgtctggctgcctgggaggaatggcttcttgtgggaaccaaacaaggacatcttcttctctataggattcggaaggacgttgtgccagcagatgtagcatcacctgaaagcggcagttgcaacagatttgaagtgacactagagaaatccaataagaacttctccaaaaagattcagcagatccatgtggtttcccagtttaagattctggtcagcttgttagaaaataacatttatgtccatgacctattgacatttcaacaaatcactacggtttcaaaggcaaagggagcatcactgtttacttgtgacctccagcacacagagaccggtgaggaggtgttacggatgtgtgtggcagtaaaaaagaagctgcagctctatttctggaaggacagggaatttcatgaattgcagggggactttagtgtgccagatgtgcccaagtccatggcgtggtgtgaaaattctatctgtgtgggtttcaagagagactactacctaataagggtggatggaaaggggtccatcaaagagctctttccaacaggaaaacagctggagcccttagttgcacctctggcagatggaaaagtggctgtgggccaggatgatctcaccgtggtactcaatgaggaagggatctgcacacagaaatgtgccctgaactggacggacataccagtggccatggagcaccagcctccctacatcattgcagtgttgcctcgatatgttgagatccgaacatttgaaccgaggcttctggtccaaagcattgaattgcaaaggccccgtttcattacctcaggaggatcaaacattatctatgtggccagcaatcattttgtttggagactcatccctgtccccatggcaacccaaatccaacaacttctccaggacaagcagtttgaattggctctgcagctcgcagaaatgaaagatgattctgacagtgaaaagcagcaacaaattcatcacatcaagaacttgtatgccttcaacctcttctgccagaagcgttttgatgagtccatgcaggtctttgctaaacttggcacagatcccacccatgtgatgggcctgtaccctgacctgctgcccacagactacagaaagcagttgcagtatcccaacccattgcctgtgctctccggggctgaattggagaaggctcacttagctctgattgactacctgacacagaaacgaagtcaattggtaaagaagctgaatgactctgatcaccagtcaagcacctcaccgctcatggaaggcactcccaccatcaaatccaagaagaagctgctacaaatcatcgacaccaccctgctcaagtgctatctccatacaaatgtggccctggtggcccccttgctacgcctggagaacaatcactgccacatcgaggagagcgagcacgtgctaaagaaggctcacaagtacagtgagcttatcatcctgtatgagaagaaggggctccacgagaaagctctgcaggtgctcgtggaccagtccaagaaagccaactcccctctgaaaggccacgagaggacagtgcagtatctgcagcatctgggcacagaaaacctgcatttgattttctcctactcagtgtgggtgctgagagacttcccagaagatggcctgaagatatttactgaagatctcccggaagtggagtctctgccacgtgatcgagtcctcggcttcttaatagagaattttaagggtctggctattccttatctggaacacatcatccatgtttgggaggagacaggctctcggttccacaactgcctgatccagctatactgtgagaaggtgcaaggtctgatgaaggagtatctcctgtccttccctgcaggcaaaaccccagtcccagctggagaggaagagggtgagctgggagaataccggcaaaagctcctcatgttcttggagatttccagctactatgatccaggccggctcatctgtgattttccctttgatggcctcttagaagaacgagctctcctgttggggcgcatggggaaacatgaacaagctcttttcatttatgtccacatcttgaaggatacaaggatggctgaggagtactgccacaaacactatgaccgaaacaaagatggcaacaaagatgtgtatctgtccctgcttcggatgtacctgtcgccccccagcattcactgcctggggccaatcaagctggaactactggagccaaaagccaacctccaggccgctctgcaggtcctcgagctacaccacagcaaactggacaccaccaaggccctcaaccttctgccagcaaacactcagatcaatgacatacgcatcttcctggaaaaggtcttggaagaaaatgcacaaaagaaacggttcaatcaagtgctcaagaaccttctccatgcagaattcctgagggtccaggaagagcggattttacaccagcaggtgaagtgcatcatcacagaggagaaggtgtgcatggtgtgtaagaagaagattgggaacagtgcatttgcaagataccccaatggagtggtcgtccattacttctgttccaaagaggtaaacccagctgacacttgagcccagcatcctggggatccagcggatggacagcttggctctcccagagaggtgaaggagcacctggccttaggaatcctggctgccaccaccacaaggctccccatttggacattactggctatcttgtgccctggaacaactctgaattaattagactcatggtctggcattgccagctttttaatgggaaaagagattagttataccttataccattatgttgtgggcaattccagagaattcagtacctgcttggtcaggaggatgtgcaccatcttgcctttgcacaccagtcacctgaacaaggaaacttgtcacaagtgtttgtaaccatggggttgttcatcaagggcttttctattaagtacatgacttcacaaggaccgctcagcatggctcactggagagttccatgagagaacagcactcaagcttctggccgcatggacccgatggctcgcattctgtgtagtgttttacgtctccatggtaactgtgccctgcacccctcggtagccgccctgttagttttcagtctccttttctttctcaccatttatcacttccctcactgccctacccaggctttctctcccacttccctgactctgggaataactaatatttaagcaaggtaagatgagaagcaaggggtctcagttctaggaatacagtgctagttgattgtcaggtatgttgtaaatagaccctctttggccatacactccatgcctagatgcctcggagagcatcattctctgcctaggcaaggccctgcatcccttgcctcaggccgggctgagtgtgactgcagctcctgaggatgggcctgccctgtctggggtatgcgtgatccctagatacatgttcccacagaggtgcctgctccgtcttcgctcaccagacactcaggcaggctggcttagtctttgtgcgtggcgattttgtgctctgggccctttctctttttccagccagtttccattcacttgccttacagcctgccctggccgtcactccccagctttgttcagcaatggtgtggttggagagttgtgctgggatagcgcaggaaggtgggtcccggcaacacgcaggggatgagtggacctggaactgacaatggcgtgctgccaagtgttcctgagaggtgtttaggcacagcagaggggacgcggggggcaagaacagcaggacgctggtttaaaaataactcaccgccaaacctgtggagcagtgtggggcatcctgccagaggtgcacaggctggagtttcaggcactgcaggctgatgacacacagggagactgcccggggcctcatctgggccagcttggactctgcttcctccaggagcagcagggaagctctgggccacctccctggatagcaggaacttgacctgccatgtgtgccctgccttcctggccagctgtgcttgttatcttccattctcacaaactgtctttgaagcaatagaataaagaatgtgtgttttctttcctggtatacatacatgatcccatgctcccaagctccattcttccttccctcaactctctgccctccacagagctatggagaaggctggagatgaaagctttgtagtgaggactgataaagatctcatcactgctccttataataaacctaataaagcaagaaaccaaaaaaa

SEQ ID NO: 313249 - DNA, 3524 bp, Homo sapiens
ctaactagcaggaagtccggggttgacgatggctgtgttgttgaagggcctgtagccggggggttcctggccggatcccggtctacccttagcccagactcgttccggaccccagcccggcccggaacactctgggcgagacggcggtggcaactctccccttgccgccatgcacgacgctttcgagccagtgccgatcctagaaaagctgcctctgcaaatcgactgtctggctgcctgggaggaatggcttcttgtgggaaccaaacaaggacatcttcttctctataggattcggaaggacgttgtgccagcagatgtagcatcacctgaaagcggcagttgcaacagatttgaagtgacactagagaaatccaataagaacttctccaaaaagattcagcagatccatgtggtttcccagtttaagattctggtcagcttgttagaaaataacatttatgtccatgacctattgacatttcaacaaatcactacggtttcaaaggcaaagggagcatcactgtttacttgtgacctccagcacacagagaccggtgaggaggtgttacggatgtgtgtggcagtaaaaaagaagctgcagctctatttctggaaggacagggaatttcatgaattgcagggggactttagtgtgccagatgtgcccaagtccatggcgtggtgtgaaaattctatctgtgtgggtttcaagagagactactacctaataagggtggatggaaaggggtccatcaaagagctctttccaacaggaaaacagctggagcccttagttgcacctctggcagatggaaaagtggctgtgggccaggatgatctcaccgtggtactcaatgaggaagggatctgcacacagaaatgtgccctgaactggacggacataccagtggccatggagcaccagcctccctacatcattgcagtgttgcctcgatatgttgagatccgaacatttgaaccgaggcttctggtccaaagcattgaattgcaaaggccccgtttcattacctcaggaggatcaaacattatctatgtggccagcaatcattttgtttggagactcatccctgtccccatggcaacccaaatccaacaacttctccaggacaagcagtttgaattggctctgcagctcgcagaaatgaaagatgattctgacagtgaaaagcagcaacaaattcatcacatcaagaacttgtatgccttcaacctcttctgccagaagcgttttgatgagtccatgcaggtctttgctaaacttggcacagatcccacccatgtgatgggcctgtaccctgacctgctgcccacagactacagaaagcagttgcagtatcccaacccattgcctgtgctctccggggctgaattggagaaggctcacttagctctgattgactacctgacacagaaacgaagtcaattggtaaagaagctgaatgactctgatcaccagtcaagcacctcaccgctcatggaaggcactcccaccatcaaatccaagaagaagctgctacaaatcatcgacaccaccctgctcaagtgctatctccatacaaatgtggccctggtggcccccttgctacgcctggagaacaatcactgccacatcgaggagagcgagcacgtgctaaagaaggctcacaagtacagtgagcttatcatcctgtatgagaagaaggggctccacgagaaagctctgcaggtgctcgtggaccagtccaagaaagccaactcccctctgaaaggccacgagaggacagtgcagtatctgcagcatctgggcacagaaaacctgcatttgattttctcctactcagtgtgggtgctgagagacttcccagaagatggcctgaagatatttactgaagatctcccggaagtggagtctctgccacgtgatcgagtcctcggcttcttaatagagaattttaagggtctggctattccttatctggaacacatcatccatgtttgggaggagacaggctctcggttccacaactgcctgatccagctatactgtgagaaggtgcaaggtctgatgaaggagtatctcctgtccttccctgcaggcaaaaccccagtcccagctggagaggaagagggtgagctgggagaataccggcaaaagctcctcatgttcttggagatttccagctactatgatccaggccggctcatctgtgattttccctttgatggcctcttagaagaacgagctctcctgttggggcgcatggggaaacatgaacaagctcttttcatttatgtccacatcttgaaggatacaaggatggctgaggagtactgccacaaacactatgaccgaaacaaagatggcaacaaagatgtgtatctgtccctgcttcggatgtacctgtcgccccccagcattcactgcctggggccaatcaagctggaactactggagccaaaagccaacctccaggccgctctgcaggtcctcgagctacaccacagcaaactggacaccaccaaggccctcaaccttctgccagcaaacactcagatcaatgacatacgcatcttcctggaaaaggtcttggaagaaaatgcacaaaagaaacggttcaatcaagtgctcaagaaccttctccatgcagaattcctgagggtccaggaagagcggattttacaccagcaggtgaagtgcatcatcacagaggagaaggtgtgcatggtgtgtaagaagaagattgggaacagtgcatttgcaagataccccaatggagtggtcgtccattacttctgttccaaagaggtaaacccagctgacacttgagcccagcatcctggggatccagcggatggacagcttggctctcccagagaggtgaaggagcacctggccttaggaatcctggctgccaccaccacaaggctccccatttggacattactggctatcttgtgccctggaacaactctgaattaattagactcatggtctggcattgccagctttttaatgggaaaagagattagttataccttataccattatgttgtgggcaattccagagaattcagtacctgcttggtcaggaggatgtgcaccatcttgcctttgcacaccagtcacctgaacaaggaaacttgtcacaagtgtttgtaaccatggggttgttcatcaagggcttttctattaagtacatgacttcacaaggaccgctcagcatggctcactggagagttccatgagagaacagcactcaagcttctggccgcatggacccgatggctcgcattctgtgtagtgttttacgtctccatggtaactgtgccctgcacccctcggtagccgccctgttagttttcagtctccttttctttctcaccatttatcacttccctcaactctctgccctccacagagctatggagaaggctggagatgaaagctttgtagtgaggactgataaagatctcatcactgctccttataataaacctaataaagcaagaaaccaaaaaaa

SEQ ID NO: 313250 - DNA, 3377 bp, Homo sapiens
ctaactagcaggaagtccggggttgacgatggctgtgttgttgaagggcctgtagccggggggttcctggccggatcccggtctacccttagcccagactcgttccggaccccagcccggcccggaacactctgggcgagacggcggtggcaactctccccttgccgccatgcacgacgctttcgagccagtgccgatcctagaaaagctgcctctgcaaatcgactgtctggctgcctgggaggaatggcttcttgtgggaaccaaacaaggacatcttcttctctataggattcggaaggacgttgtgccagcagatgtagcatcacctgaaagcggcagttgcaacagatttgaagtgacactagagaaatccaataagaacttctccaaaaagattcagcagatccatgtggtttcccagtttaagattctggtcagcttgttagaaaataacatttatgtccatgacctattgacatttcaacaaatcactacggtttcaaaggcaaagggagcatcactgtttacttgtgacctccagcacacagagaccggtgaggaggtgttacggatgtgtgtggcagtaaaaaagaagctgcagctctatttctggaaggacagggaatttcatgaattgcagggggactttagtgtgccagatgtgcccaagtccatggcgtggtgtgaaaattctatctgtgtgggtttcaagagagactactacctaataagggtggatggaaaggggtccatcaaagagctctttccaacaggaaaacagctggagcccttagttgcacctctggcagatggaaaagtggctgtgggccaggatgatctcaccgtggtactcaatgaggaagggatctgcacacagaaatgtgccctgaactggacggacataccagtggccatggagcaccagcctccctacatcattgcagtgttgcctcgatatgttgagatccgaacatttgaaccgaggcttctggtccaaagcattgaattgcaaaggccccgtttcattacctcaggaggatcaaacattatctatgtggccagcaatcattttgtttggagactcatccctgtccccatggcaacccaaatccaacaacttctccaggacaagcagtttgaattggctctgcagctcgcagaaatgaaagatgattctgacagtgaaaagcagcaacaaattcatcacatcaagaacttgtatgccttcaacctcttctgccagaagcgttttgatgagtccatgcaggtctttgctaaacttggcacagatcccacccatgtgatgggcctgtaccctgacctgctgcccacagactacagaaagcagttgcagtatcccaacccattgcctgtgctctccggggctgaattggagaaggctcacttagctctgattgactacctgacacagaaacgaagtcaattggtaaagaagctgaatgactctgatcaccagtcaagcacctcaccgctcatggaaggcactcccaccatcaaatccaagaagaagctgctacaaatcatcgacaccaccctgctcaagtgctatctccatacaaatgtggccctggtggcccccttgctacgcctggagaacaatcactgccacatcgaggagagcgagcacgtgctaaagaaggctcacaagtacagtgagcttatcatcctgtatgagaagaaggggctccacgagaaagctctgcaggtgctcgtggaccagtccaagaaagccaactcccctctgaaaggccacgagaggacagtgcagtatctgcagcatctgggcacagaaaacctgcatttgattttctcctactcagtgtgggtgctgagagacttcccagaagatggcctgaagatatttactgaagatctcccggaagtggagtctctgccacgtgatcgagtcctcggcttcttaatagagaattttaagggtctggctattccttatctggaacacatcatccatgtttgggaggagacaggctctcggttccacaactgcctgatccagctatactgtgagaaggtgcaaggtctgatgaaggagtatctcctgtccttccctgcaggcaaaaccccagtcccagctggagaggaagagggtgagctgggagaataccggcaaaagctcctcatgttcttggagatttccagctactatgatccaggccggctcatctgtgattttccctttgatggcctcttagaagaacgagctctcctgttggggcgcatggggaaacatgaacaagctcttttcatttatgtccacatcttgaaggatacaaggatggctgaggagtactgccacaaacactatgaccgaaacaaagatggcaacaaagatgtgtatctgtccctgcttcggatgtacctgtcgccccccagcattcactgcctggggccaatcaagctggaactactggagccaaaagccaacctccaggccgctctgcaggtcctcgagctacaccacagcaaactggacaccaccaaggccctcaaccttctgccagcaaacactcagatcaatgacatacgcatcttcctggaaaaggtcttggaagaaaatgcacaaaagaaacggttcaatcaagtgctcaagaaccttctccatgcagaattcctgagggtccaggaagagcggattttacaccagcaggtgaagtgcatcatcacagaggagaaggtgtgcatggtgtgtaagaagaagattgggaacagtgcatttgcaagataccccaatggagtggtcgtccattacttctgttccaaagaggtaaacccagctgacacttgagcccagcatcctggggatccagcggatggacagcttggctctcccagagaggtgaaggagcacctggccttaggaatcctggctgccaccaccacaaggctccccatttggacattactggctatcttgtgccctggaacaactctgaattaattagactcatggtctggcattgccagctttttaatgggaaaagagattagttataccttaaaaaaaaaaaaaaaaaaaaaaaaaaaaaaaaaaaaaaaaaaaaaaaaaaaaaaaaaaaaaaaaaaaaaagggggggggcccccaaaaaatccccccggggggcggccgccattgttgtcgcgcgcatccccccgcgtttttttggttgcaaccagggggggccccatatgtgggggggcggtttttaattgcagccgagggcggcggggcccgcgtgttttaacacgctggtggagggtggtggaaccgcccgctcgcgctggggacatcttgtgcggagaggagccccttccctgggggggggggcgcaccctgtcgtgcggcgcgctcttga

SEQ ID NO: 313251 - DNA, 655 bp, Homo sapiens
agtcggtaccgcacgagttcggagttcactgtaccggccgtgcgtcttagacatgtaaactatggctccatgctgtgtgacagatcaacgtgctgatggtaagtagactaggcttccccaggcatgccgtccgtgggggcctgaagagacagtgagtgccattggccccattcgcagatgtgggagactctgctcaggcctgtgaggctgggcagcccttcaccagagttcggaggagcagtgtgtggcgccacgtcccgactggccatacccacacagaagcagtgctgcccggggcctcatctgggccagcttggactctgcttcctccaggagcagcagggaagctctgggccacctccctggatagcaggaacttgacctgccatgtgtgccctgccttcctggccagctgtgcttgttatcttccattctcacaaactgtctttgaagcaatagaataaagaatgtgtgttttctttcctggtatacatacatgatcccatgctcccaagctccattcttccttccctcaactctctgccctccacagagctatggagaaggctggagatgaaagctttgtagtgaggactgataaagatctcatcactgctccttataataaacctaataaagcaagaaaccaaaaaaa

SEQ ID NO: 313252 - DNA, 806 bp, Homo sapiens
taaactgttggtgctgggcacatcacccaccctcaccaccaccaaagacactggtgcagtgagacttcgagtctgcaaaaaccccggggaggacaggaggcagggccactctccctgtgtgtcatcagcctgcagtgcctgaaactccagcctgtgcacctctggcaggatgccccacactgctccacaggtttggcggtgagttataaactatggctccatgctgtgtgacagatcaacgtgctgatggtaagtagactaggcttccccaggcatgccgtccgtgggggcctgaagagacagtgagtgccattggccccattcgcagatgtgggagactctgctcaggcctgtgaggctgggcagcccttcaccagagttcggaggagcagtgtgtggcgccacgtcccgactggccatacccacacagaagcagtgctgcccggggcctcatctgggccagcttggactctgcttcctccaggagcagcagggaagctctgggccacctccctggatagcaggaacttgacctgccatgtgtgccctgccttcctggccagctgtgcttgttatcttccattctcacaaactgtctttgaagcaatagaataaagaatgtgtgttttctttcctggtatacatacatgatcccatgctcccaagctccattcttccttccctcaactctctgccctccacagagctatggagaaggctggagatgaaagctttgtagtgaggactgataaagatctcatcactgctccttataataaacctaataaagcaagaaaccaaaaaaa

SEQ ID NO: 313253 - DNA, 1752 bp, Homo sapiens
ctaactagcaggaagtccggggttgacgatggctgtgttgttgaagggcctgtagccggggggttcctggccggatcccggtctacccttagcccagactcgttccggaccccagcccggcccggaacactctgggcgagacggcggtggcaactctccccttgccgccatgcacgacgctttcgagccagtgccgatcctagaaaagctgcctctgcaaatcgactgtctggctgcctgggaggaatggcttcttgtgggaaccaaacaaggacatcttcttctctataggattcggaaggacgttggttgcaacagatttgaagtgacactagagaaatccaataagaacttctccaaaaagattcagcagatccatgtggtttcccagtttaagattctggtcagcttgttagaaaataacatttatgtccatgacctattgacatttcaacaaatcactacggtttcaaaggcaaagggagcatcactgtttacttgtgacctccagcacacagagaccggtgaggaggtgttacggatgtgtgtggcagtaaaaaagaagctgcagctctatttctggaaggacagggaatttcatgaattgcagggggactttagtgtgccagatgtgcccaagtccatggcgtggtgtgaaaattctatctgtgtgggtttcaagagagactactacctaataagggtggatggaaaggggtccatcaaagagctctttccaacaggaaaacagctggagcccttagttgcacctctggcagatggaaaagtggctgtgggccaggatgatctcaccgtggtactcaatgaggaagggatctgcacacagaaatgtgccctgaactggacggacataccagtggccatggagcaccagcctccctacatcattgcagtgttgcctcgatatgttgagatccgaacatttgaaccgaggcttctggtccaaagcattgaattgcaaaggccccgtttcattacctcaggaggatcaaacattatctatgtggccagcaatcattttgtttggagactcatccctgtccccatggcaacccaaatccaacaacttctccaggacaagcagtttgaattggctctgcagctcgcagaaatgaaagatgattctgacagtgaaaagcagcaacaaattcatcacatcaagaacttgtatgccttcaacctcttctgccagaagcgttttgatgagtccatgcaggtctttgctaaacttggcacagatcccacccatgtgatgggcctgtaccctgacctgctgcccacagactacagaaagcagttgcagtatcccaacccattgcctgtgctctccggggctgaattggagaaggctcacttagctctgattgactacctgacacagaaacgaagtcaattggtaaagaagctgaatgactctgatcaccagtcaagcacctccctggatagcaggaacttgacctgccatgtgtgccctgccttcctggccagctgtgcttgttatcttccattctcacaaactgtctttgaagcaatagaataaagaatgtgtgttttctttcctggtatacatacatgatcccatgctcccaagctccattcttccttccctcaactctctgccctccacagagctatggagaaggctggagatgaaagctttgtagtgaggactgataaagatctcatcactgctccttataataaacctaataaagcaagaaaccaaaaaaa

SEQ ID NO: 313254 - DNA, 549 bp, Homo sapiens
agtaatcccagcactttgggaggctaaggcaggaggattgcttgagtccaggagtttgagaccagcctgggcaacacagggagacctcatctccacaaaaaataaacaaaattagccaggtgtggtggtgcatgcctgtagtcctagctactcaggaggctgaggtaggaggatcacttgactgcccggggcctcatctgggccagcttggactctgcttcctccaggagcagcagggaagctctgggccacctccctggatagcaggaacttgacctgccatgtgtgccctgccttcctggccagctgtgcttgttatcttccattctcacaaactgtctttgaagcaatagaataaagaatgtgtgttttctttcctggtatacatacatgatcccatgctcccaagctccattcttccttccctcaactctctgccctccacagagctatggagaaggctggagatgaaagctttgtagtgaggactgataaagatctcatcactgctccttataataaacctaataaagcaagaaaccaaaaaaa

SEQ ID NO: 313255 - DNA, 230 bp, Homo sapiens
ctccttgaagaaaaacccaagcaataagaatcctattgtcttccctttatattgcctcgtgtccactcctctgacagcatagcccccaccttgtgcttgcgtgatggcggcagtggttcctcatattccttttcctcctaggcctcttagaagaacgagctctcctgttggggcgcatggggaaacatgaacaagctcttttcatttatgtccacatcttgaaggataca

SEQ ID NO: 313256 - DNA, 387 bp, Homo sapiens
acaattacatgagtcgctatgagagtttggaggattatgggacaaaattagtaaaatggagtttagtaattgagaagatggctcctcacgttactgggtcgcattgtgaaacttcctggtggctttagacgagctgtctcttagtcatctttgcagcccgattaggggataatctggatgggacctgttgggccttaaaaatgtgagggaggctgggagaccaggtcacagcctggagaataccagtgacaaagacctacatcttgcctcaggaacacatcatccatgtttgggaggagacaggctctcggttccacaactgcctgatccagctatactgtgagaaggtgcaaggtctgatgaaggagtatctcctgtccttccctg

SEQ ID NO: 313257 - DNA, 386 bp, Homo sapiens
ggctgtctgctttctcttgcttgtgctacattcctggcctttcagcctagagcaggcctgggccagggaagggtggggctccccaggaagcagtttccactgaactcctgctctttctgcagacaaatgtggccctggtggcccccttgctacgcctggagaacaatcactgccacatcgaggagagcgagcacgtgctaaagaaggctcacaagtacagtgagcttatcatcctgtatgagaagaaggggctccacgagaaaggtgtgggagtggttccttggatctgggaggggctcttgtacatggcaggggaaacccactgagatatggaaatctcccgtggggaaaaggctcatgaccttgttcttgggcttggtggccag

SEQ ID NO: 313258 - DNA, 576 bp, Homo sapiens
tctgtagctcctagcatcttctctaacatcaagaacatactgaacaatatttgttgagtgagtgaactcttacatattctgctccgttattaggaaatgaaagatgattctgacagtgaaaagcagcaacaaattcatcacatcaagaacttgtatgccttcaacctcttctgccagaagcgttttgatgagtccatgcaggtctttgctaaacttggcacaggtaacaagtggtgaggcctttatataagggactaatggaggaggggagcctgaaaagtatggggagaaatgataacagacttctgagaatggagaaggtttaggctcagctaaattgatcctcatacctagcaagatcctgtggggtgaccacagtggttacatatctatactcctaatcctatgaatctggtcttctcaataaatgtggactcccaattttccagtatgatatgcccttgccattagagaaaggtagcagaaagtcattcagttcaacaaatgggtatttgatcagctagtgtttattgaatgctgttctgaaccaaagtccttggattaaactgcagatca

SEQ ID NO: 313259 - DNA, 612 bp, Homo sapiens
ctaactagcaggaagtccggggttgacgatggctgtgttgttgaagggcctgtagccggggggttcctggccggatcccggtctacccttagcccagactcgttccggaccccagcccggcccggaacactctgggcgagacggcggtggcaactctccccttgccgccatgcacgacgctttcgagccagtgccgatcctagaaaagctgcctctgcaaatcgactgtctggctgcctgggaggaatggcttcttgtgggaaccaaacaaggacatcttcttctctataggattcggaaggacgttggttgcaacagatttgaagtgacactagagaaatccaataagaacttctccaaaaagattcagcaggtaagcagtgatggcagtccttacaagaatatttgacttacatgagaccctgtcagactagaactttggtaatgttatttattaactctgaatcctcttctctttgaccttctatttatgcaggagtgtctgctcatatatcatgtgcctgagatcctctctcacaagcagaaatgataatcacagaaattatagtgcccagaaaaatcagtgagatccctgtaactggataggctccg

SEQ ID NO: 313260 - DNA, 4883 bp, Homo sapiens
ctaactagcaggaagtccggggttgacgatggctgtgttgttgaagggcctgtagccggggggttcctggccggatcccggtctacccttagcccagactcgttccggaccccagcccggcccggaacactctgggcgagacggcggtggcaactctccccttgccgccatgcacgacgctttcgagccagtgccgatcctagaaaagctgcctctgcaaatcgactgtctggctgcctgggaggaatggcttcttgtgggaaccaaacaaggacatcttcttctctataggattcggaaggacgttgtgccagcagatgtagcatcacctgaaagcggcagttgcaacagatttgaagtgacactagagaaatccaataagaacttctccaaaaagattcagcagatccatgtggtttcccagtttaagattctggtcagcttgttagaaaataacatttatgtccatgacctattgacatttcaacaaatcactacggtttcaaaggcaaagggagcatcactgtttacttgtgacctccagcacacagagaccggtgaggaggtgttacggatgtgtgtggcagtaaaaaagaagctgcagctctatttctggaaggacagggaatttcatgaattgcagggggactttagtgtgccagatgtgcccaagtccatggcgtggtgtgaaaattctatctgtgtgggtttcaagagagactactacctaataagggtggatggaaaggggtccatcaaagagctctttccaacaggaaaacagctggagcccttagttgcacctctggcagatggaaaagtggctgtgggccaggatgatctcaccgtggtactcaatgaggaagggatctgcacacagaaatgtgccctgaactggacggacataccagtggccatggagcaccagcctccctacatcattgcagtgttgcctcgatatgttgagatccgaacatttgaaccgaggcttctggtccaaagcattgaattgcaaaggccccgtttcattacctcaggaggatcaaacattatctatgtggccagcaatcattttgtttggagactcatccctgtccccatggcaacccaaatccaacaacttctccaggacaagcagtttgaattggctctgcagctcgcagaaatgaaagatgattctgacagtgaaaagcagcaacaaattcatcacatcaagaacttgtatgccttcaacctcttctgccagaagcgttttgatgagtccatgcaggtctttgctaaacttggcacagatcccacccatgtgatgggcctgtaccctgacctgctgcccacagactacagaaagcagttgcagtatcccaacccattgcctgtgctctccggggctgaattggagaaggctcacttagctctgattgactacctgacacagaaacgaagtcaattggtaaagaagctgaatgactctgatcaccagtcaagcacctcaccgctcatggaaggcactcccaccatcaaatccaagaagaagctgctacaaatcatcgacaccaccctgctcaagtgctatctccatacaaatgtggccctggtggcccccttgctacgcctggagaacaatcactgccacatcgaggagagcgagcacgtgctaaagaaggctcacaagtacagtgagcttatcatcctgtatgagaagaaggggctccacgagaaagctctgcaggtgctcgtggaccagtccaagaaagccaactcccctctgaaaggccacgagaggacagtgcagtatctgcagcatctgggcacagaaaacctgcatttgattttctcctactcagtgtgggtgctgagagacttcccagaagatggcctgaagatatttactgaagatctcccggaagtggagtctctgccacgtgatcgagtcctcggcttcttaatagagaattttaagggtctggctattccttatctggaacacatcatccatgtttgggaggagacaggctctcggttccacaactgcctgatccagctatactgtgagaaggtgcaaggtctgatgaaggagtatctcctgtccttccctgcaggcaaaaccccagtcccagctggagaggaagagggtgagctgggagaataccggcaaaagctcctcatgttcttggagatttccagctactatgatccaggccggctcatctgtgattttccctttgatggcctcttagaagaacgagctctcctgttggggcgcatggggaaacatgaacaagctcttttcatttatgtccacatcttgaaggatacaaggatggctgaggagtactgccacaaacactatgaccgaaacaaagatggcaacaaagatgtgtatctgtccctgcttcggatgtacctgtcgccccccagcattcactgcctggggccaatcaagctggaactactggagccaaaagccaacctccaggccgctctgcaggtcctcgagctacaccacagcaaactggacaccaccaaggccctcaaccttctgccagcaaacactcagatcaatgacatacgcatcttcctggaaaaggtcttggaagaaaatgcacaaaagaaacggttcaatcaagtgctcaagaaccttctccatgcagaattcctgagggtccaggaagagcggattttacaccagcaggtgaagtgcatcatcacagaggagaaggtgtgcatggtgtgtaagaagaagattgggaacagtgcatttgcaagataccccaatggagtggtcgtccattacttctgttccaaagaggtaaacccagctgacacttgagcccagcatcctggggatccagcggatggacagcttggctctcccagagaggtgaaggagcacctggccttaggaatcctggctgccaccaccacaaggctccccatttggacattactggctatcttgtgccctggaacaactctgaattaattagactcatggtctggcattgccagctttttaatgggaaaagagattagttataccttataccattatgttgtgggcaattccagagaattcagtacctgcttggtcaggaggatgtgcaccatcttgcctttgcacaccagtcacctgaacaaggaaacttgtcacaagtgtttgtaaccatggggttgttcatcaagggcttttctattaagtacatgacttcacaaggaccgctcagcatggctcactggagagttccatgagagaacagcactcaagcttctggccgcatggacccgatggctcgcattctgtgtagtgttttacgtctccatggtaactgtgccctgcacccctcggtagccgccctgttagttttcagtctccttttctttctcaccatttatcacttccctcactgccctacccaggctttctctcccacttccctgactctgggaataactaatatttaagcaaggtaagatgagaagcaaggggtctcagttctaggaatacagtgctagttgattgtcaggtatgttgtaaatagaccctctttggccatacactccatgcctagatgcctcggagagcatcattctctgcctaggcaaggccctgcatcccttgcctcaggccgggctgagtgtgactgcagctcctgaggatgggcctgccctgtctggggtatgcgtgatccctagatacatgttcccacagaggtgcctgctccgtcttcgctcaccagacactcaggcaggctggcttagtctttgtgcgtggcgattttgtgctctgggccctttctctttttccagccagtttccattcacttgccttacagcctgccctggccgtcactccccagctttgttcagcaatggtgtggttggagagttgtgctgggatagcgcaggaaggtgggtcccggcaacacgcaggggatgagtggacctggaactgacaatggcgtgctgccaagtgttcctgagaggtgtttaggcacagcagaggggacgcggggggcaagaacagcaggacgctggtttaaaaataactcaccgccaaacctgtggagcagtgtggggcatcctgccagaggtgcacaggctggagtttcaggcactgcaggctgatgacacacagggagagtggccctgcctcctgtcctccccggggtttttgcagactcgaagtctcactgcaccagtgtctttgatggtggtgagggtgggtgatggtgcccagcaccaacagttttagtggcctgtccttgacctgccgtggtcctttgtaaactatggctccatgctgtgtgacagatcaacgtgctgatggtaagtagactaggcttccccaggcatgccgtccgtgggggcctgaagagacagtgagtgccattggccccattcgcagatgtgggagactctgctcaggcctgtgaggctgggcagcccttcaccagagttcggaggagcagtgtgtggcgccacgtcccgactggccatacccacacagaagcagtgctgcccggggcctcatctgggccagcttggactctgcttcctccaggagcagcagggaagctctgggccacctccctggatagcaggaacttgacctgccatgtgtgccctgccttcctggccagctgtgcttgttatcttccattctcacaaactgtctttgaagcaatagaataaagaatgtgtgttttctttcctggtatacatacatgatcccatgctcccaagctccattcttccttccctcaactctctgccctccacagagctatggagaaggctggagatgaaagctttgtagtgaggactgataaagatctcatcactgctccttataataaacctaataaagcaagaaaccaaaaaaa

SEQ ID NO: 313261 - DNA, 4842 bp, Homo sapiens
ctaactagcaggaagtccggggttgacgatggctgtgttgttgaagggcctgtagccggggggttcctggccggatcccggtctacccttagcccagactcgttccggaccccagcccggcccggaacactctgggcgagacggcggtggcaactctccccttgccgccatgcacgacgctttcgagccagtgccgatcctagaaaagctgcctctgcaaatcgactgtctggctgcctgggaggaatggcttcttgtgggaaccaaacaaggacatcttcttctctataggattcggaaggacgttgtgccagcagatgtagcatcacctgaaagcggcagttgcaacagatttgaagtgacactagagaaatccaataagaacttctccaaaaagattcagcagatccatgtggtttcccagtttaagattctggtcagcttgttagaaaataacatttatgtccatgacctattgacatttcaacaaatcactacggtttcaaaggcaaagggagcatcactgtttacttgtgacctccagcacacagagaccggtgaggaggtgttacggatgtgtgtggcagtaaaaaagaagctgcagctctatttctggaaggacagggaatttcatgaattgcagggggactttagtgtgccagatgtgcccaagtccatggcgtggtgtgaaaattctatctgtgtgggtttcaagagagactactacctaataagggtggatggaaaggggtccatcaaagagctctttccaacaggaaaacagctggagcccttagttgcacctctggcagatggaaaagtggctgtgggccaggatgatctcaccgtggtactcaatgaggaagggatctgcacacagaaatgtgccctgaactggacggacataccagtggccatggagcaccagcctccctacatcattgcagtgttgcctcgatatgttgagatccgaacatttgaaccgaggcttctggtccaaagcattgaattgcaaaggccccgtttcattacctcaggaggatcaaacattatctatgtggccagcaatcattttgtttggagactcatccctgtccccatggcaacccaaatccaacaacttctccaggacaagcagtttgaattggctctgcagctcgcagaaatgaaagatgattctgacagtgaaaagcagcaacaaattcatcacatcaagaacttgtatgccttcaacctcttctgccagaagcgttttgatgagtccatgcaggtctttgctaaacttggcacagatcccacccatgtgatgggcctgtaccctgacctgctgcccacagactacagaaagcagttgcagtatcccaacccattgcctgtgctctccggggctgaattggagaaggctcacttagctctgattgactacctgacacagaaacgaagtcaattggtaaagaagctgaatgactctgatcaccagtcaagcacctcaccgctcatggaaggcactcccaccatcaaatccaagaagaagctgctacaaatcatcgacaccaccctgctcaagtgctatctccatacaaatgtggccctggtggcccccttgctacgcctggagaacaatcactgccacatcgaggagagcgagcacgtgctaaagaaggctcacaagtacagtgagcttatcatcctgtatgagaagaaggggctccacgagaaagctctgcaggtgctcgtggaccagtccaagaaagccaactcccctctgaaaggccacgagaggacagtgcagtatctgcagcatctgggcacagaaaacctgcatttgattttctcctactcagtgtgggtgctgagagacttcccagaagatggcctgaagatatttactgaagatctcccggaagtggagtctctgccacgtgatcgagtcctcggcttcttaatagagaattttaagggtctggctattccttatctggaacacatcatccatgtttgggaggagacaggctctcggttccacaactgcctgatccagctatactgtgagaaggtgcaaggtctgatgaaggagtatctcctgtccttccctgcaggcaaaaccccagtcccagctggagaggaagagggtgagctgggagaataccggcaaaagctcctcatgttcttggagatttccagctactatgatccaggccggctcatctgtgattttccctttgatggcctcttagaagaacgagctctcctgttggggcgcatggggaaacatgaacaagctcttttcatttatgtccacatcttgaaggatacaaggatggctgaggagtactgccacaaacactatgaccgaaacaaagatggcaacaaagatgtgtatctgtccctgcttcggatgtacctgtcgccccccagcattcactgcctggggccaatcaagctggaactactggagccaaaagccaacctccaggccgctctgcaggtcctcgagctacaccacagcaaactggacaccaccaaggccctcaaccttctgccagcaaacactcagatcaatgacatacgcatcttcctggaaaaggtcttggaagaaaatgcacaaaagaaacggttcaatcaagtgctcaagaaccttctccatgcagaattcctgagggtccaggaagagcggattttacaccagcaggtgaagtgcatcatcacagaggagaaggtgtgcatggtgtgtaagaagaagattgggaacagtgcatttgcaagataccccaatggagtggtcgtccattacttctgttccaaagaggtaaacccagctgacacttgagcccagcatcctggggatccagcggatggacagcttggctctcccagagaggtgaaggagcacctggccttaggaatcctggctgccaccaccacaaggctccccatttggacattactggctatcttgtgccctggaacaactctgaattaattagactcatggtctggcattgccagctttttaatgggaaaagagattagttataccttataccattatgttgtgggcaattccagagaattcagtacctgcttggtcaggaggatgtgcaccatcttgcctttgcacaccagtcacctgaacaaggaaacttgtcacaagtgtttgtaaccatggggttgttcatcaagggcttttctattaagtacatgacttcacaaggaccgctcagcatggctcactggagagttccatgagagaacagcactcaagcttctggccgcatggacccgatggctcgcattctgtgtagtgttttacgtctccatggtaactgtgccctgcacccctcggtagccgccctgttagttttcagtctccttttctttctcaccatttatcacttccctcactgccctacccaggctttctctcccacttccctgactctgggaataactaatatttaagcaaggtaagatgagaagcaaggggtctcagttctaggaatacagtgctagttgattgtcaggtatgttgtaaatagaccctctttggccatacactccatgcctagatgcctcggagagcatcattctctgcctaggcaaggccctgcatcccttgcctcaggccgggctgagtgtgactgcagctcctgaggatgggcctgccctgtctggggtatgcgtgatccctagatacatgttcccacagaggtgcctgctccgtcttcgctcaccagacactcaggcaggctggcttagtctttgtgcgtggcgattttgtgctctgggccctttctctttttccagccagtttccattcacttgccttacagcctgccctggccgtcactccccagctttgttcagcaatggtgtggttggagagttgtgctgggatagcgcaggaaggtgggtcccggcaacacgcaggggatgagtggacctggaactgacaatggcgtgctgccaagtgttcctgagaggtgtttaggcacagcagaggggacgcggggggcaagaacagcaggacgctggtttaaaaataactcaccgccaaacctgtggagcagtgtggggcatcctgccagaggtgcacaggctggagtttcaggcactgcaggctgatgacacacagggagagtggccctgcctcctgtcctccccggggtttttgcagactcgaagtctcactgcaccagtgtctttgatggtggtgagggtgggtgatggtgcccagcaccaacagttttagtggcctgtccttgacctgccgtggtcctttgtaaactatggctccatgctgtgtgacagatcaacgtgctgatggtaagtagactaggcttccccaggcatgccgtccgtgggggcctgaagagacagtgagtgccattggccccattcgcagatgtgggagactctgctcaggcctgtgaggctgggcagcccttcaccagagttcggaggagcagtgtgtggcgccacgtcccgactggccatacccacacagaagcagtgctgcccggggcctcatctgggccagcttggactctgcttcctccaggagcagcagggaagctctgggccacctccctggatagcaggaacttgacctgccatgtgtgccctgccttcctggccagctgtgcttgttatcttccattctcacaaactgtctttgaagcaatagaataaagaatgtgtgttttctttcctggtatacatacatgatcccatgctcccaagctccattcttccttccctcaactctctgccctccacagagctatggagaaggctggagatgaaagctttgtagtgaggactgataaagatctcatcact

SEQ ID NO: 313262 - DNA, 4031 bp, Homo sapiens
caagggggtcataaaacccaggagagatgtgtccctaaacaggaacgagacataccagttggccatggagcaccagcctccctacatcattgcagtgttgcctcgatatgttgagatccgaacatttgaaccgaggcttctggtccaaagcattgaattgcaaaggccccgtttcattacctcaggaggatcaaacattatctatgtggccagcaatcattttgtttggagactcatccctgtccccatggcaacccaaatccaacaacttctccaggacaagcagtttgaattggctctgcagctcgcagaaatgaaagatgattctgacagtgaaaagcagcaacaaattcatcacatcaagaacttgtatgccttcaacctcttctgccagaagcgttttgatgagtccatgcaggtctttgctaaacttggcacagatcccacccatgtgatgggcctgtaccctgacctgctgcccacagactacagaaagcagttgcagtatcccaacccattgcctgtgctctccggggctgaattggagaaggctcacttagctctgattgactacctgacacagaaacgaagtcaattggtaaagaagctgaatgactctgatcaccagtcaagcacctcaccgctcatggaaggcactcccaccatcaaatccaagaagaagctgctacaaatcatcgacaccaccctgctcaagtgctatctccatacaaatgtggccctggtggcccccttgctacgcctggagaacaatcactgccacatcgaggagagcgagcacgtgctaaagaaggctcacaagtacagtgagcttatcatcctgtatgagaagaaggggctccacgagaaagctctgcaggtgctcgtggaccagtccaagaaagccaactcccctctgaaaggccacgagaggacagtgcagtatctgcagcatctgggcacagaaaacctgcatttgattttctcctactcagtgtgggtgctgagagacttcccagaagatggcctgaagatatttactgaagatctcccggaagtggagtctctgccacgtgatcgagtcctcggcttcttaatagagaattttaagggtctggctattccttatctggaacacatcatccatgtttgggaggagacaggctctcggttccacaactgcctgatccagctatactgtgagaaggtgcaaggtctgatgaaggagtatctcctgtccttccctgcaggcaaaaccccagtcccagctggagaggaagagggtgagctgggagaataccggcaaaagctcctcatgttcttggagatttccagctactatgatccaggccggctcatctgtgattttccctttgatggcctcttagaagaacgagctctcctgttggggcgcatggggaaacatgaacaagctcttttcatttatgtccacatcttgaaggatacaaggatggctgaggagtactgccacaaacactatgaccgaaacaaagatggcaacaaagatgtgtatctgtccctgcttcggatgtacctgtcgccccccagcattcactgcctggggccaatcaagctggaactactggagccaaaagccaacctccaggccgctctgcaggtcctcgagctacaccacagcaaactggacaccaccaaggccctcaaccttctgccagcaaacactcagatcaatgacatacgcatcttcctggaaaaggtcttggaagaaaatgcacaaaagaaacggttcaatcaagtgctcaagaaccttctccatgcagaattcctgagggtccaggaagagcggattttacaccagcaggtgaagtgcatcatcacagaggagaaggtgtgcatggtgtgtaagaagaagattgggaacagtgcatttgcaagataccccaatggagtggtcgtccattacttctgttccaaagaggtaaacccagctgacacttgagcccagcatcctggggatccagcggatggacagcttggctctcccagagaggtgaaggagcacctggccttaggaatcctggctgccaccaccacaaggctccccatttggacattactggctatcttgtgccctggaacaactctgaattaattagactcatggtctggcattgccagctttttaatgggaaaagagattagttataccttataccattatgttgtgggcaattccagagaattcagtacctgcttggtcaggaggatgtgcaccatcttgcctttgcacaccagtcacctgaacaaggaaacttgtcacaagtgtttgtaaccatggggttgttcatcaagggcttttctattaagtacatgacttcacaaggaccgctcagcatggctcactggagagttccatgagagaacagcactcaagcttctggccgcatggacccgatggctcgcattctgtgtagtgttttacgtctccatggtaactgtgccctgcacccctcggtagccgccctgttagttttcagtctccttttctttctcaccatttatcacttccctcactgccctacccaggctttctctcccacttccctgactctgggaataactaatatttaagcaaggtaagatgagaagcaaggggtctcagttctaggaatacagtgctagttgattgtcaggtatgttgtaaatagaccctctttggccatacactccatgcctagatgcctcggagagcatcattctctgcctaggcaaggccctgcatcccttgcctcaggccgggctgagtgtgactgcagctcctgaggatgggcctgccctgtctggggtatgcgtgatccctagatacatgttcccacagaggtgcctgctccgtcttcgctcaccagacactcaggcaggctggcttagtctttgtgcgtggcgattttgtgctctgggccctttctctttttccagccagtttccattcacttgccttacagcctgccctggccgtcactccccagctttgttcagcaatggtgtggttggagagttgtgctgggatagcgcaggaaggtgggtcccggcaacacgcaggggatgagtggacctggaactgacaatggcgtgctgccaagtgttcctgagaggtgtttaggcacagcagaggggacgcggggggcaagaacagcaggacgctggtttaaaaataactcaccgccaaacctgtggagcagtgtggggcatcctgccagaggtgcacaggctggagtttcaggcactgcaggctgatgacacacagggagagtggccctgcctcctgtcctccccggggtttttgcagactcgaagtctcactgcaccagtgtctttgatggtggtgagggtgggtgatggtgcccagcaccaacagttttagtggcctgtccttgacctgccgtggtcctttgtaaactatggctccatgctgtgtgacagatcaacgtgctgatggtaagtagactaggcttccccaggcatgccgtccgtgggggcctgaagagacagtgagtgccattggccccattcgcagatgtgggagactctgctcaggcctgtgaggctgggcagcccttcaccagagttcggaggagcagtgtgtggcgccacgtcccgactggccatacccacacagaagcagtgctgcccggggcctcatctgggccagcttggactctgcttcctccaggagcagcagggaagctctgggccacctccctggatagcaggaacttgacctgccatgtgtgccctgccttcctggccagctgtgcttgttatcttccattctcacaaactgtctttgaagcaatagaataaagaatgtgtgttttctttcctggtatacatacatgatcccatgctcccaagctccattcttccttccctcaactctctgccctccacagagctatggagaaggctggagatgaaagctttgtagtgaggactgataaagatctcatcactgctccttataataaacctaataaagcaagaaaccaaaaaaa

SEQ ID NO: 313263 - DNA, 4841 bp, Homo sapiens
ctaactagcaggaagtccggggttgacgatggctgtgttgttgaagggcctgtagccggggggttcctggccggatcccggtctacccttagcccagactcgttccggaccccagcccggcccggaacactctgggcgagacggcggtggcaactctccccttgccgccatgcacgacgctttcgagccagtgccgatcctagaaaagctgcctctgcaaatcgactgtctggctgcctgggaggaatggcttcttgtgggaaccaaacaaggacatcttcttctctataggattcggaaggacgttgtgccagcagatgtagcatcacctgaaagcggcagttgcaacagatttgaagtgacactagagaaatccaataagaacttctccaaaaagattcagcagatccatgtggtttcccagtttaagattctggtcagcttgttagaaaataacatttatgtccatgacctattgacatttcaacaaatcactacggtttcaaaggcaaagggagcatcactgtttacttgtgacctccagcacacagagaccggtgaggaggtgttacggatgtgtgtggcagtaaaaaagaagctgcagctctatttctggaaggacagggaatttcatgaattgcagggggactttagtgtgccagatgtgcccaagtccatggcgtggtgtgaaaattctatctgtgtgggtttcaagagagactactacctaataagggtggatggaaaggggtccatcaaagagctctttccaacaggaaaacagctggagcccttagttgcacctctggcagatggaaaagtggctgtgggccaggatgatctcaccgtggtactcaatgaggaagggatctgcacacagaaatgtgccctgaactggacggacataccagtggccatggagcaccagcctccctacatcattgcagtgttgcctcgatatgttgagatccgaacatttgaaccgaggcttctggtccaaagcattgaattgcaaaggccccgtttcattacctcaggaggatcaaacattatctatgtggccagcaatcattttgtttggagactcatccctgtccccatggcaacccaaatccaacaacttctccaggacaagcagtttgaattggctctgcagctcgcagaaatgaaagatgattctgacagtgaaaagcagcaacaaattcatcacatcaagaacttgtatgccttcaacctcttctgccagaagcgttttgatgagtccatgcaggtctttgctaaacttggcacagatcccacccatgtgatgggcctgtaccctgacctgctgcccacagactacagaaagcagttgcagtatcccaacccattgcctgtgctctccggggctgaattggagaaggctcacttagctctgattgactacctgacacagaaacgaagtcaattggtaaagaagctgaatgactctgatcaccagtcaagcacctcaccgctcatggaaggcactcccaccatcaaatccaagaagaagctgctacaaatcatcgacaccaccctgctcaagtgctatctccatacaaatgtggccctggtggcccccttgctacgcctggagaacaatcactgccacatcgaggagagcgagcacgtgctaaagaaggctcacaagtacagtgagcttatcatcctgtatgagaagaaggggctccacgagaaagctctgcaggtgctcgtggaccagtccaagaaagccaactcccctctgaaaggccacgagaggacagtgcagtatctgcagcatctgggcacagaaaacctgcatttgattttctcctactcagtgtgggtgctgagagacttcccagaagatggcctgaagatatttactgaagatctcccggaagtggagtctctgccacgtgatcgagtcctcggcttcttaatagagaattttaagggtctggctattccttatctggaacacatcatccatgtttgggaggagacaggctctcggttccacaactgcctgatccagctatactgtgagaaggtgcaaggtctgatgaaggagtatctcctgtccttccctgcaggcaaaaccccagtcccagctggagaggaagagggtgagctgggagaataccggcaaaagctcctcatgttcttggagatttccagctactatgatccaggccggctcatctgtgattttccctttgatggcctcttagaagaacgagctctcctgttggggcgcatggggaaacatgaacaagctcttttcatttatgtccacatcttgaaggatacaaggatggctgaggagtactgccacaaacactatgaccgaaacaaagatggcaacaaagatgtgtatctgtccctgcttcggatgtacctgtcgccccccagcattcactgcctggggccaatcaagctggaactactggagccaaaagccaacctccaggccgctctgcaggtcctcgagctacaccacagcaaactggacaccaccaaggccctcaaccttctgccagcaaacactcagatcaatgacatacgcatcttcctggaaaaggtcttggaagaaaatgcacaaaagaaacggttcaatcaagtgctcaagaaccttctccatgcagaattcctgagggtccaggaagagcggattttacaccagcaggtgaagtgcatcatcacagaggagaaggtgtgcatggtgtgtaagaagaagattgggaacagtgcatttgcaagataccccaatggagtggtcgtccattacttctgttccaaagaggtaaacccagctgacacttgagcccagcatcctggggatccagcggatggacagcttggctctcccagagaggtgaaggagcacctggccttaggaatcctggctgccaccaccacaaggctccccatttggacattactggctatcttgtgccctggaacaactctgaattaattagactcatggtctggcattgccagctttttaatgggaaaagagattagttataccttataccattatgttgtgggcaattccagagaattcagtacctgcttggtcaggaggatgtgcaccatcttgcctttgcacaccagtcacctgaacaaggaaacttgtcacaagtgtttgtaaccatggggttgttcatcaagggcttttctattaagtacatgacttcacaaggaccgctcagcatggctcactggagagttccatgagagaacagcactcaagcttctggccgcatggacccgatggctcgcattctgtgtagtgttttacgtctccatggtaactgtgccctgcacccctcggtagccgccctgttagttttcagtctccttttctttctcaccatttatcacttccctcactgccctacccaggctttctctcccacttccctgactctgggaataactaatatttaagcaaggtaagatgagaagcaaggggtctcagttctaggaatacagtgctagttgattgtcaggtatgttgtaaatagaccctctttggccatacactccatgcctagatgcctcggagagcatcattctctgcctaggcaaggccctgcatcccttgcctcaggccgggctgagtgtgactgcagctcctgaggatgggcctgccctgtctggggtatgcgtgatccctagatacatgttcccacagaggtgcctgctccgtcttcgctcaccagacactcaggcaggctggcttagtctttgtgcgtggcgattttgtgctctgggccctttctctttttccagccagtttccattcacttgccttacagcctgccctggccgtcactccccagctttgttcagcaatggtgtggttggagagttgtgctgggatagcgcaggaaggtgggtcccggcaacacgcaggggatgagtggacctggaactgacaatggcgtgctgccaagtgttcctgagaggtgtttaggcacagcagaggggacgcggggggcaagaacagcaggacgctggtttaaaaataactcaccgccaaacctgtggagcagtgtggggcatcctgccagaggtgcacaggctggagtttcaggcactgcaggctgatgacacacagggagagtggccctgcctcctgtcctccccggggtttttgcagactcgaagtctcactgcaccagtgtctttgatggtggtgagggtgggtgatggtgcccagcaccaacagttttagtggcctgtccttgacctgccgtggtcctttgtaaactatggctccatgctgtgtgacagatcaacgtgctgatggtaagtagactaggcttccccaggcatgccgtccgtgggggcctgaagagacagtgagtgccattggccccattcgcagatgtgggagactctgctcaggcctgtgaggctgggcagcccttcaccagagttcggaggagcagtgtgtggcgccacgtcccgactggccatacccacacagaagcagtgctgcccggggcctcatctgggccagcttggactctgcttcctccaggagcagcagggaagctctgggccacctccctggatagcaggaacttgacctgccatgtgtgccctgccttcctggccagctgtgcttgttatcttccattctcacaaactgtctttgaagcaatagaataaagaatgtgtgttttctttcctggtatacatacatgatcccatgctcccaagctccattcttccttccctcaactctctgccctccacagagctatggggaggcggggagcaacttggaggggagggaaagtcatagggctttataactg

SEQ ID NO: 313264 - DNA, 4450 bp, Homo sapiens
  misc_feature (4447)..(4447): n is a, c, g, or t
ctaactagcaggaagtccggggttgacgatggctgtgttgttgaagggcctgtagccggggggttcctggccggatcccggtctacccttagcccagactcgttccggaccccagcccggcccggaacactctgggcgagacggcggtggcaactctccccttgccgccatgcacgacgctttcgagccagtgccgatcctagaaaagctgcctctgcaaatcgactgtctggctgcctgggaggaatggcttcttgtgggaaccaaacaaggacatcttcttctctataggattcggaaggacgttgtgccagcagatgtagcatcacctgaaagcggcagttgcaacagatttgaagtgacactagagaaatccaataagaacttctccaaaaagattcagcagatccatgtggtttcccagtttaagattctggtcagcttgttagaaaataacatttatgtccatgacctattgacatttcaacaaatcactacggtttcaaaggcaaagggagcatcactgtttacttgtgacctccagcacacagagaccggtgaggaggtgttacggatgtgtgtggcagtaaaaaagaagctgcagctctatttctggaaggacagggaatttcatgaattgcagggggactttagtgtgccagatgtgcccaagtccatggcgtggtgtgaaaattctatctgtgtgggtttcaagagagactactacctaataagggtggatggaaaggggtccatcaaagagctctttccaacaggaaaacagctggagcccttagttgcacctctggcagatggaaaagtggctgtgggccaggatgatctcaccgtggtactcaatgaggaagggatctgcacacagaaatgtgccctgaactggacggacataccagtggccatggagcaccagcctccctacatcattgcagtgttgcctcgatatgttgagatccgaacatttgaaccgaggcttctggtccaaagcattgaattgcaaaggccccgtttcattacctcaggaggatcaaacattatctatgtggccagcaatcattttgtttggagactcatccctgtccccatggcaacccaaatccaacaacttctccaggacaagcagtttgaattggctctgcagctcgcagaaatgaaagatgattctgacagtgaaaagcagcaacaaattcatcacatcaagaacttgtatgccttcaacctcttctgccagaagcgttttgatgagtccatgcaggtctttgctaaacttggcacagatcccacccatgtgatgggcctgtaccctgacctgctgcccacagactacagaaagcagttgcagtatcccaacccattgcctgtgctctccggggctgaattggagaaggctcacttagctctgattgactacctgacacagaaacgaagtcaattggtaaagaagctgaatgactctgatcaccagtcaagcacctcaccgctcatggaaggcactcccaccatcaaatccaagaagaagctgctacaaatcatcgacaccaccctgctcaagtgctatctccatacaaatgtggccctggtggcccccttgctacgcctggagaacaatcactgccacatcgaggagagcgagcacgtgctaaagaaggctcacaagtacagtgagcttatcatcctgtatgagaagaaggggctccacgagaaagctctgcaggtgctcgtggaccagtccaagaaagccaactcccctctgaaaggccacgagaggacagtgcagtatctgcagcatctgggcacagaaaacctgcatttgattttctcctactcagtgtgggtgctgagagacttcccagaagatggcctgaagatatttactgaagatctcccggaagtggagtctctgccacgtgatcgagtcctcggcttcttaatagagaattttaagggtctggctattccttatctggaacacatcatccatgtttgggaggagacaggctctcggttccacaactgcctgatccagctatactgtgagaaggtgcaaggtctgatgaaggagtatctcctgtccttccctgcaggcaaaaccccagtcccagctggagaggaagagggtgagctgggagaataccggcaaaagctcctcatgttcttggagatttccagctactatgatccaggccggctcatctgtgattttccctttgatggcctcttagaagaacgagctctcctgttggggcgcatggggaaacatgaacaagctcttttcatttatgtccacatcttgaaggatacaaggatggctgaggagtactgccacaaacactatgaccgaaacaaagatggcaacaaagatgtgtatctgtccctgcttcggatgtacctgtcgccccccagcattcactgcctggggccaatcaagctggaactactggagccaaaagccaacctccaggccgctctgcaggtcctcgagctacaccacagcaaactggacaccaccaaggccctcaaccttctgccagcaaacactcagatcaatgacatacgcatcttcctggaaaaggtcttggaagaaaatgcacaaaagaaacggttcaatcaagtgctcaagaaccttctccatgcagaattcctgagggtccaggaagagcggattttacaccagcaggtgaagtgcatcatcacagaggagaaggtgtgcatggtgtgtaagaagaagattgggaacagtgcatttgcaagataccccaatggagtggtcgtccattacttctgttccaaagaggtaaacccagctgacacttgagcccagcatcctggggatccagcggatggacagcttggctctcccagagaggtgaaggagcacctggccttaggaatcctggctgccaccaccacaaggctccccatttggacattactggctatcttgtgccctggaacaactctgaattaattagactcatggtctggcattgccagctttttaatgggaaaagagattagttataccttataccattatgttgtgggcaattccagagaattcagtacctgcttggtcaggaggatgtgcaccatcttgcctttgcacaccagtcacctgaacaaggaaacttgtcacaagtgtttgtaaccatggggttgttcatcaagggcttttctattaagtacatgacttcacaaggaccgctcagcatggctcactggagagttccatgagagaacagcactcaagcttctggccgcatggacccgatggctcgcattctgtgtagtgttttacgtctccatggtaactgtgccctgcacccctcggtagccgccctgttagttttcagtctccttttctttctcaccatttatcacttccctcactgccctacccaggctttctctcccacttccctgactctgggaataactaatatttaagcaaggtaagatgagaagcaaggggtctcagttctaggaatacagtgctagttgattgtcaggtatgttgtaaatagaccctctttggccatacactccatgcctagatgcctcggagagcatcattctctgcctaggcaaggccctgcatcccttgcctcaggccgggctgagtgtgactgcagctcctgaggatgggcctgccctgtctggggtatgcgtgatccctagatacatgttcccacagaggtgcctgctccgtcttcgctcaccagacactcaggcaggctggcttagtctttgtgcgtggcgattttgtgctctgggccctttctctttttccagccagtttccattcacttgccttacagcctgccctggccgtcactccccagctttgttcagcaatggtgtggttggagagttgtgctgggatagcgcaggaaggtgggtcccggcaacacgcaggggatgagtggacctggaactgacaatggcgtgctgccaagtgttcctgagaggtgtttaggcacagcagaggggacgcggggggcaagaacagcaggacgctggtttaaaaataactcaccgccaaacctgtggagcagtgtggggcatcctgccagaggtgcacaggctggagtttcaggcactgcaggctgatgacacacagggagagtggccctgcctcctgtcctccccggggtttttgcagactcgaagtctcactgcaccagtgtctttgatggtggtgagggtgggtgatggtgcccagcaccaacagttttagtggcctgtccttgacctgccgtggtcctttgtaaactatggctccatgctgtgtgacagatcaacgtgctgatggtaagtagactaggcttccccaggcatgccgtccgtgggggcctgaagagacagtgagtgcacacactgcactccgaatctggtgaagggctgccagctccaggctgagcagaggggtccnaac

SEQ ID NO: 313265 - DNA, 1050 bp, Homo sapiens
gtctggggaaatgtgccagcagaagcggagcaactatcctgcttctgctcgggcccctcatgagacgcggcagaggccatcagccggcaacacgcaggggatgagtggacctggaactgacaatggcgtgctgccaagtgttcctgagaggtgtttaggcacagcagaggggacgcggggggcaagaacagcaggacgctggtttaaaaataactcaccgccaaacctgtggagcagtgtggggcatcctgccagaggtgcacaggctggagtttcaggcactgcaggctgatgacacacagggagagtggccctgcctcctgtcctccccggggtttttgcagactcgaagtctcactgcaccagtgtctttgatggtggtgagggtgggtgatggtgcccagcaccaacagttttagtggcctgtccttgacctgccgtggtcctttgtaaactatggctccatgctgtgtgacagatcaacgtgctgatggtaagtagactaggcttccccaggcatgccgtccgtgggggcctgaagagacagtgagtgccattggccccattcgcagatgtgggagactctgctcaggcctgtgaggctgggcagcccttcaccagagttcggaggagcagtgtgtggcgccacgtcccgactggccatacccacacagaagcagtgctgcccggggcctcatctgggccagcttggactctgcttcctccaggagcagcagggaagctctgggccacctccctggatagcaggaacttgacctgccatgtgtgccctgccttcctggccagctgtgcttgttatcttccattctcacaaactgtctttgaagcaatagaataaagaatgtgtgttttctttcctggtatacatacatgatcccatgctcccaagctccattcttccttccctcaactctctgccctccacagagctatggagaaggctggagatgaaagctttgtagtgaggactgataaagatctcatcactgctccttataataaacctaataaagcaagaaaccaaaaaaa

SEQ ID NO: 313266 - DNA, 2674 bp, Homo sapiens
ctaactagcaggaagtccggggttgacgatggctgtgttgttgaagggcctgtagccggggggttcctggccggatcccggtctacccttagcccagactcgttccggaccccagcccggcccggaacactctgggcgagacggcggtggcaactctccccttgccgccatgcacgacgctttcgagccagtgccgatcctagaaaagctgcctctgcaaatcgactgtctggctgcctgggaggaatggcttcttgtgggaaccaaacaaggacatcttcttctctataggattcggaaggacgttggttgcaacagatttgaagtgacactagagaaatccaataagaacttctccaaaaagattcagcagatccatgtggtttcccagtttaagattctggtcagcttgttagaaaataacatttatgtccatgacctattgacatttcaacaaatcactacggtttcaaaggcaaagggagcatcactgtttacttgtgacctccagcacacagagaccggtgaggaggtgttacggatgtgtgtggcagtaaaaaagaagctgcagctctatttctggaaggacagggaatttcatgaattgcagggggactttagtgtgccagatgtgcccaagtccatggcgtggtgtgaaaattctatctgtgtgggtttcaagagagactactacctaataagggtggatggaaaggggtccatcaaagagctctttccaacaggaaaacagctggagcccttagttgcacctctggcagatggaaaagtggctgtgggccaggatgatctcaccgtggtactcaatgaggaagggatctgcacacagaaatgtgccctgaactggacggacataccagtggccatggagcaccagcctccctacatcattgcagtgttgcctcgatatgttgagatccgaacatttgaaccgaggcttctggtccaaagcattgaattgcaaaggccccgtttcattacctcaggaggatcaaacattatctatgtggccagcaatcattttgtttggagactcatccctgtccccatggcaacccaaatccaacaacttctccaggacaagcagtttgaattggctctgcagctcgcagaaatgaaagatgattctgacagtgaaaagcagcaacaaattcatcacatcaagaacttgtatgccttcaacctcttctgccagaagcgttttgatgagtccatgcaggtctttgctaaacttggcacagatcccacccatgtgatgggcctgtaccctgacctgctgcccacagactacagaaagcagttgcagtatcccaacccattgcctgtgctctccggggctgaattggagaaggctcacttagctctgattgactacctgacacagaaacgaagtcaattggtaaagaagctgaatgactctgatcaccagtcaagcacctcaccgctcatggaaggcactcccaccatcaaatccaagaagaagctgctacaaatcatcgacaccaccctgctcaagtgctatctccatacaaatgtggccctggtggcccccttgctacgcctggagaacaatcactgccacatcgaggagagcgagcacgtgctaaagaaggctcacaagtacagtgagcttatcatcctgtatgagaagaaggggctccacgagaaagctctgcaggtgctcgtggaccagtccaagaaagccaactcccctctgaaaggccacgagaggacagtgcagtatctgcagcatctgggcacagaaaacctgcatttgattttctcctactcagtgtgggtgctgagagacttcccagaagatggcctgaagatatttactgaagatctcccggaagtggagtctctgccacgtgatcgagtcctcggcttcttaatagagaattttaagggtctggctattccttatctggaacacatcatccatgtttgggaggagacaggctctcggttccacaactgcctgatccagctatactgtgagaaggtgcaaggtctgatgaaggagtatctcctgtccttccctgcaggcaaaaccccagtcccagctggagaggaagagggtgagctgggagaataccggcaaaagctcctcatgttcttggagatttccagctactatgatccaggccggctcatctgtgattttccctttgatggcctcttagaagaacgagctctcctgttggggcgcatggggaaacatgaacaagctcttttcatttatgtccacatcttgaaggatacaaggatggctgaggagtactgccacaaacactatgaccgaaacaaagatggcaacaaagatgtgtatctgtccctgcttcggatgtacctgtcgccccccagcattcactgcctggggccaatcaagctggaactactggagccaaaagccaacctccaggccgctctgcaggtcctcgagctacaccacagcaaactggacaccaccaaggccctcaaccttctgctttagttcattccagcaggaaggaggagaagggcagggaggtagggagcttctcagcataagccagcttcagctttgataatctcacccacctaccccatttaaggagttccaggtttaagagttaaaacaggtgcacgtcacgtggctagggatctctagtcc

SEQ ID NO: 313267 - DNA, 1464 bp, Homo sapiens
ctaactagcaggaagtccggggttgacgatggctgtgttgttgaagggcctgtagccggggggttcctggccggatcccggtctacccttagcccagactcgttccggaccccagcccggcccggaacactctgggcgagacggcggtggcaactctccccttgccgccatgcacgacgctttcgagccagtgccgatcctagaaaagctgcctctgcaaatcgactgtctggctgcctgggaggaatggcttcttgtgggaaccaaacaaggacatcttcttctctataggattcggaaggacgttggttgcaacagatttgaagtgacactagagaaatccaataagaacttctccaaaaagattcagcagatccatgtggtttcccagtttaagattctggtcagcttgttagaaaataacatttatgtccatgacctattgacatttcaacaaatcactacggtttcaaaggcaaagggagcatcactgtttacttgtgacctccagcacacagagaccggtgaggaggtgttacggatgtgtgtggcagtaaaaaagaagctgcagctctatttctggaaggacagggaatttcatgaattgcagggggactttagtgtgccagatgtgcccaagtccatggcgtggtgtgaaaattctatctgtgtgggtttcaagagagactactacctaataagggtggatggaaaggggtccatcaaagagctctttccaacaggaaaacagctggagcccttagttgcacctctggcagatggaaaagtggctgtgggccaggatgatctcaccgtggtactcaatgaggaagggatctgcacacagaaatgtgccctgaactggacggacataccagtggccatggagcaccagcctccctacatcattgcagtgttgcctcgatatgttgagatccgaacatttgaaccgaggcttctggtccaaagcattgaattgcaaaggccccgtttcattacctcaggaggatcaaacattatctatgtggccagcaatcattttgtttggagactcatccctgtccccatggcaacccaaatccaacaacttctccaggacaagcagtttgaattggctctgcagctcgcagaaatgaaagatgattctgacagtgaaaagcagcaacaaattcatcacatcaagaacttgtatgccttcaacctcttctgccagaagcgttttgatgagtccatgcaggtctttgctaaacttggcacaggtaacaagtggtgaggcctttatataagggactaatggaggaggggagcctgaaaagtatggggagaaatgataacagacttctgagaatggagaaggtttaggctcagctaaattgatcctcatacctagcaagatcctgtggggtgaccacagtggttacatatctatactcctaatcctatgaatctggtcttctcaataaa

SEQ ID NO: 313268 - DNA, 2208 bp, Homo sapiens
ggcgcgctctcgccggcccgccccgaaccgccccgcgctgggaatttgcggcggcctccgccggggcagccgagctgaaccggtctcttcctcggaaaggcagggccgaggggcctgcggggcagccatggaggcgacgcggaggcggcagcacctgggagcgacgggcggcccaggcgcgcagctgggcgcctccttcctgcaggccaggcatggctctgtgagcgctgatgaggctgcccgcacggctcccttccacctcgacctctggttctacttcacactgcagaactgggttctggactttgggcgtcccattgccatgctggtattccctctcgagtggtttccactcaacaagcccagtgttggggactacttccacatggcctacaacgtcatcacgccctttctcttgctcaagctcatcgagcggtccccccgcaccctgccacgctccatcacgtacgtgagcatcatcatcttcatcatgggtgccagcatccacctggtgggtgactctgtcaaccaccgcctgctcttcagtggctaccagcaccacctgtctgtccgtgagaaccccatcatcaagaatctcaagccggagacgctgatcgactcctttgagctgctctactattatgatgagtacctgggtcactgcatgtggtacatccccttcttcctcatcctcttcatgtacttcagcggctgctttactgcctctaaagctgagagcttgattccagggcctgccctgctcctggtggcacccagtggcctgtactactggtacctggtcaccgagggccagatcttcatcctcttcatcttcaccttcttcgccatgctggccctcgtcctgcaccagaagcgcaagcgcctcttcctggacagcaacggcctcttcctcttctcctccttcgcactgaccctcttgcttgtggcgctctgggtcgcctggctgtggaatgaccctgttctcaggaagaagtacccgggtgtcatctacgtccctgagccctgggctttctacacccttcacgtcagcagtcggcactgagtccctggcaccaggctctggcgctctgctgggtgggagggtgggccatggagggcatctgaatacaggagtagggggggtgtgggtgtgtaaccagagaccgagagcatgagtggggtgtgcctcgtgtgcgtggattcgtgtgtgtgtgtgtgtcttgtatatgtgtgcgcagagtgcatcattttcagactctactatttccgtcaagtttctgtttgatttggatcatctcaggatcggattctgttttagagtgtttctgggccaggatccgggcccctgccctcctctgcacctgaccacactccctactcagggctagtctgttcttcccggacatcttctggtagccgtgcaggagagggctgggtggggcagaggccaggaggggacctggtgtgtcacctgcccaccacctggctcatccctcaggcccaccctgaccctacattacataggttacgtcagcctactgtggctgttgagcaaagcatttctcctttctgggcctcatttgcactagatgggcctgtggtcccaaagtaggtcagtaggttggggttgctgacaccccttgggtgcagctttgggacagatgagtggctctgtcctgtcactgccctctccctgcctgggggctatgtgcactccagacccctgcccaggctcaggcccatgaggtatggagacaccctggcccccaggagctggaggcaccgcccactcccctggcattccagctttgcaggtgaccctcctctacccaaagctctgtccccctgctcccactccagaagaactgcggcacgtgcttcgggcagcctagccacaggctttgagcgcctgcattcctgggggctggagggtggggtgccaaaggccctgagcaaaagccagagctcctctcatcaaagcctttacaaggtgctgggcccagaggctttgccttgacagagtggcccagggtttcaagggaggaggaacctccccctacctaggacccttcctgtggggggtctacagagtcagggacagaagggaagggacccacaggaagtcacagtggtgcccagggatgtgtcagcccccagccacggggacgcgggattcaagaatgaagtaaatacagtcacaggccccaa

SEQ ID NO: 313269 - DNA, 142 bp, Homo sapiens
gcctactctactattcgggtgcgagaagaggacagaagggaagggacccacaggaagtcacagtggtgcccagggatgtgtcagcccccagccacggggacgcgggattcaagaatgaagtaaatacagtcacaggccccaa

SEQ ID NO: 313270 - DNA, 2415 bp, Homo sapiens
ggcgcgctctcgccggcccgccccgaaccgccccgcgctgggaatttgcggcggcctccgccggggcagccgagctgaaccggtctcttcctcggaaaggcagggccgaggggcctgcggggcagccatggaggcgacgcggaggcggcagcacctgggagcgacgggcggcccaggcgcgcagctgggcgcctccttcctgcaggccaggcatggctctgtgagcgctgatgaggctgcccgcacggctcccttccacctcgacctctggttctacttcacactgcagaactgggttctggactttgggcgtcccattgccatgctggtattccctctcgagtggtttccactcaacaagcccagtgttggggactacttccacatggcctacaacgtcatcacgccctttctcttgctcaagctcatcgagcggtccccccgcaccctgccacgctccatcacgtacgtgagcatcatcatcttcatcatgggtgccagcatccacctggtgggtgactctgtcaaccaccgcctgctcttcagtggctaccagcaccacctgtctgtccgtgagaaccccatcatcaagaatctcaagccggagacgctgatcgactcctttgagctgctctactattatgatgagtacctgggtcactgcatgtggtacatccccttcttcctcatcctcttcatgtacttcagcggctgctttactgcctctaaagctgagagcttgattccagggcctgccctgctcctggtggcacccagtggcctgtactactggtacctggtcaccgagggccagatcttcatcctcttcatcttcaccttcttcgccatgctggccctcgtcctgcaccagaagcgcaagcgcctcttcctggacagcaacggcctcttcctcttctcctccttcgcactgaccctcttgcttgtggcgctctgggtcgcctggctgtggaatgaccctgttctcaggaagaagtacccgggtgtcatctacgtccctgagccctgggctttctacacccttcacgtcagcagtcggcactgagtccctggcaccaggctctggcgctctgctgggtgggagggtgggccatggagggcatctgaatacaggagtagggggggtgtgggtgtgtaaccagagaccgagagcatgagtggggtgtgcctcgtgtgcgtggattcgtgtgtgtgtgtgtgtcttgtatatgtgtgcgcagagtgcatcattttcagactctactatttccgtcaagtttctgtttgatttggatcatctcaggatcggattctgttttagagtgtttctgggccaggatccgggcccctgccctcctctgcacctgaccacactccctactcagggctagtctgttcttcccggacatcttctggtagccgtgcaggagagggctgggtggggcagaggccaggaggggacctggtgtgtcacctgcccaccacctggctcatccctcaggcccaccctgaccctacattacataggttacgtcagcctactgtggctgttgagcaaagcatttctcctttctgggcctcatttgcactagatgggcctgtggtcccaaagtaggtcagtaggttggggttgctgacaccccttgggtgcagctttgggacagatgagtggctctgtcctgtcactgccctctccctgcctgggggctatgtgcactccagacccctgcccaggctcaggcccatgaggtatggagacaccctggcccccaggagctggaggcaccgcccactcccctggcattccagctttgcaggtgaccctcctctacccaaagctctgtccccctgctcccactccagaagaactgcggcacgtgcttcgggcagcctagccacaggctttgagcgcctgcattcctgggggctggagggtggggtgccaaaggccctgagcaaaagccagagctcctctcatcaaagcctttacaaggtgctgggcccagaggctttgccttgacagagtggcccagggtttcaagggaggaggaacctccccctacctaggacccttcctgtggggggtctacagagtcagggacagaagggaagggacccacaggaagtcacagtggtgcccagggatgtgtcagcccccagccacggggacgcgggattcaagaatgaagtaaatacagtcacaggccccaaaaaaaaaagaagaaaaggaacacaaacaacgcacggcaaaccagaaaggagacacacgcgggggcaataataggggggggggagaaaaaaaaggaggaaacaggcgcgcgacggacaaagagtgtcgcgcccccgaacttggagcaacaggggggtaagcgcgggggccccaaaggggaggggaaactagagagcggcggacccgaa

SEQ ID NO: 313271 - DNA, 2019 bp, Homo sapiens
ggcgcgctctcgccggcccgccccgaaccgccccgcgctgggaatttgcggcggcctccgccggggcagccgagctgaaccggtctcttcctcggaaaggcagggccgaggggcctgcggggcagccatggaggcgacgcggaggcggcagcacctgggagcgacgggcggcccaggcgcgcagctgggcgcctccttcctgcaggccaggcatggctctgtgagcgctgatgaggctgcccgcacggctcccttccacctcgacctctggttctacttcacactgcagaactgggttctggactttgggcgtcccattgccatgctggtattccctctcgagtggtttccactcaacaagcccagtgttggggactacttccacatggcctacaacgtcatcacgccctttctcttgctcaagatcgactcctttgagctgctctactattatgatgagtacctgggtcactgcatgtggtacatccccttcttcctcatcctcttcatgtacttcagcggctgctttactgcctctaaagctgagagcttgattccagggcctgccctgctcctggtggcacccagtggcctgtactactggtacctggtcaccgagggccagatcttcatcctcttcatcttcaccttcttcgccatgctggccctcgtcctgcaccagaagcgcaagcgcctcttcctggacagcaacggcctcttcctcttctcctccttcgcactgaccctcttgcttgtggcgctctgggtcgcctggctgtggaatgaccctgttctcaggaagaagtacccgggtgtcatctacgtccctgagccctgggctttctacacccttcacgtcagcagtcggcactgagtccctggcaccaggctctggcgctctgctgggtgggagggtgggccatggagggcatctgaatacaggagtagggggggtgtgggtgtgtaaccagagaccgagagcatgagtggggtgtgcctcgtgtgcgtggattcgtgtgtgtgtgtgtgtcttgtatatgtgtgcgcagagtgcatcattttcagactctactatttccgtcaagtttctgtttgatttggatcatctcaggatcggattctgttttagagtgtttctgggccaggatccgggcccctgccctcctctgcacctgaccacactccctactcagggctagtctgttcttcccggacatcttctggtagccgtgcaggagagggctgggtggggcagaggccaggaggggacctggtgtgtcacctgcccaccacctggctcatccctcaggcccaccctgaccctacattacataggttacgtcagcctactgtggctgttgagcaaagcatttctcctttctgggcctcatttgcactagatgggcctgtggtcccaaagtaggtcagtaggttggggttgctgacaccccttgggtgcagctttgggacagatgagtggctctgtcctgtcactgccctctccctgcctgggggctatgtgcactccagacccctgcccaggctcaggcccatgaggtatggagacaccctggcccccaggagctggaggcaccgcccactcccctggcattccagctttgcaggtgaccctcctctacccaaagctctgtccccctgctcccactccagaagaactgcggcacgtgcttcgggcagcctagccacaggctttgagcgcctgcattcctgggggctggagggtggggtgccaaaggccctgagcaaaagccagagctcctctcatcaaagcctttacaaggtgctgggcccagaggctttgccttgacagagtggcccagggtttcaagggaggaggaacctccccctacctaggacccttcctgtggggggtctacagagtcagggacagaagggaagggacccacaggaagtcacagtggtgcccagggatgtgtcagcccccagccacggggacgcgggattcaagaatgaagtaaatacagtcacaggccccaa

SEQ ID NO: 313272 - DNA, 1749 bp, Homo sapiens
ggcgcgctctcgccggcccgccccgaaccgccccgcgctgggaatttgcggcggcctccgccggggcagccgagctgaaccggtctcttcctcggaaaggcagggccgaggggcctgcggggcagccatggaggcgacgcggaggcggcagcacctgggagcgacgggcggcccaggcgcgcagctgggcgcctccttcctgcaggccaggtacatccccttcttcctcatcctcttcatgtacttcagcggctgctttactgcctctaaagctgagagcttgattccagggcctgccctgctcctggtggcacccagtggcctgtactactggtacctggtcaccgagggccagatcttcatcctcttcatcttcaccttcttcgccatgctggccctcgtcctgcaccagaagcgcaagcgcctcttcctggacagcaacggcctcttcctcttctcctccttcgcactgaccctcttgcttgtggcgctctgggtcgcctggctgtggaatgaccctgttctcaggaagaagtacccgggtgtcatctacgtccctgagccctgggctttctacacccttcacgtcagcagtcggcactgagtccctggcaccaggctctggcgctctgctgggtgggagggtgggccatggagggcatctgaatacaggagtagggggggtgtgggtgtgtaaccagagaccgagagcatgagtggggtgtgcctcgtgtgcgtggattcgtgtgtgtgtgtgtgtcttgtatatgtgtgcgcagagtgcatcattttcagactctactatttccgtcaagtttctgtttgatttggatcatctcaggatcggattctgttttagagtgtttctgggccaggatccgggcccctgccctcctctgcacctgaccacactccctactcagggctagtctgttcttcccggacatcttctggtagccgtgcaggagagggctgggtggggcagaggccaggaggggacctggtgtgtcacctgcccaccacctggctcatccctcaggcccaccctgaccctacattacataggttacgtcagcctactgtggctgttgagcaaagcatttctcctttctgggcctcatttgcactagatgggcctgtggtcccaaagtaggtcagtaggttggggttgctgacaccccttgggtgcagctttgggacagatgagtggctctgtcctgtcactgccctctccctgcctgggggctatgtgcactccagacccctgcccaggctcaggcccatgaggtatggagacaccctggcccccaggagctggaggcaccgcccactcccctggcattccagctttgcaggtgaccctcctctacccaaagctctgtccccctgctcccactccagaagaactgcggcacgtgcttcgggcagcctagccacaggctttgagcgcctgcattcctgggggctggagggtggggtgccaaaggccctgagcaaaagccagagctcctctcatcaaagcctttacaaggtgctgggcccagaggctttgccttgacagagtggcccagggtttcaagggaggaggaacctccccctacctaggacccttcctgtggggggtctacagagtcagggacagaagggaagggacccacaggaagtcacagtggtgcccagggatgtgtcagcccccagccacggggacgcgggattcaagaatgaagtaaatacagtcacaggccccaa

SEQ ID NO: 313273 - DNA, 2154 bp, Homo sapiens
ggcgcgctctcgccggcccgccccgaaccgccccgcgctgggaatttgcggcggcctccgccggggcagccgagctgaaccggtctcttcctcggaaaggcagggccgaggggcctgcggggcagccatggaggcgacgcggaggcggcagcacctgggagcgacgggcggcccaggcgcgcagctgggcgcctccttcctgcaggccaggcatggctctgtgagcgctgatgaggctgcccgcacggctcccttccacctcgacctctggttctacttcacactgcagaactgggttctggactttgggcgtcccattgccatgctggtattccctctcgagtggtttccactcaacaagcccagtgttggggactacttccacatggcctacaacgtcatcacgccctttctcttgctcaagctcatcgagcggtccccccgcaccctgccacgctccatcacgtacgtgagcatcatcatcttcatcatgggtgccagcatccacctggtgggtgactctgtcaaccaccgcctgctcttcagtggctaccagcaccacctgtctgtccgtgagaaccccatcatcaagaatctcaagccggagacgctgatcgactcctttgagctgctctactattatgatgagtacctgggtcactgcatgtggtacatccccttcttcctcatcctcttcatgtacttcagcggctgctttactgcctctaaagctgagagcttgattccagggcctgccctgctcctggtggcacccagtggcctgtactactggtacctggtcaccgagggccagatcttcatcctcttcatcttcaccttcttcgccatgctggccctcgtcctgcaccagaagcgcaagcgcctcttcctggacagcaacggcctcttcctcttctcctccttcgcactgaccctcttgcttgtggcgctctgggtcgcctggctgtggaatgaccctgttctcaggaagaagtacccgggtgtcatctacgtccctgagccctgggctttctacacccttcacgtcagcagtcggcactgagtccctggcaccaggctctggcgctctgctgggtgggagggtgggccatggagggcatctgaatacaggagtagggggggtgtgggtgtgtaaccagagaccgagagcatgagtggggtgtgcctcgtgtgcgtggattcgtgtgtgtgtgtgtgtcttgtatatgtgtgcgcagagtgcatcattttcagactgttttagagtgtttctgggccaggatccgggcccctgccctcctctgcacctgaccacactccctactcagggctagtctgttcttcccggacatcttctggtagccgtgcaggagagggctgggtggggcagaggccaggaggggacctggtgtgtcacctgcccaccacctggctcatccctcaggcccaccctgaccctacattacataggttacgtcagcctactgtggctgttgagcaaagcatttctcctttctgggcctcatttgcactagatgggcctgtggtcccaaagtaggtcagtaggttggggttgctgacaccccttgggtgcagctttgggacagatgagtggctctgtcctgtcactgccctctccctgcctgggggctatgtgcactccagacccctgcccaggctcaggcccatgaggtatggagacaccctggcccccaggagctggaggcaccgcccactcccctggcattccagctttgcaggtgaccctcctctacccaaagctctgtccccctgctcccactccagaagaactgcggcacgtgcttcgggcagcctagccacaggctttgagcgcctgcattcctgggggctggagggtggggtgccaaaggccctgagcaaaagccagagctcctctcatcaaagcctttacaaggtgctgggcccagaggctttgccttgacagagtggcccagggtttcaagggaggaggaacctccccctacctaggacccttcctgtggggggtctacagagtcagggacagaagggaagggacccacaggaagtcacagtggtgcccagggatgtgtcagcccccagccacggggacgcgggattcaagaatgaagtaaatacagtcacaggccccaa

SEQ ID NO: 313274 - DNA, 1140 bp, Homo sapiens
tgcagcagcggtcgcttagagatccccagaggagggtgggccatggagggcatctgaatacaggagtagggggggtgtgggtgtgtaaccagagaccgagagcatgagtggggtgtgcctcgtgtgcgtggattcgtgtgtgtgtgtgtgtcttgtatatgtgtgcgcagagtgcatcattttcagactctactatttccgtcaagtttctgtttgatttggatcatctcaggatcggattctgttttagagtgtttctgggccaggatccgggcccctgccctcctctgcacctgaccacactccctactcagggctagtctgttcttcccggacatcttctggtagccgtgcaggagagggctgggtggggcagaggccaggaggggacctggtgtgtcacctgcccaccacctggctcatccctcaggcccaccctgaccctacattacataggttacgtcagcctactgtggctgttgagcaaagcatttctcctttctgggcctcatttgcactagatgggcctgtggtcccaaagtaggtcagtaggttggggttgctgacaccccttgggtgcagctttgggacagatgagtggctctgtcctgtcactgccctctccctgcctgggggctatgtgcactccagacccctgcccaggctcaggcccatgaggtatggagacaccctggcccccaggagctggaggcaccgcccactcccctggcattccagctttgcaggtgaccctcctctacccaaagctctgtccccctgctcccactccagaagaactgcggcacgtgcttcgggcagcctagccacaggctttgagcgcctgcattcctgggggctggagggtggggtgccaaaggccctgagcaaaagccagagctcctctcatcaaagcctttacaaggtgctgggcccagaggctttgccttgacagagtggcccagggtttcaagggaggaggaacctccccctacctaggacccttcctgtggggggtctacagagtcagggacagaagggaagggacccacaggaagtcacagtggtgcccagggatgtgtcagcccccagccacggggacgcgggattcaagaatgaagtaaatacagtcacaggccccaa

SEQ ID NO: 313275 - DNA, 1704 bp, Homo sapiens
ggcgcgctctcgccggcccgccccgaaccgccccgcgctgggaatttgcggcggcctccgccggggcagccgagctgaaccggtctcttcctcggaaaggcagggccgaggggcctgcggggcagccatggaggcgacgcggaggcggcagcacctgggagcgacgggcggcccaggcgcgcagctgggcgcctccttcctgcaggccaggcatggctctgtgagcgctgatgaggctgcccgcacggctcccttccacctcgacctctggttctacttcacactgcagaactgggttctggactttgggcgtcccattgccatgctggtattccctctcgagtggtttccactcaacaagcccagtgttggggactacttccacatggcctacaacgtcatcacgccctttctcttgctcaagctcatcgagcggtccccccgcaccctgccacgctccatcacgtacgtgagcatcatcatcttcatcatgggtgccagcatccacctggtgggtgactctgtcaaccaccgcctgctcttcagtggctaccagcaccacctgtctgtccgtgagaaccccatcatcaagaatctcaagccggagacgctgatcgactcctttgagctgctctactattatgatgagtacctgggtcactgcatgtggtacatccccttcttcctcatcctcttcatgtacttcagcggctgctttactgcctctaaagctgagagcttgattccagggcctgccctgctcctggtggcacccagtggcctgtactactggtacctggtcaccgagggccagatcttcatcctcttcatcttcaccttcttcgccatgctggccctcgtcctgcaccagaagcgcaagcgcctcttcctggacagcaacggcctcttcctcttctcctccttcgcactgaccctcttgcttgtggcgctctgggtcgcctggctgtggaatgaccctgttctcaggaagaagtacccgggtgtcatctacgtccctgagccctgggctttctacacccttcacgtcagcagtcggcactgagtccctggcaccaggctctggcgctctgctgggtgggagggtgggccatggagggcatctgaatacaggagtagggggggtgtgggtgtgtaaccagagaccgagagcatgagtggggtgtgcctcgtgtgcgtggattcgtgtgtgtgtgtgtgtcttgtatatgtgtgcgcagagtgcatcattttcagactctactatttccgtcaagtttctgtttgatttggatcatctcaggatcggattctgttttagagtgtttctgggccaggatccgggcccctgccctcctctgcacctgaccacactccctactcagggctagtctgttcttcccggacatcttctggtagccgtgcaggagagggctgggtggggcagaggccaggaggggacctggtgtgtcacctgcccaccacctggctcatccctcaggcccaccctgaccctacattacataggttacgtcagcctactgtggctgttgagcaaagcatttctcctttctgggcctcatttgcactagatgggcctgtggtcccaaagtaggtcagtaggttggggttgctgatcctctttgtaattactatttgtacttgttaattactataacttttcaattcttttaatattcatgattt

SEQ ID NO: 313276 - DNA, 947 bp, Homo sapiens
ggacgcgtgggtcgacccacgcgtccgggatcatctcaggatcggattctgttttagagtgtttctgggccaggatccgggcccctgccctcctctgcacctgaccacactccctactcagggctagtctgttcttcccggacatcttctggtagccgtgcaggagagggctgggtggggcagaggccaggaggggacctggtgtgtcacctgcccaccacctggctcatccctcaggcccaccctgaccctacattacataggttacgtcagcctactgtggctgttgagcaaagcatttctcctttctgggcctcatttgcactagatgggcctgtggtcccaaagtaggtcagtaggttggggttgctgacaccccttgggtgcagctttgggacagatgagtggctctgtcctgtcactgccctctccctgcctgggggctatgtgcactccagacccctgcccaggctcaggcccatgaggtatggagacaccctggcccccaggagctggaggcaccgcccactcccctggcattccagctttgcaggtgaccctcctctacccaaagctctgtccccctgctcccactccagaagaactgcggcacgtgcttcgggcagcctagccacaggctttgagcgcctgcattcctgggggctggagggtggggtgccaaaggccctgagcaaaagccagagctcctctcatcaaagcctttacaaggtgctgggcccagaggctttgccttgacagagtggcccagggtttcaagggaggaggaacctccccctacctaggacccttcctgtggggggtctacagagtcagggacagaagggaagggacccacaggaagtcacagtggtgcccagggatgtgtcagcccccagccacggggacgcgggattcaagaatgaagtaaatacagtcacaggccccaa

SEQ ID NO: 313277 - DNA, 288 bp, Homo sapiens
ggcgcgctctcgccggcccgccccgaaccgccccgcgctgggaatttgcggcggcctccgccggggcagccgagctgaaccggtctcttcctcggaaaggcagggccgaggggcctgcggggcagccatggaggcgacgcggaggcggcagcacctgggagcgacgggcggcccaggcgcgcagctgggcgcctccttcctgcaggccagaacggaaatgggggggggtggtgggagggggttggtgtgtgaatggtgaggggagggagggtggtgtgggtggagggg

SEQ ID NO: 313278 - DNA, 1056 bp, Homo sapiens
  misc_feature (981)..(982): n is a, c, g, or t
  misc_feature (1052)..(1052): n is a, c, g, or t
ggcgcgctctcgccggcccgccccgaaccgccccgcgctgggaatttgcggcggcctccgccggggcagccgagctgaaccggtctcttcctcggaaaggcagggccgaggggcctgcggggcagccatggaggcgacgcggaggcggcagcacctgggagcgacgggcggcccaggcgcgcagctgggcgcctccttcctgcaggccaggcatggctctgtgagcgctgatgaggctgcccgcacggctcccttccacctcgacctctggttctacttcacactgcagaactgggttctggactttgggcgtcccattgccatgctggtattccctctcgagtggtttccactcaacaagcccagtgttggggactacttccacatggcctacaacgtcatcacgccctttctcttgctcaagatcgactcctttgagctgctctactattatgatgagtacctgggtcactgcatgtggtacatccccttcttcctcatcctcttcatgtacttcagcggctgctttactgcctctaaagctgagagcttgattccagggcctgccctgctcctggtggcacccagtggcctgtactactggtacctggtcaccgagggccagatcttcatcctcttcatcttcaccttcttcgccatgctggccctcgtcctgcaccagaagcgcaagcgcctcttcctggacagcaacggcctcttcctcttctcctccttcgcactgaccctcttgcttgtggcgctctgggtcgcctggctgtggaatgaccctgttctcaggaagaagtacccgggtgtcatctacgtccctgagccctgggctttctacacccttcacgtcagcagtcggcactgagtccctggcaccaggctctggcgctctgctgggtgggagggtgggccatggagggcatctgaatacaggagtagggggggtgtgggtgtgtaaccagagaatccacnnttttttttttttttttttttttttttttttttttttttttttttttttttttttttttttttttatattnatta

SEQ ID NO: 313279 - DNA, 2234 bp, Homo sapiens
ggcgcgctctcgccggcccgccccgaaccgccccgcgctgggaatttgcggcggcctccgccggggcagccgagctgaaccggtctcttcctcggaaaggcagggccgaggggcctgcggggcagccatggaggcgacgcggaggcggcagcacctgggagcgacgggcggcccaggcgcgcagctgggcgcctccttcctgcaggccaggcatggctctgtgagcgctgatgaggctgcccgcacggctcccttccacctcgacctctggttctacttcacactgcagaactgggttctggactttgggcgtcccattgccatgctggtattccctctcgagtggtttccactcaacaagcccagtgttggggactacttccacatggcctacaacgtcatcacgccctttctcttgctcaagctcatcgagcggtccccccgcaccctgccacgctccatcacgtacgtgagcatcatcatcttcatcatgggtgccagcatccacctggtgggtgactctgtcaaccaccgcctgctcttcagtggctaccagcaccacctgtctgtccgtgagaaccccatcatcaagaatctcaagccggagacgctggtgaggccacctcctgctccctgcctatcgactcctttgagctgctctactattatgatgagtacctgggtcactgcatgtggtacatccccttcttcctcatcctcttcatgtacttcagcggctgctttactgcctctaaagctgagagcttgattccagggcctgccctgctcctggtggcacccagtggcctgtactactggtacctggtcaccgagggccagatcttcatcctcttcatcttcaccttcttcgccatgctggccctcgtcctgcaccagaagcgcaagcgcctcttcctggacagcaacggcctcttcctcttctcctccttcgcactgaccctcttgcttgtggcgctctgggtcgcctggctgtggaatgaccctgttctcaggaagaagtacccgggtgtcatctacgtccctgagccctgggctttctacacccttcacgtcagcagtcggcactgagtccctggcaccaggctctggcgctctgctgggtgggagggtgggccatggagggcatctgaatacaggagtagggggggtgtgggtgtgtaaccagagaccgagagcatgagtggggtgtgcctcgtgtgcgtggattcgtgtgtgtgtgtgtgtcttgtatatgtgtgcgcagagtgcatcattttcagactctactatttccgtcaagtttctgtttgatttggatcatctcaggatcggattctgttttagagtgtttctgggccaggatccgggcccctgccctcctctgcacctgaccacactccctactcagggctagtctgttcttcccggacatcttctggtagccgtgcaggagagggctgggtggggcagaggccaggaggggacctggtgtgtcacctgcccaccacctggctcatccctcaggcccaccctgaccctacattacataggttacgtcagcctactgtggctgttgagcaaagcatttctcctttctgggcctcatttgcactagatgggcctgtggtcccaaagtaggtcagtaggttggggttgctgacaccccttgggtgcagctttgggacagatgagtggctctgtcctgtcactgccctctccctgcctgggggctatgtgcactccagacccctgcccaggctcaggcccatgaggtatggagacaccctggcccccaggagctggaggcaccgcccactcccctggcattccagctttgcaggtgaccctcctctacccaaagctctgtccccctgctcccactccagaagaactgcggcacgtgcttcgggcagcctagccacaggctttgagcgcctgcattcctgggggctggagggtggggtgccaaaggccctgagcaaaagccagagctcctctcatcaaagcctttacaaggtgctgggcccagaggctttgccttgacagagtggcccagggtttcaagggaggaggaacctccccctacctaggacccttcctgtggggggtctacagagtcagggacagaagggaagggacccacaggaagtcacagtggtgcccagggatgtgtcagcccccagccacggggacgcgggattcaagaatgaagtaaatacagtcacaggccccaa

SEQ ID NO: 313280 - DNA, 2219 bp, Homo sapiens
  misc_feature (122)..(122): n is a, c, g, or t
  misc_feature (137)..(137): n is a, c, g, or t
  misc_feature (162)..(162): n is a, c, g, or t
  misc_feature (166)..(166): n is a, c, g, or t
  misc_feature (211)..(211): n is a, c, g, or t
  misc_feature (233)..(233): n is a, c, g, or t
  misc_feature (326)..(326): n is a, c, g, or t
  misc_feature (363)..(363): n is a, c, g, or t
  misc_feature (398)..(398): n is a, c, g, or t
  misc_feature (441)..(441): n is a, c, g, or t
  misc_feature (445)..(445): n is a, c, g, or t
  misc_feature (447)..(447): n is a, c, g, or t
  misc_feature (451)..(451): n is a, c, g, or t
  misc_feature (469)..(469): n is a, c, g, or t
  misc_feature (499)..(499): n is a, c, g, or t
  misc_feature (508)..(508): n is a, c, g, or t
  misc_feature (516)..(516): n is a, c, g, or t
  misc_feature (555)..(555): n is a, c, g, or t
ggcgcgctctcgccggcccgccccgaaccgccccgcgctgggaatttgcggcggcctccgccggggcagccgagctgaaccggtctcttcctcggaaaggcagggccgaggggggggggggngcgcggggggggggnggggggggggggggcggggcggggngggnggggggggggggggggggggggggggggggggggggggggggggnggggggggtcgggggggggggngggggggggggggggggcgccctgggagggggagggggggggggggggggagaggggggaagggggtgggggaggtgggggggggcagggggngggggggagggggggggggggggggggcagggaagangccgagggggggggaggagtgggagagggggtagnaggggagggggggggggggcggggggagggggagggggggggnccgncnggancgggggaggggccgaggnaggggaggtgaggggtgagcatgcgggagnagggggggnagcagggnagggggggggggagggggtgaaccaccgggctgggcggnagtggctaccagcaccacctgtctgtccgtgagaaccccatcatcaagaatctcaagccggagacgctgatcgactcctttgagctgctctactattatgatgagtacctgggtcactgcatgtggtacatccccttcttcctcatcctcttcatgtacttcagcggctgctttactgcctctaaagctgagagcttgattccagggcctgccctgctcctggtggcacccagtggcctgtactactggtacctggtcaccgagggccagatcttcatcctcttcatcttcaccttcttcgccatgctggccctcgtcctgcaccagaagcgcaagcgcctcttcctggacagcaacggcctcttcctcttctcctccttcgcactgaccctcttgcttgtggcgctctgggtcgcctggctgtggaatgaccctgttctcaggaagaagtacccgggtgtcatctacgtccctgagccctgggctttctacacccttcacgtcagcagtcggcactgagtccctggcaccaggctctggcgctctgctgggtgggagggtgggccatggagggcatctgaatacaggagtagggggggtgtgggtgtgtaaccagagaccgagagcatgagtggggtgtgcctcgtgtgcgtggattcgtgtgtgtgtgtgtgtcttgtatatgtgtgcgcagagtgcatcattttcagactctactatttccgtcaagtttctgtttgatttggatcatctcaggatcggattctgttttagagtgtttctgggccaggatccgggcccctgccctcctctgcacctgaccacactccctactcagggctagtctgttcttcccggacatcttctggtagccgtgcaggagagggctgggtggggcagaggccaggaggggacctggtgtgtcacctgcccaccacctggctcatccctcaggcccaccctgaccctacattacataggttacgtcagcctactgtggctgttgagcaaagcatttctcctttctgggcctcatttgcactagatgggcctgtggtcccaaagtaggtcagtaggttggggttgctgacaccccttgggtgcagctttgggacagatgagtggctctgtcctgtcactgccctctccctgcctgggggctatgtgcactccagacccctgcccaggctcaggcccatgaggtatggagacaccctggcccccaggagctggaggcaccgcccactcccctggcattccagctttgcaggtgaccctcctctacccaaagctctgtccccctgctcccactccagaagaactgcggcacgtgcttcgggcagcctagccacaggctttgagcgcctgcattcctgggggctggagggtggggtgccaaaggccctgagcaaaagccagagctcctctcatcaaagcctttacaaggtgctgggcccagaggctttgccttgacagagtggcccagggtttcaagggaggaggaacctccccctacctaggacccttcctgtggggggtctacagagtcagggacagaagggaagggacccacaggaagtcacagtggtgcccagggatgtgtcagcccccagccacggggacgcgggattcaagaatgaagtaaatacagtcacaggccccaa

SEQ ID NO: 313281 - DNA, 2248 bp, Homo sapiens
ggcgcgctctcgccggcccgccccgaaccgccccgcgctgggaatttgcggcggcctccgccggggcagccgagctgaaccggtctcttcctcggaaaggcagggccgaggggcctgcggggcagccatggaggcgacgcggaggcggcagcacctgggagcgacgggcggcccaggcgcgcagctgggcgcctccttcctgcaggccaggcatggctctgtgagcgctgatgaggctgcccgcacggctcccttccacctcgacctctggttctacttcacactgcagaactgggttctggactttgggcgtcccattgccatgctggtattccctctcgagtggtttccactcaacaagcccagtgttggggactacttccacatggcctacaacgtcatcacgccctttctcttgctcaagctcatcgagcggtccccccgcaccctgccacgctccatcacgtacgtgagcatcatcatcttcatcatgggtgccagcatccacctggtgggtgactctgtcaaccaccgcctgctcttcagtggctaccagcaccacctgtctgtccgtgagaaccccatcatcaagaatctcaagccggagacgctgatcgactcctttgagctgctctactattatgatgagtacctgggtcactgcatgtggtacatccccttcttcctcatcctcttcatgtacttcagcggctgctttactgcctctaaagctgagagcttgattccagggcctgccctgctcctggtggcacccagtggcctgtactactggtacctggtcaccgagggccagatcttcatcctcttcatcttcaccttcttcgccatgctggccctcgtcctgcaccagaagcgcaagcgcctcttcctggacagcaacggcctcttcctcttctcctccttcgcactgaccctcttgcttgtggcgctctgggtcgcctggctgtggaatgaccctgttctcaggaagaagtacccgggtgtcatctacgtccctgagccctgggctttctacacccttcacgtcagcagtcggcactgagtccctggcaccaggctctggcgctctgctgggtgggagggtgggccatggagggcatctgaatacaggagtagggggggtgtgggtgtgtaaccagagaccgagagcatgagtggggtgtgcctcgtgtgcgtggattcgtgtgtgtgtgtgtgtcttgtatatgtgtgcgcagagtgcatcattttcagactctactatttccgtcaagtttctgtttgatttggatcatctcaggatcggattctgttttagagtgtttctgggccaggatccgggcccctgccctcctctgcacctgaccacactccctactcagggctagtctgttcttcccggacatcttctggtagccgtgcaggagagggctgggtggggcagaggccaggaggggacctggtgtgtcacctgcccaccacctggctcatccctcaggcccaccctgaccctacattacataggttacgtcagcctactgtggctgttgagcaaagcatttctcctttctgggcctcatttgcactagatgggcctgtactgacctactttgggaccacaggcccatctagtgcaaatggtcccaaagtaggtcagtaggttggggttgctgacaccccttgggtgcagctttgggacagatgagtggctctgtcctgtcactgccctctccctgcctgggggctatgtgcactccagacccctgcccaggctcaggcccatgaggtatggagacaccctggcccccaggagctggaggcaccgcccactcccctggcattccagctttgcaggtgaccctcctctacccaaagctctgtccccctgctcccactccagaagaactgcggcacgtgcttcgggcagcctagccacaggctttgagcgcctgcattcctgggggctggagggtggggtgccaaaggccctgagcaaaagccagagctcctctcatcaaagcctttacaaggtgctgggcccagaggctttgccttgacagagtggcccagggtttcaagggaggaggaacctccccctacctaggacccttcctgtggggggtctacagagtcagggacagaagggaagggacccacaggaagtcacagtggtgcccagggatgtgtcagcccccagccacggggacgcgggattcaagaatgaagtaaatacagtcacaggccccaa

SEQ ID NO: 313282 - DNA, 1656 bp, Homo sapiens
ggcgcgctctcgccggcccgccccgaaccgccccgcgctgggaatttgcggcggcctccgccggggcagccgagctgaaccggtctcttcctcggaaaggcagggccgaggggcctgcggggcagccatggaggcgacgcggaggcggcagcacctgggagcgacgggcggcccaggcgcgcagctgggcgcctccttcctgcaggccaggcatggctctgtgagcgctgatgaggctgcccgcacggctcccttccacctcgacctctggttctacttcacactgcagaactgggttctggactttgggcgtcccattgccatgctggtattccctctcgagtggtttccactcaacaagcccagtgttggggactacttccacatggcctacaacgtcatcacgccctttctcttgctcaagctcatcgagcggtccccccgcaccctgccacgctccatcacgtacgtgagcatcatcatcttcatcatgggtgccagcatccacctggtgggtgactctgtcaaccaccgcctgctcttcagtggctaccagcaccacctgtctgtccgtgagaaccccatcatcaagaatctcaagccggagacgctgatcgactcctttgagctgctctactattatgatgagtacctgggtcactgcatgtggtacatccccttcttcctcatcctcttcatgtacttcagcggctgctttactgcctctaaagctgagagcttgattccagggcctgccctgctcctggtggcacccagtggcctgtactactggtacctggtcaccgagggccagatcttcatcctcttcatcttcaccttcttcgccatgctggccctcgtcctgcaccagaagcgcaagcgcctcttcctggacagcaacggcctcttcctcttctcctccttcgcactgaccctcttgcttgtggcgctctgggtcgcctggctgtggaatgaccctgttctcaggaagaagtacccgggtgtcatctacgtccctgagccctgggctttctacacccttcacgtcagcagtcggcactgagtccctggcaccaggctctggcgctctgctgggtgggagggtgggccatggagggcatctgaatacaggagtagggggggtgtgggtgtgtaaccagagaccgagagcatgagtggggtgtgcctcgtgtgcgtggattcgtgtgtgtgtgtgtgtcttgtatatgtgtgcgcagagtgcatcattttcagactctactatttccgtcaagtttctgtttgatttggatcatctcaggatcggattctgttttagagtgtttctgggccaggatccgggcccctgccctcctctgcacctgaccacactccctactcagggctagtctgttcttcccggacatcttctggtagccgtgcaggagagggctgggtggggcagaggccaggaggggacctggtgtgtcacctgcccaccacctggctcatccctcaggcccaccctgaccctacattacataggttacgtcagcctactgtggctgttgagcaaagcatttctcctttctgggcctcatttgcactagatgggcctgcccccagccacggggacgcgggattcaagaatgaagtaaatacagtcacaggccccaa

SEQ ID NO: 313283 - DNA, 6936 bp, Homo sapiens
  misc_feature (4185)..(4185): n is a, c, g, or t
gggcagccgcggcagaggagccgcagccgcagcggggccgggccgggccgggcgcgcaccagcggcagcggcagcggcagcggcggcggcagcatctcgctctcggagccggcgcaggtttccctgtacttagagcgtggactgtgaacccccaagcagacgagctgaacttcgtcacccagtccctagagccagcaagacatgggccccagtttccagaccctgacacctctcatttaaccagaagacgtggaggggagccaccacccctgaccatgtagatgccagttccagggagcagcatgggccccactgaatggagactcctgggtctacagccctgagcccctccggcccctggacctcgtcccacaccggaggacacctcttggagctcaccaccactgtcaccagcccgcctcggccacccccaccccccgggacccggagtcggccgcctggtgccacagctgaccagtgagggtgtgctgaggacagccacaagcagccatcacccggcagcctcttgtccagcgctgacccttgggcccagcccgagcaaggaccgcagcaaacatgggtgacatgaccaacagcgacttttactccaaaaaccaaagaaatgagtcgagccatgggggcgagttcgggtgcacaatggaggagctccgctccctcatggagctgcggggcactgaggctgtggtcaagatcaaggagacttatggggacaccgaagccatctgccggcgcctcaaaacctcacctgttgaaggtttgccgggcaccgctccagacctggaaaagagaaagcaaatttttgggcaaaactttatacctccaaagaagccaaaaaccttcctgcagctcgtgtgggaggcgctgcaggacgtgacgctcatcatcctggagattgccgccatcatctccctggggctgtccttctaccaccgccccggcgagggcaacgaaggatgtgcgacggcccagggtggggcagaggatgaaggagaggcagaggcaggttggatcgagggggccgccattctcctctcagttatctgtgtggtcctggtcacggccttcaatgactggagcaaagagaaacagttccggggcctgcagagccgcatcgagcaggaacagaaatttaccgtggtccgggctggccaggtggtccagatccctgtggctgagatcgtggttggggacatagcccaggtcaaatatggtgacctcctccctgccgacggactcttcatccagggcaatgacctcaagattgatgaaagctccctaactggagagtctgaccaggtgcgcaagtccgtggacaaggaccccatgctgctgtcaggaacccacgtgatggagggctcaggacggatgttggtgactgctgtgggtgtgaactctcagactggcatcatctttaccctcctgggggctggtggtgaagaggaagagaagaaagacaaaaaagccaaacagcaggacggggcagccgccatggagatgcagcccctcaagagtgccgagggcggcgacgctgacgacaggaagaaggccagcatgcacaagaaggagaagtccgtgctgcagggcaagctcaccaagctggctgtgcagatcgggaaggcgggcttggtgatgtcagccatcacggtgatcatcctggtgctctacttcactgtggacaccttcgtggtcaacaagaagccgtggctgcctgagtgcacgcccgtctacgtgcagtactttgtcaagttcttcatcattggcgtgacggtgctggtggtcgccgtgcccgaggggctccctctggccgtcaccatctcgttggcctattcggtgaagaaaatgatgaaggacaacaacctggtacgccacctggatgcctgtgagaccatgggcaatgccacagccatctgctcagacaagacaggcacgctgaccaccaatcgcatgacagtggtacaggcctatgtcgacgacgtccactataaagagatccccgaccccagctccatcaacaccaagactatggagctgctgatcaatgccatcgccatcaacagcgcctacaccaccaagattctgcccccagagaaggagggcgccctgcctcggcaggtgggcaacaagacggagtgcggcctgctgggcttcgtgctggacctgaagcaggactacgagcccgtgcgcagccagatgccagaggagaagttgtacaaagtgtacaccttcaactccgtgcgcaagtccatgagcactgtcatcaagctgcccgacgagagcttccgcatgtacagcaagggggcttctgagatcgtgctcaagaagtgctgcaaaatcctcaatggggcgggagagcctcgtgtcttccggccccgcgaccgggacgagatggtaaagaaggtgattgagcccatggcttgcgatgggctccgcactatctgcgtggcctaccgcgacttccccagcagcccggagccggactgggacaatgagaatgacatcctcaacgaactcacctgcatctgcgtggtgggcatcgaggacccggtgcggccagaggtcccagaagccatccgcaagtgccagcgggcaggcatcacggtccgcatggtcactggcgacaatatcaacacggctcgggccatcgccatcaagtgtggcatcatccatcctggggaggactttctgtgcctcgagggcaaggagttcaacaggaggatccgcaacgagaagggggagattgagcaggagcgaattgacaagatctggccaaagctgcgggtgctggctcgctcctccccaacggacaagcataccctggttaaaggcatcatcgacagcacacacactgagcagcggcaggtggtggccgtgacgggggacgggaccaacgacgggcctgcactcaagaaggccgacgtgggcttcgccatgggcatcgcaggcactgacgtggccaaggaggcctcagacatcatcctgacagacgacaatttcagcagcatcgtcaaggcagtgatgtggggccgcaacgtctatgacagcatctccaaattcttgcagttccagctcaccgtcaacgtggtggccgtgattgtggccttcacaggcgcctgcatcacgcaggactcccctctgaaggccgtgcagatgctctgggtgaacctcatcatggacacgtttgcctcgctggcactggccactgagccgcccacggagaccctgctgctgaggaagccgtacggccgcaacaagccgctcatctccaggaccatgatgaagaacatcctgggccatgctgtctaccagcttgccctcatcttcaccctgctctttgttggcgagaagatgttccagatcgacagcgggaggaacgcgcccctgcattcgccaccctcagaacattacaccatcatcttcaacaccttcgtcatgatgcagctcttcaacgagatcaacgcccgcaagatccacggcgagcgcaatgtctttgacggcatcttccggaaccccatcttctgcaccatcgtgctgggcacctttgccatccagatagtgatcgtgcagtttggagggaagccattcagctgctctccactgcagctggaccagtggatgtggtgcatattcattgggttaggagagctcgtttggggccaggtcatcgccaccatcccgaccagcagactcaagttcctcaaggaggcaggcaggctcacacagaaggaggagatcccggaggaggagctcaacgaggacgtggaggagatcgaccacgcagagcgggagctgcggcggggccagatcctgtggttccgaggcctgaatcggatccagacacagatccgcgtcgtgaaggcgttccgtagctctctctatgaaggtttagaaaagcctgaatctcgaacctccatccataacttcatggctcatcctgaattccggatcgaagattcccagccccacatccccctcattgatgacaccgacctggaagaagatgccgcgctcaagcagaactcgagcccgccgtcatccctcaacaagaacaacagcgccatcgacagtgggatcaacctgacgaccgacacaagcaaatcagctacctcttcaagtccagggagccccatccacagcctggagacgtcgctttagctgaggaccctntcgcctgcccgcccgccctcatggaccccgctgtcacccgctttccgggcacccatccatccaggcacccaactcacccaagcagcaacgagcaacaatcggaaaccaaatactggagagaaaaccaacgtttccacccacagaccctttctctggctgcgatgctgtttgaactctttttcacttcaaggcaaggggcgggatctccactgggggcttacgggagtgagcggttttcccaaaacaagcccttcctggctcccacccagacatggaccagccatgcacccgcccagccaccacgtcccccgcatgaatgtactgtacactttcaatcctccccttgtttggtttttgggggttggggaggggtttttgtttgtttgtttgttttcttaggcgggaactgcaaacagactcttttctgagactatttatccaatccactggtctgtgagtttttgaaatgcttgcacagcatggtctcagttgtatagattaatttaataactttttgaaattgcagagcttaactcgcctagtagatttgcaccaatggaaccgaagaacttcatagacactcacaaggttatatccatttctttgtatctatatcaacgtatacttttccgagactgtatacgtccatatagataggtagatatatatatatatatataaatatatatacatggatatataaagtttctttgccggcatgttgccttgtttccgcttaaattgctctattttaacttatttatgtcctaaaagaagaatgtaatttgtttacaaacctgtagataacgtctttggctatttgtatggtttaagaacactggtggctgagatgctataaaaacagctcggcccaacagacacttcccctgggttgcatcctggatgttttatgatagccatgctctgatttttgcctgctatttccgttcaataatgtcactaccgtgagaggctcaggcagaagccaaatgctaccgagttgccatcctgaggggtttaacaacatgctccgtagacgaagggagaggaggagagaaggcttcctgggtttgcaacactaacggccatccggcccaaggatgccaggatctgcaaagcactgctcgaagacttttctctcaatgaaactcgcttgagtttactaagagcatttcaaaaataggttctctttggcactgtctgtacagagattgaggtagtgttgaaatattataaatggtattgtgttgatttttttttttatttagtaacttacaggtttgtttccttattaatggcagcatctgagctgttggcatattggatgaggatcagtatggcttgctgcttttatttttatttttgaagaagaatagcctttttctctgcactatttagatccgaatgaaccttatgatgtgtatattgagatgtactcagtgtgattttaaaccaaattgtcttcctgtagtcacaatatatactgtagccttttaacagcaagtcttgctttcccaaacagaaagccattctgaaaccctacagtatcacaggtgagaaaaggtggttattttttccccaagacaacagcactagtaatcccacttaataagagcttatttaattggatgtcagcctcttaactgctaagcactttgtgggtctcagcgtttttcataaaagaacttttgtatttaatacaaagtttgctttgagacttttcagcatatgatcttttttccataaacttgtacagtgcaaaagacattttgaataccatgatcgatgatgtcccatgcttcgaggaaaaccaaacactttccgcctctcttgcaaaatccattcctcatgctgaccctcctcacgatggctgtgtcagcccagccccttcccttctccaggcccagagaactcttccacaaacaagatgagagccactcgggaaaagagccatagtcaactgggagggcctacatctggatggcggtggaaaaacttgagggtttggggttcaaagtcagcccatcccacctggcaaaatcctcctggaaggaggaccttcaagagcgcatcacctgaatgtcgtgaagaagtatctctgaatgtatccaggagaggaactgcataaccaaaggggtgaccagccctcagatgtgcttattggattccagtacaaacgccaccaaagccagcccactgctctcctacaaggaaggaaagatctgcacgtgtaaaacatggggcagccttggaacatggtgttttttggagtttcctttctcacagttttccatctccccacttctttgatcagtcatgtgtccgtgacctcgttccatgacatcaggatagctgtgtttgcacaccatgctgcatgttcatttggagccaggaggggttctcagtggagcctggcttagggaacagggagcgatggaagaatgccaacattagcgttggtcttctcttgtcaggaatgaaggatgcttgcacacatgcaccccctcactctcacacttgcacacatacacacacacacacacgaaatggttggtttgtcaaaactcactgtagtacataaagcttgcactctgcgtcctatatctagcagcatggggtacgtttggcagttcactccattagggggtaaataatttatgaccattcatctgtttttatgaatttttttatctagacaataattgtaaataaagaactcaccatctctgttcatttaaaaaaaaaatgcaa

SEQ ID NO: 313284 - DNA, 3311 bp, Homo sapiens
  misc_feature (2)..(2): n is a, c, g, or t
  misc_feature (4)..(6): n is a, c, g, or t
  misc_feature (177)..(177): n is a, c, g, or t
  misc_feature (560)..(560): n is a, c, g, or t
cngnnncagattgaagtagtcaatactttcaagagcggggcctcctttcagggggccctgcggagacagtcctcggtcaccagccagagccaggatgtagccaatctctctagccctagtcgcgtgtcgttgtccaatgctctttcctctccgaccagccttcctcctgctgcagcngggcagggctagagaaccctggacacagagttcagcaagagagagtgaaattaaaagagatccgcgtcgtgaaggcgttccgtagctctctctatgaaggtttagaaaagcctgaatctcgaacctccatccataacttcatggctcatcctgaattccggatcgaagattcccagccccacatccccctcattgatgacaccgacctggaagaagatgccgcgctcaagcagaactcgagcccgccgtcatccctcaacaagaacaacagcgccatcgacagtgggatcaacctgacgaccgacacaagcaaatcagctacctcttcaagtccagggagccccatccacagcctggagacgtcgctttagctgaggaccctntcgcctgcccgcccgccctcatggaccccgctgtcacccgctttccgggcacccatccatccaggcacccaactcacccaagcagcaacgagcaacaatcggaaaccaaatactggagagaaaaccaacgtttccacccacagaccctttctctggctgcgatgctgtttgaactctttttcacttcaaggcaaggggcgggatctccactgggggcttacgggagtgagcggttttcccaaaacaagcccttcctggctcccacccagacatggaccagccatgcacccgcccagccaccacgtcccccgcatgaatgtactgtacactttcaatcctccccttgtttggtttttgggggttggggaggggtttttgtttgtttgtttgttttcttaggcgggaactgcaaacagactcttttctgagactatttatccaatccactggtctgtgagtttttgaaatgcttgcacagcatggtctcagttgtatagattaatttaataactttttgaaattgcagagcttaactcgcctagtagatttgcaccaatggaaccgaagaacttcatagacactcacaaggttatatccatttctttgtatctatatcaacgtatacttttccgagactgtatacgtccatatagataggtagatatatatatatatatataaatatatatacatggatatataaagtttctttgccggcatgttgccttgtttccgcttaaattgctctattttaacttatttatgtcctaaaagaagaatgtaatttgtttacaaacctgtagataacgtctttggctatttgtatggtttaagaacactggtggctgagatgctataaaaacagctcggcccaacagacacttcccctgggttgcatcctggatgttttatgatagccatgctctgatttttgcctgctatttccgttcaataatgtcactaccgtgagaggctcaggcagaagccaaatgctaccgagttgccatcctgaggggtttaacaacatgctccgtagacgaagggagaggaggagagaaggcttcctgggtttgcaacactaacggccatccggcccaaggatgccaggatctgcaaagcactgctcgaagacttttctctcaatgaaactcgcttgagtttactaagagcatttcaaaaataggttctctttggcactgtctgtacagagattgaggtagtgttgaaatattataaatggtattgtgttgatttttttttttatttagtaacttacaggtttgtttccttattaatggcagcatctgagctgttggcatattggatgaggatcagtatggcttgctgcttttatttttatttttgaagaagaatagcctttttctctgcactatttagatccgaatgaaccttatgatgtgtatattgagatgtactcagtgtgattttaaaccaaattgtcttcctgtagtcacaatatatactgtagccttttaacagcaagtcttgctttcccaaacagaaagccattctgaaaccctacagtatcacaggtgagaaaaggtggttattttttccccaagacaacagcactagtaatcccacttaataagagcttatttaattggatgtcagcctcttaactgctaagcactttgtgggtctcagcgtttttcataaaagaacttttgtatttaatacaaagtttgctttgagacttttcagcatatgatcttttttccataaacttgtacagtgcaaaagacattttgaataccatgatcgatgatgtcccatgcttcgaggaaaaccaaacactttccgcctctcttgcaaaatccattcctcatgctgaccctcctcacgatggctgtgtcagcccagccccttcccttctccaggcccagagaactcttccacaaacaagatgagagccactcgggaaaagagccatagtcaactgggagggcctacatctggatggcggtggaaaaacttgagggtttggggttcaaagtcagcccatcccacctggcaaaatcctcctggaaggaggaccttcaagagcgcatcacctgaatgtcgtgaagaagtatctctgaatgtatccaggagaggaactgcataaccaaaggggtgaccagccctcagatgtgcttattggattccagtacaaacgccaccaaagccagcccactgctctcctacaaggaaggaaagatctgcacgtgtaaaacatggggcagccttggaacatggtgttttttggagtttcctttctcacagttttccatctccccacttctttgatcagtcatgtgtccgtgacctcgttccatgacatcaggatagctgtgtttgcacaccatgctgcatgttcatttggagccaggaggggttctcagtggagcctggcttagggaacagggagcgatggaagaatgccaacattagcgttggtcttctcttgtcaggaatgaaggatgcttgcacacatgcaccccctcactctcacacttgcacacatacacacacacacacacgaaatggttggtttgtcaaaactcactgtagtacataaagcttgcactctgcgtcctatatctagcagcatggggtacgtttggcagttcactccattagggggtaaataatttatgaccattcatctgtttttatgaatttttttatctagacaataattgtaaataaagaactcaccatctctgttcatttaaaaaaaaaatgcaa

SEQ ID NO: 313285 - DNA, 3260 bp, Homo sapiens
  misc_feature (509)..(509): n is a, c, g, or t
cataagccaggtccaagccacattctggacgccgtaccttgctagacagataaggcacctcctgctcccacttcccctgcagattcctggttctgacgactcctagggcaaggagtttgcactgttagggggagaaatgaagacaacaaaaagggaagaaagctggacttctcattagcgttttgatccgcgtcgtgaaggcgttccgtagctctctctatgaaggtttagaaaagcctgaatctcgaacctccatccataacttcatggctcatcctgaattccggatcgaagattcccagccccacatccccctcattgatgacaccgacctggaagaagatgccgcgctcaagcagaactcgagcccgccgtcatccctcaacaagaacaacagcgccatcgacagtgggatcaacctgacgaccgacacaagcaaatcagctacctcttcaagtccagggagccccatccacagcctggagacgtcgctttagctgaggaccctntcgcctgcccgcccgccctcatggaccccgctgtcacccgctttccgggcacccatccatccaggcacccaactcacccaagcagcaacgagcaacaatcggaaaccaaatactggagagaaaaccaacgtttccacccacagaccctttctctggctgcgatgctgtttgaactctttttcacttcaaggcaaggggcgggatctccactgggggcttacgggagtgagcggttttcccaaaacaagcccttcctggctcccacccagacatggaccagccatgcacccgcccagccaccacgtcccccgcatgaatgtactgtacactttcaatcctccccttgtttggtttttgggggttggggaggggtttttgtttgtttgtttgttttcttaggcgggaactgcaaacagactcttttctgagactatttatccaatccactggtctgtgagtttttgaaatgcttgcacagcatggtctcagttgtatagattaatttaataactttttgaaattgcagagcttaactcgcctagtagatttgcaccaatggaaccgaagaacttcatagacactcacaaggttatatccatttctttgtatctatatcaacgtatacttttccgagactgtatacgtccatatagataggtagatatatatatatatatataaatatatatacatggatatataaagtttctttgccggcatgttgccttgtttccgcttaaattgctctattttaacttatttatgtcctaaaagaagaatgtaatttgtttacaaacctgtagataacgtctttggctatttgtatggtttaagaacactggtggctgagatgctataaaaacagctcggcccaacagacacttcccctgggttgcatcctggatgttttatgatagccatgctctgatttttgcctgctatttccgttcaataatgtcactaccgtgagaggctcaggcagaagccaaatgctaccgagttgccatcctgaggggtttaacaacatgctccgtagacgaagggagaggaggagagaaggcttcctgggtttgcaacactaacggccatccggcccaaggatgccaggatctgcaaagcactgctcgaagacttttctctcaatgaaactcgcttgagtttactaagagcatttcaaaaataggttctctttggcactgtctgtacagagattgaggtagtgttgaaatattataaatggtattgtgttgatttttttttttatttagtaacttacaggtttgtttccttattaatggcagcatctgagctgttggcatattggatgaggatcagtatggcttgctgcttttatttttatttttgaagaagaatagcctttttctctgcactatttagatccgaatgaaccttatgatgtgtatattgagatgtactcagtgtgattttaaaccaaattgtcttcctgtagtcacaatatatactgtagccttttaacagcaagtcttgctttcccaaacagaaagccattctgaaaccctacagtatcacaggtgagaaaaggtggttattttttccccaagacaacagcactagtaatcccacttaataagagcttatttaattggatgtcagcctcttaactgctaagcactttgtgggtctcagcgtttttcataaaagaacttttgtatttaatacaaagtttgctttgagacttttcagcatatgatcttttttccataaacttgtacagtgcaaaagacattttgaataccatgatcgatgatgtcccatgcttcgaggaaaaccaaacactttccgcctctcttgcaaaatccattcctcatgctgaccctcctcacgatggctgtgtcagcccagccccttcccttctccaggcccagagaactcttccacaaacaagatgagagccactcgggaaaagagccatagtcaactgggagggcctacatctggatggcggtggaaaaacttgagggtttggggttcaaagtcagcccatcccacctggcaaaatcctcctggaaggaggaccttcaagagcgcatcacctgaatgtcgtgaagaagtatctctgaatgtatccaggagaggaactgcataaccaaaggggtgaccagccctcagatgtgcttattggattccagtacaaacgccaccaaagccagcccactgctctcctacaaggaaggaaagatctgcacgtgtaaaacatggggcagccttggaacatggtgttttttggagtttcctttctcacagttttccatctccccacttctttgatcagtcatgtgtccgtgacctcgttccatgacatcaggatagctgtgtttgcacaccatgctgcatgttcatttggagccaggaggggttctcagtggagcctggcttagggaacagggagcgatggaagaatgccaacattagcgttggtcttctcttgtcaggaatgaaggatgcttgcacacatgcaccccctcactctcacacttgcacacatacacacacacacacacgaaatggttggtttgtcaaaactcactgtagtacataaagcttgcactctgcgtcctatatctagcagcatggggtacgtttggcagttcactccattagggggtaaataatttatgaccattcatctgtttttatgaatttttttatctagacaataattgtaaataaagaactcaccatctctgttcatttaaaaaaaaaatgcaa

SEQ ID NO: 313286 - DNA, 5019 bp, Homo sapiens
  misc_feature (4320)..(4320): n is a, c, g, or t
gggcagccgcggcagaggagccgcagccgcagcggggccgggccgggccgggcgcgcaccagcggcagcggcagcggcagcggcggcggcagcatctcgctctcggagccggcgcaggtttccctgtacttagagcgtggactgtgaacccccaagcagacgagctgaacttcgtcacccagtccctagagccagcaagacatgggccccagtttccagaccctgacacctctcatttaaccagaagacgtggaggggagccaccacccctgaccatgtagatgccagttccagggagcagcatgggccccactgaatggagactcctgggtctacagccctgagcccctccggcccctggacctcgtcccacaccggaggacacctcttggagctcaccaccactgtcaccagcccgcctcggccacccccaccccccgggacccggagtcggccgcctggtgccacagctgaccagtgagggtgtgctgaggacagccacaagcagccatcacccggcagcctcttgtccagcgctgacccttgggcccagcccgagcaaggaccgcagcaaacatgggtgacatgaccaacagcgacttttactccaaaaaccaaagaaatgagtcgagccatgggggcgagttcgggtgcacaatggaggagctccgctccctcatggagctgcggggcactgaggctgtggtcaagatcaaggagacttatggggacaccgaagccatctgccggcgcctcaaaacctcacctgttgaaggtttgccgggcaccgctccagacctggaaaagagaaagcaaatttttgggcaaaactttatacctccaaagaagccaaaaaccttcctgcagctcgtgtgggaggcgctgcaggacgtgacgctcatcatcctggagattgccgccatcatctccctggggctgtccttctaccaccgccccggcgagggcaacgaaggatgtgcgacggcccagggtggggcagaggatgaaggagaggcagaggcaggttggatcgagggggccgccattctcctctcagttatctgtgtggtcctggtcacggccttcaatgactggagcaaagagaaacagttccggggcctgcagagccgcatcgagcaggaacagaaatttaccgtggtccgggctggccaggtggtccagatccctgtggctgagatcgtggttggggacatagcccaggtcaaatatggtgacctcctccctgccgacggactcttcatccagggcaatgacctcaagattgatgaaagctccctaactggagagtctgaccaggtgcgcaagtccgtggacaaggaccccatgctgctgtcaggaacccacgtgatggagggctcaggacggatgttggtgactgctgtgggtgtgaactctcagactggcatcatctttaccctcctgggggctggtggtgaagaggaagagaagaaagacaaaaaaggtgtgaagaagggggatggccttcagctaccagcagcagacggtgcggcagcttcaaacgctgcagatagtgcgaatgccagcctagtcaatggtaaaatgcaggatggcaatgtggacgccagccagagcaaagccaaacagcaggacggggcagccgccatggagatgcagcccctcaagagtgccgagggcggcgacgctgacgacaggaagaaggccagcatgcacaagaaggagaagtccgtgctgcagggcaagctcaccaagctggctgtgcagatcgggaaggcgggcttggtgatgtcagccatcacggtgatcatcctggtgctctacttcactgtggacaccttcgtggtcaacaagaagccgtggctgcctgagtgcacgcccgtctacgtgcagtactttgtcaagttcttcatcattggcgtgacggtgctggtggtcgccgtgcccgaggggctccctctggccgtcaccatctcgttggcctattcggtgaagaaaatgatgaaggacaacaacctggtacgccacctggatgcctgtgagaccatgggcaatgccacagccatctgctcagacaagacaggcacgctgaccaccaatcgcatgacagtggtacaggcctatgtcgacgacgtccactataaagagatccccgaccccagctccatcaacaccaagactatggagctgctgatcaatgccatcgccatcaacagcgcctacaccaccaagattctgcccccagagaaggagggcgccctgcctcggcaggtgggcaacaagacggagtgcggcctgctgggcttcgtgctggacctgaagcaggactacgagcccgtgcgcagccagatgccagaggagaagttgtacaaagtgtacaccttcaactccgtgcgcaagtccatgagcactgtcatcaagctgcccgacgagagcttccgcatgtacagcaagggggcttctgagatcgtgctcaagaagtgctgcaaaatcctcaatggggcgggagagcctcgtgtcttccggccccgcgaccgggacgagatggtaaagaaggtgattgagcccatggcttgcgatgggctccgcactatctgcgtggcctaccgcgacttccccagcagcccggagccggactgggacaatgagaatgacatcctcaacgaactcacctgcatctgcgtggtgggcatcgaggacccggtgcggccagaggtcccagaagccatccgcaagtgccagcgggcaggcatcacggtccgcatggtcactggcgacaatatcaacacggctcgggccatcgccatcaagtgtggcatcatccatcctggggaggactttctgtgcctcgagggcaaggagttcaacaggaggatccgcaacgagaagggggagattgagcaggagcgaattgacaagatctggccaaagctgcgggtgctggctcgctcctccccaacggacaagcataccctggttaaaggcatcatcgacagcacacacactgagcagcggcaggtggtggccgtgacgggggacgggaccaacgacgggcctgcactcaagaaggccgacgtgggcttcgccatgggcatcgcaggcactgacgtggccaaggaggcctcagacatcatcctgacagacgacaatttcagcagcatcgtcaaggcagtgatgtggggccgcaacgtctatgacagcatctccaaattcttgcagttccagctcaccgtcaacgtggtggccgtgattgtggccttcacaggcgcctgcatcacgcaggactcccctctgaaggccgtgcagatgctctgggtgaacctcatcatggacacgtttgcctcgctggcactggccactgagccgcccacggagaccctgctgctgaggaagccgtacggccgcaacaagccgctcatctccaggaccatgatgaagaacatcctgggccatgctgtctaccagcttgccctcatcttcaccctgctctttgttggcgagaagatgttccagatcgacagcgggaggaacgcgcccctgcattcgccaccctcagaacattacaccatcatcttcaacaccttcgtcatgatgcagctcttcaacgagatcaacgcccgcaagatccacggcgagcgcaatgtctttgacggcatcttccggaaccccatcttctgcaccatcgtgctgggcacctttgccatccagatagtgatcgtgcagtttggagggaagccattcagctgctctccactgcagctggaccagtggatgtggtgcatattcattgggttaggagagctcgtttggggccaggtcatcgccaccatcccgaccagcagactcaagttcctcaaggaggcaggcaggctcacacagaaggaggagatcccggaggaggagctcaacgaggacgtggaggagatcgaccacgcagagcgggagctgcggcggggccagatcctgtggttccgaggcctgaatcggatccagacacagatccgcgtcgtgaaggcgttccgtagctctctctatgaaggtttagaaaagcctgaatctcgaacctccatccataacttcatggctcatcctgaattccggatcgaagattcccagccccacatccccctcattgatgacaccgacctggaagaagatgccgcgctcaagcagaactcgagcccgccgtcatccctcaacaagaacaacagcgccatcgacagtgggatcaacctgacgaccgacacaagcaaatcagctacctcttcaagtccagggagccccatccacagcctggagacgtcgctttagctgaggaccctntcgcctgcccgcccgccctcatggaccccgctgtcacccgctttccgggcacccatccatccaggcacccaactcacccaagcagcaacgagcaacaatcggaaaccaaatactggagagaaaaccaacgtttccacccacagaccctttctctggctgcgatgctgtttgaactctttttcacttcaaggcaaggggcgggatctccactgggggcttacgggagtgagcggttttcccaaaacaagcccttcctggctcccacccagacatggaccagccatgcacccgcccagccaccacgtcccccgcatgaatgtactgtacactttcaatcctccccttgtttggtttttgggggttggggaggggtttttgtttgtttgtttgttttcttaggcgggaactgcaaacagactcttttctgagactatttatccaatccactggtctgtgagtttttgaaatgcttgcacagcatggtctcagttgtatagattaatttaataactttttgaaattgcagagcttaactcgcctagtagatttgcaccaatggaaccgaagaacttcatagacactcacaaggttatatccatttctttgtatctatatcaacgtatacttttccgagactgtatacgtccatatagataggtagatatatatatatatatataaatatatatacatggatat

SEQ ID NO: 313287 - DNA, 1127 bp, Homo sapiens
cacattgctttagcatcccttctgtcttttgacgtgggtctcagcgtttttcataaaagaacttttgtatttaatacaaagtttgctttgagacttttcagcatatgatcttttttccataaacttgtacagtgcaaaagacattttgaataccatgatcgatgatgtcccatgcttcgaggaaaaccaaacactttccgcctctcttgcaaaatccattcctcatgctgaccctcctcacgatggctgtgtcagcccagccccttcccttctccaggcccagagaactcttccacaaacaagatgagagccactcgggaaaagagccatagtcaactgggagggcctacatctggatggcggtggaaaaacttgagggtttggggttcaaagtcagcccatcccacctggcaaaatcctcctggaaggaggaccttcaagagcgcatcacctgaatgtcgtgaagaagtatctctgaatgtatccaggagaggaactgcataaccaaaggggtgaccagccctcagatgtgcttattggattccagtacaaacgccaccaaagccagcccactgctctcctacaaggaaggaaagatctgcacgtgtaaaacatggggcagccttggaacatggtgttttttggagtttcctttctcacagttttccatctccccacttctttgatcagtcatgtgtccgtgacctcgttccatgacatcaggatagctgtgtttgcacaccatgctgcatgttcatttggagccaggaggggttctcagtggagcctggcttagggaacagggagcgatggaagaatgccaacattagcgttggtcttctcttgtcaggaatgaaggatgcttgcacacatgcaccccctcactctcacacttgcacacatacacacacacacacacgaaatggttggtttgtcaaaactcactgtagtacataaagcttgcactctgcgtcctatatctagcagcatggggtacgtttggcagttcactccattagggggtaaataatttatgaccattcatctgtttttatgaatttttttatctagacaataattgtaaataaagaactcaccatctctgttcatttaaaaaaaaaatgcaa

SEQ ID NO: 313288 - DNA, 387 bp, Homo sapiens
agacaacaaaaagggaagaaagctggacttctcattagcgttttggtaactaatttagtgcaaccttgggttggcgagaaaatggcttgctttgtggggggaaccctagacctctccactgtctgaatattccatgtgtttgtttccctagagggctagagaaccctggacacagagttcagcaagagagagtgaaattaaaagaggttgtgagtctttaaccttgagcctgaaatgaatgtgaatcaatcccagactcttggcttccttgaagccgggtaaacattcgagtatgtagaacccatctcagaccagggcctgtgcgttttctcagagccctctgacaacgggcatgggtctccctgttccctttgtgctgacgaaacc

SEQ ID NO: 313289 - DNA, 6785 bp, Homo sapiens
  misc_feature (4034)..(4034): n is a, c, g, or t
gaattccccgctggctgggctcagccgcggcaccagctgccgcaccgcgattacggggctgcccgccgggaaaccgtgcaggattggtggtgattttcatagccaagagccaccacccctgaccatgtagatgccagttccagggagcagcatgggccccactgaatggagactcctgggtctacagccctgagcccctccggcccctggacctcgtcccacaccggaggacacctcttggagctcaccaccactgtcaccagcccgcctcggccacccccaccccccgggacccggagtcggccgcctggtgccacagctgaccagtgagggtgtgctgaggacagccacaagcagccatcacccggcagcctcttgtccagcgctgacccttgggcccagcccgagcaaggaccgcagcaaacatgggtgacatgaccaacagcgacttttactccaaaaaccaaagaaatgagtcgagccatgggggcgagttcgggtgcacaatggaggagctccgctccctcatggagctgcggggcactgaggctgtggtcaagatcaaggagacttatggggacaccgaagccatctgccggcgcctcaaaacctcacctgttgaaggtttgccgggcaccgctccagacctggaaaagagaaagcaaatttttgggcaaaactttatacctccaaagaagccaaaaaccttcctgcagctcgtgtgggaggcgctgcaggacgtgacgctcatcatcctggagattgccgccatcatctccctggggctgtccttctaccaccgccccggcgagggcaacgaaggatgtgcgacggcccagggtggggcagaggatgaaggagaggcagaggcaggttggatcgagggggccgccattctcctctcagttatctgtgtggtcctggtcacggccttcaatgactggagcaaagagaaacagttccggggcctgcagagccgcatcgagcaggaacagaaatttaccgtggtccgggctggccaggtggtccagatccctgtggctgagatcgtggttggggacatagcccaggtcaaatatggtgacctcctccctgccgacggactcttcatccagggcaatgacctcaagattgatgaaagctccctaactggagagtctgaccaggtgcgcaagtccgtggacaaggaccccatgctgctgtcaggaacccacgtgatggagggctcaggacggatgttggtgactgctgtgggtgtgaactctcagactggcatcatctttaccctcctgggggctggtggtgaagaggaagagaagaaagacaaaaaagccaaacagcaggacggggcagccgccatggagatgcagcccctcaagagtgccgagggcggcgacgctgacgacaggaagaaggccagcatgcacaagaaggagaagtccgtgctgcagggcaagctcaccaagctggctgtgcagatcgggaaggcgggcttggtgatgtcagccatcacggtgatcatcctggtgctctacttcactgtggacaccttcgtggtcaacaagaagccgtggctgcctgagtgcacgcccgtctacgtgcagtactttgtcaagttcttcatcattggcgtgacggtgctggtggtcgccgtgcccgaggggctccctctggccgtcaccatctcgttggcctattcggtgaagaaaatgatgaaggacaacaacctggtacgccacctggatgcctgtgagaccatgggcaatgccacagccatctgctcagacaagacaggcacgctgaccaccaatcgcatgacagtggtacaggcctatgtcgacgacgtccactataaagagatccccgaccccagctccatcaacaccaagactatggagctgctgatcaatgccatcgccatcaacagcgcctacaccaccaagattctgcccccagagaaggagggcgccctgcctcggcaggtgggcaacaagacggagtgcggcctgctgggcttcgtgctggacctgaagcaggactacgagcccgtgcgcagccagatgccagaggagaagttgtacaaagtgtacaccttcaactccgtgcgcaagtccatgagcactgtcatcaagctgcccgacgagagcttccgcatgtacagcaagggggcttctgagatcgtgctcaagaagtgctgcaaaatcctcaatggggcgggagagcctcgtgtcttccggccccgcgaccgggacgagatggtaaagaaggtgattgagcccatggcttgcgatgggctccgcactatctgcgtggcctaccgcgacttccccagcagcccggagccggactgggacaatgagaatgacatcctcaacgaactcacctgcatctgcgtggtgggcatcgaggacccggtgcggccagaggtcccagaagccatccgcaagtgccagcgggcaggcatcacggtccgcatggtcactggcgacaatatcaacacggctcgggccatcgccatcaagtgtggcatcatccatcctggggaggactttctgtgcctcgagggcaaggagttcaacaggaggatccgcaacgagaagggggagattgagcaggagcgaattgacaagatctggccaaagctgcgggtgctggctcgctcctccccaacggacaagcataccctggttaaaggcatcatcgacagcacacacactgagcagcggcaggtggtggccgtgacgggggacgggaccaacgacgggcctgcactcaagaaggccgacgtgggcttcgccatgggcatcgcaggcactgacgtggccaaggaggcctcagacatcatcctgacagacgacaatttcagcagcatcgtcaaggcagtgatgtggggccgcaacgtctatgacagcatctccaaattcttgcagttccagctcaccgtcaacgtggtggccgtgattgtggccttcacaggcgcctgcatcacgcaggactcccctctgaaggccgtgcagatgctctgggtgaacctcatcatggacacgtttgcctcgctggcactggccactgagccgcccacggagaccctgctgctgaggaagccgtacggccgcaacaagccgctcatctccaggaccatgatgaagaacatcctgggccatgctgtctaccagcttgccctcatcttcaccctgctctttgttggcgagaagatgttccagatcgacagcgggaggaacgcgcccctgcattcgccaccctcagaacattacaccatcatcttcaacaccttcgtcatgatgcagctcttcaacgagatcaacgcccgcaagatccacggcgagcgcaatgtctttgacggcatcttccggaaccccatcttctgcaccatcgtgctgggcacctttgccatccagatagtgatcgtgcagtttggagggaagccattcagctgctctccactgcagctggaccagtggatgtggtgcatattcattgggttaggagagctcgtttggggccaggtcatcgccaccatcccgaccagcagactcaagttcctcaaggaggcaggcaggctcacacagaaggaggagatcccggaggaggagctcaacgaggacgtggaggagatcgaccacgcagagcgggagctgcggcggggccagatcctgtggttccgaggcctgaatcggatccagacacagatccgcgtcgtgaaggcgttccgtagctctctctatgaaggtttagaaaagcctgaatctcgaacctccatccataacttcatggctcatcctgaattccggatcgaagattcccagccccacatccccctcattgatgacaccgacctggaagaagatgccgcgctcaagcagaactcgagcccgccgtcatccctcaacaagaacaacagcgccatcgacagtgggatcaacctgacgaccgacacaagcaaatcagctacctcttcaagtccagggagccccatccacagcctggagacgtcgctttagctgaggaccctntcgcctgcccgcccgccctcatggaccccgctgtcacccgctttccgggcacccatccatccaggcacccaactcacccaagcagcaacgagcaacaatcggaaaccaaatactggagagaaaaccaacgtttccacccacagaccctttctctggctgcgatgctgtttgaactctttttcacttcaaggcaaggggcgggatctccactgggggcttacgggagtgagcggttttcccaaaacaagcccttcctggctcccacccagacatggaccagccatgcacccgcccagccaccacgtcccccgcatgaatgtactgtacactttcaatcctccccttgtttggtttttgggggttggggaggggtttttgtttgtttgtttgttttcttaggcgggaactgcaaacagactcttttctgagactatttatccaatccactggtctgtgagtttttgaaatgcttgcacagcatggtctcagttgtatagattaatttaataactttttgaaattgcagagcttaactcgcctagtagatttgcaccaatggaaccgaagaacttcatagacactcacaaggttatatccatttctttgtatctatatcaacgtatacttttccgagactgtatacgtccatatagataggtagatatatatatatatatataaatatatatacatggatatataaagtttctttgccggcatgttgccttgtttccgcttaaattgctctattttaacttatttatgtcctaaaagaagaatgtaatttgtttacaaacctgtagataacgtctttggctatttgtatggtttaagaacactggtggctgagatgctataaaaacagctcggcccaacagacacttcccctgggttgcatcctggatgttttatgatagccatgctctgatttttgcctgctatttccgttcaataatgtcactaccgtgagaggctcaggcagaagccaaatgctaccgagttgccatcctgaggggtttaacaacatgctccgtagacgaagggagaggaggagagaaggcttcctgggtttgcaacactaacggccatccggcccaaggatgccaggatctgcaaagcactgctcgaagacttttctctcaatgaaactcgcttgagtttactaagagcatttcaaaaataggttctctttggcactgtctgtacagagattgaggtagtgttgaaatattataaatggtattgtgttgatttttttttttatttagtaacttacaggtttgtttccttattaatggcagcatctgagctgttggcatattggatgaggatcagtatggcttgctgcttttatttttatttttgaagaagaatagcctttttctctgcactatttagatccgaatgaaccttatgatgtgtatattgagatgtactcagtgtgattttaaaccaaattgtcttcctgtagtcacaatatatactgtagccttttaacagcaagtcttgctttcccaaacagaaagccattctgaaaccctacagtatcacaggtgagaaaaggtggttattttttccccaagacaacagcactagtaatcccacttaataagagcttatttaattggatgtcagcctcttaactgctaagcactttgtgggtctcagcgtttttcataaaagaacttttgtatttaatacaaagtttgctttgagacttttcagcatatgatcttttttccataaacttgtacagtgcaaaagacattttgaataccatgatcgatgatgtcccatgcttcgaggaaaaccaaacactttccgcctctcttgcaaaatccattcctcatgctgaccctcctcacgatggctgtgtcagcccagccccttcccttctccaggcccagagaactcttccacaaacaagatgagagccactcgggaaaagagccatagtcaactgggagggcctacatctggatggcggtggaaaaacttgagggtttggggttcaaagtcagcccatcccacctggcaaaatcctcctggaaggaggaccttcaagagcgcatcacctgaatgtcgtgaagaagtatctctgaatgtatccaggagaggaactgcataaccaaaggggtgaccagccctcagatgtgcttattggattccagtacaaacgccaccaaagccagcccactgctctcctacaaggaaggaaagatctgcacgtgtaaaacatggggcagccttggaacatggtgttttttggagtttcctttctcacagttttccatctccccacttctttgatcagtcatgtgtccgtgacctcgttccatgacatcaggatagctgtgtttgcacaccatgctgcatgttcatttggagccaggaggggttctcagtggagcctggcttagggaacagggagcgatggaagaatgccaacattagcgttggtcttctcttgtcaggaatgaaggatgcttgcacacatgcaccccctcactctcacacttgcacacatacacacacacacacacgaaatggttggtttgtcaaaactcactgtagtacataaagcttgcactctgcgtcctatatctagcagcatggggtacgtttggcagttcactccattagggggtaaataatttatgaccattcatctgtttttatgaatttttttatctagacaataattgtaaataaagaactcaccatctctgttcatttaaaaaaaaaatgcaa

SEQ ID NO: 313290 - DNA, 3148 bp, Homo sapiens
  misc_feature (397)..(397): n is a, c, g, or t
tgactcatagaggatccctgatgacggcgggacagatcctgtgttaccgaggctgaatcggatccagacacagatccgcgtcgtgaaggcgttccgtagctctctctatgaaggtttagaaaagcctgaatctcgaacctccatccataacttcatggctcatcctgaattccggatcgaagattcccagccccacatccccctcattgatgacaccgacctggaagaagatgccgcgctcaagcagaactcgagcccgccgtcatccctcaacaagaacaacagcgccatcgacagtgggatcaacctgacgaccgacacaagcaaatcagctacctcttcaagtccagggagccccatccacagcctggagacgtcgctttagctgaggaccctntcgcctgcccgcccgccctcatggaccccgctgtcacccgctttccgggcacccatccatccaggcacccaactcacccaagcagcaacgagcaacaatcggaaaccaaatactggagagaaaaccaacgtttccacccacagaccctttctctggctgcgatgctgtttgaactctttttcacttcaaggcaaggggcgggatctccactgggggcttacgggagtgagcggttttcccaaaacaagcccttcctggctcccacccagacatggaccagccatgcacccgcccagccaccacgtcccccgcatgaatgtactgtacactttcaatcctccccttgtttggtttttgggggttggggaggggtttttgtttgtttgtttgttttcttaggcgggaactgcaaacagactcttttctgagactatttatccaatccactggtctgtgagtttttgaaatgcttgcacagcatggtctcagttgtatagattaatttaataactttttgaaattgcagagcttaactcgcctagtagatttgcaccaatggaaccgaagaacttcatagacactcacaaggttatatccatttctttgtatctatatcaacgtatacttttccgagactgtatacgtccatatagataggtagatatatatatatatatataaatatatatacatggatatataaagtttctttgccggcatgttgccttgtttccgcttaaattgctctattttaacttatttatgtcctaaaagaagaatgtaatttgtttacaaacctgtagataacgtctttggctatttgtatggtttaagaacactggtggctgagatgctataaaaacagctcggcccaacagacacttcccctgggttgcatcctggatgttttatgatagccatgctctgatttttgcctgctatttccgttcaataatgtcactaccgtgagaggctcaggcagaagccaaatgctaccgagttgccatcctgaggggtttaacaacatgctccgtagacgaagggagaggaggagagaaggcttcctgggtttgcaacactaacggccatccggcccaaggatgccaggatctgcaaagcactgctcgaagacttttctctcaatgaaactcgcttgagtttactaagagcatttcaaaaataggttctctttggcactgtctgtacagagattgaggtagtgttgaaatattataaatggtattgtgttgatttttttttttatttagtaacttacaggtttgtttccttattaatggcagcatctgagctgttggcatattggatgaggatcagtatggcttgctgcttttatttttatttttgaagaagaatagcctttttctctgcactatttagatccgaatgaaccttatgatgtgtatattgagatgtactcagtgtgattttaaaccaaattgtcttcctgtagtcacaatatatactgtagccttttaacagcaagtcttgctttcccaaacagaaagccattctgaaaccctacagtatcacaggtgagaaaaggtggttattttttccccaagacaacagcactagtaatcccacttaataagagcttatttaattggatgtcagcctcttaactgctaagcactttgtgggtctcagcgtttttcataaaagaacttttgtatttaatacaaagtttgctttgagacttttcagcatatgatcttttttccataaacttgtacagtgcaaaagacattttgaataccatgatcgatgatgtcccatgcttcgaggaaaaccaaacactttccgcctctcttgcaaaatccattcctcatgctgaccctcctcacgatggctgtgtcagcccagccccttcccttctccaggcccagagaactcttccacaaacaagatgagagccactcgggaaaagagccatagtcaactgggagggcctacatctggatggcggtggaaaaacttgagggtttggggttcaaagtcagcccatcccacctggcaaaatcctcctggaaggaggaccttcaagagcgcatcacctgaatgtcgtgaagaagtatctctgaatgtatccaggagaggaactgcataaccaaaggggtgaccagccctcagatgtgcttattggattccagtacaaacgccaccaaagccagcccactgctctcctacaaggaaggaaagatctgcacgtgtaaaacatggggcagccttggaacatggtgttttttggagtttcctttctcacagttttccatctccccacttctttgatcagtcatgtgtccgtgacctcgttccatgacatcaggatagctgtgtttgcacaccatgctgcatgttcatttggagccaggaggggttctcagtggagcctggcttagggaacagggagcgatggaagaatgccaacattagcgttggtcttctcttgtcaggaatgaaggatgcttgcacacatgcaccccctcactctcacacttgcacacatacacacacacacacacgaaatggttggtttgtcaaaactcactgtagtacataaagcttgcactctgcgtcctatatctagcagcatggggtacgtttggcagttcactccattagggggtaaataatttatgaccattcatctgtttttatgaatttttttatctagacaataattgtaaataaagaactcaccatctctgttcatttaaaaaaaaaatgcaa

SEQ ID NO: 313291 - DNA, 735 bp, Homo sapiens
ggctactacagtagagacgagacagcagtggcctcaccaaggaggtagaaaacaggcgagaagaggttatattaggaatatgttttggcagagccaacaccattagctgatcaagcagatgtgcgttgtgacagaaggaaaggagtcaaggatgacactaagatctgtgcccggagacactggcccagtggcggtgccgcttcctgagaggaggaggagtggcaggaggagactccgtggggggaatcagagttctgttctggccaattacagctgagatgtctgcttgtagagacggtaattaaagccacaaggtggaacaagatatccatggaagcaggtattggataaacaagagaagaaaccaatggactcagaatcccagctccaaacttaacacagtgacctcaggcaagcatctctgagttttagattgctcacctgtaaaataggaaaaccaccataaatacgagtgtgcaatgagacaactagcagataggaagtgttgcccaaatattggcaaaagtagaactagatattacttctctaacacagctctgtgactgaaacacagttaaaacaaaagggaaatgatgaactaataaaacaaaaacaaaccagatgatcccaagtgacctccctgcaccaggggagcacagggcccctgtcaaacaggacagcagctggccaaagccttgggaaggcggctgacggaagctaacagagccacagcct

SEQ ID NO: 313292 - DNA, 928 bp, Homo sapiens
ctgaagcctaggggagccagtaaagattaaatgtgcttctcaaaggcagccacttcatgctgctatgtcgaaagggccattattattattatattttaatggtaaaagagaaaaggagagaggttgagcgagcgagagagaagctaggtgtgatgatgacagactagcttttctgagaggaaaaggaaaagggaagggagagaaaaaggagagcctctgagctcaacggaggattgtgcctgagaagaacccacagagtggatgctgtggggcaccacctccttgaggaccaaggcactccagctgccaggaatttggctgctaacctcacacagctgagccttccatgaaaattgctctctgccaaagagaacttcctagtccaaggtcatgtctactctccagagatgtgactggagtgatttgcacccggatgcctagactcgccatctgctcaaagactgctcagaaagccctcccatgcattcccctgctgcataccagcccactctgcctgcagctgctgtctgcaggacttcatatctatgccacactgtgtaaaagctgtgcttcaagaaatcacaaaaacattttcctgcacctactacacagcctgagtgcggcataagttgaccttgcttgctaagaaatggggcaagaaatgcttttttgtgtgtgtcatgtctgtttgtttttcaattaagagaggaaagcattaggcagatggaatgtacatgtgaggatgaggagacagaaaacaagtagccctttccatcaagatagagggttttctggggttgctggctattgaatgtcactcctgatttctctttccaaggcactgtaccaccagcctactgagattgtgtgggagctttcatgggggttgtatttcactgatgaaaataaattttttgcataatgtgaa

SEQ ID NO: 313293 - DNA, 281 bp, Homo sapiens
gagtagcattgctggatgtgcctcttttgttgaggtgattggatctttgggcaaaaaccagtgactgcaaaggatgagagaaacgatcagaaaaactgaaaagctgtaggagaccaaacactagtgtctcccctgcttcaggggacacccactgtcagagtgaacgacaaaggttagatttgaacaagcttgcttgcttgctttctttctttctttctttttctttctttctttctttctttctttctttctttctttctttctttctgtttctctttctt

SEQ ID NO: 313294 - DNA, 2800 bp, Homo sapiens
agtctcgagatttggtgtatcgcttcctgcccccgcctcccctccccgcccccgttctccgtcctctattgaaacacctcgcccagcctagcgcactgagagctctcattttccccccttgctcgggatggtgccacaggaggctgtgcgggccccgctccgcttcgaatggctggtcctatagtacccctcctcaggaatgtctccccagtgcaaggacaaagactgaagagactgctatattgatggactctcaagccaactatgaagttgaaacaaagaaagtgatcacctgaagacacctcctctgctaagaaacacccccaaattgtgcagcttctgccactagaactctcagaacaagagacaatcttttcaagaaacagaaaaactcaataatgacatctagattttcatgagccaagaactttcccttcctcatgtgtattcctctgtttgtacttaaattcatgtgacattcatttttttcctagtatggatatgcttattaatgcacttgtttcaaaatcccaaattgcacaaatgtgttaatattttaagaaacaaaatgaatcctacaaggagaatgatttttagccacacatagggttggatcttgagagtgacctacagaataaaagtacttttaaaataaagtagtcagaggctattcaaagggtaaaataatcatagtaccacattggtccacttgacactaaccaatcgatcatttttttttaatcaagaaagctagattctatcagataaaatcactgcttctaaagagtttaaatctagttagaaaaagttatagaaatgtttgcaaagataagtaacagatagagtcagtagaggataagatcaaaaacaaaaccaagcaaaagatgagttcaggggagtttgccatcaagttggcaaaactgacttacttagggaagaaagttataaaacaggaaaatatgagatgaaccttgagtgatgtggaagatttagataaatggaaaggaaggagaaaatggagttctttaggtggttgtaattggaggaggaaatgaatacacacatcttgttgacttaaacccagacattcagcagctctctatacatatctggaaaagactgcacagtcacctcctgtctctcaccccaggtattacttagaattattatcatatttcccttcctttaaagtaagtaagggtgattggtgacaatatggagaactatgatttttccattaacctaataataattggtatttattgagttctgttaagcattttacatattaactcacttaagcctttcaacagccttgcaaaataggtattattatccccattttacaggcaagaaaactgaggtttaagtaacttgccgaagtgccatatacagggctcacattcagtattgcagttgcaaagctcatgatctatagtgccaagttgcaatattgtagtcaatgtcacaattattacccctttttatattccttgatatttttccatggcaaacaattagctatttcatttaataatcacctaaaacttttcagtcttctgattaaaattacgctggagtgatagaatgtattttcatgatagaaattgggaaaaaaaatggggaatgaagtttatcagcatttcagacttgtttttttttttttttttttgcaagactttgatgagattgttcacttttgtctatgtaaaatcccaaatccttgagaataaaaaagggggaggtttaagtcacttgttgcaatgccctttttaatagaggcaataaatctaaaggccataaatttagagtgacttacagaagatcgaactttggagtgtggcagagtaagggatggaaaccgggccctccagttcactatcagtagcttttgcactggtctgcccttcctaaattaagtatgcacttcaatttgatgagtggaaacagtctatctgggcagtaaccagggagctttgtgcctagtagattgcttctgttctgcacttctttggtttcccacctcaatgtaaaaaatagctagcaatgaagtccagaagttgtcaatggttcatccccagaagaatgcataatgtccaaagttgtatgtgtatgatgtcttcaatggtattaagttatttcaaattcttagttcacctacataaatcatttctaacaagcatcttcttaaccaactttatgcacagtgtatgtttgtaagtgcttctgcacgaatgtttatacatgactgtttccatagtacttatgtttttaaaaatattcagtcatttcctactataatcctcatgtatccatgtaactgactcaaaaatacttcagccacagaaagctaaaactgagcaaatctcattcttcttttccatcccctttgcatgtggctggcatttagtaatgattaataatatggccagctgaataacagaggtttgagacacaattctttctcaaaggagtcagctaagctgggtctacttatggacaaacatctaaatgtgtggaagtatctgatatttgacaatggtaaatttccacttagctagctagcattgtcagacttcaatctcctcatggctctggccgtcctgttttaagcatgataattgttggccacatctcacatagttctcattgagtgagttcataaataaacagggtttttttttttttttaaagagcagccaagcacaaagtgtgactttgttgacattttatgtgactttgtcatatgttcctaacccccaataaaagcaatgttgcatcaactgtgaaaaaaaaatga

SEQ ID NO: 313295 - DNA, 2940 bp, Homo sapiens
ctgaagcctaggggagccagtaaagattaaatgtgcttctcaaaggcagccacttcatgctgctatgtcgaaagggccattattattattatattttaatggtaaaagagaaaaggagagaggttgagcgagcgagagagaagctaggtgtgatgatgacagactagcttttctgagaggaaaaggaaaagggaagggagagaaaaaggagagcctctgagctcaacggaggattgtgcctgagaagaacccacagaggaggctgtgcgggccccgctccgcttcgaatggttgtgttgatgttcctttcagctggtcctatagtacccctcctcaggaatgtctccccagtgcaaggacaaagactgaagagactgctatattgatggactctcaagccaactatgaagttgaaacaaagaaagtgatcacctgaagacacctcctctgctaagaaacacccccaaattgtgcagcttctgccactagaactctcagaacaagagacaatcttttcaagaaacagaaaaactcaataatgacatctagattttcatgagccaagaactttcccttcctcatgtgtattcctctgtttgtacttaaattcatgtgacattcatttttttcctagtatggatatgcttattaatgcacttgtttcaaaatcccaaattgcacaaatgtgttaatattttaagaaacaaaatgaatcctacaaggagaatgatttttagccacacatagggttggatcttgagagtgacctacagaataaaagtacttttaaaataaagtagtcagaggctattcaaagggtaaaataatcatagtaccacattggtccacttgacactaaccaatcgatcatttttttttaatcaagaaagctagattctatcagataaaatcactgcttctaaagagtttaaatctagttagaaaaagttatagaaatgtttgcaaagataagtaacagatagagtcagtagaggataagatcaaaaacaaaaccaagcaaaagatgagttcaggggagtttgccatcaagttggcaaaactgacttacttagggaagaaagttataaaacaggaaaatatgagatgaaccttgagtgatgtggaagatttagataaatggaaaggaaggagaaaatggagttctttaggtggttgtaattggaggaggaaatgaatacacacatcttgttgacttaaacccagacattcagcagctctctatacatatctggaaaagactgcacagtcacctcctgtctctcaccccaggtattacttagaattattatcatatttcccttcctttaaagtaagtaagggtgattggtgacaatatggagaactatgatttttccattaacctaataataattggtatttattgagttctgttaagcattttacatattaactcacttaagcctttcaacagccttgcaaaataggtattattatccccattttacaggcaagaaaactgaggtttaagtaacttgccgaagtgccatatacagggctcacattcagtattgcagttgcaaagctcatgatctatagtgccaagttgcaatattgtagtcaatgtcacaattattacccctttttatattccttgatatttttccatggcaaacaattagctatttcatttaataatcacctaaaacttttcagtcttctgattaaaattacgctggagtgatagaatgtattttcatgatagaaattgggaaaaaaaatggggaatgaagtttatcagcatttcagacttgtttttttttttttttttttgcaagactttgatgagattgttcacttttgtctatgtaaaatcccaaatccttgagaataaaaaagggggaggtttaagtcacttgttgcaatgccctttttaatagaggcaataaatctaaaggccataaatttagagtgacttacagaagatcgaactttggagtgtggcagagtaagggatggaaaccgggccctccagttcactatcagtagcttttgcactggtctgcccttcctaaattaagtatgcacttcaatttgatgagtggaaacagtctatctgggcagtaaccagggagctttgtgcctagtagattgcttctgttctgcacttctttggtttcccacctcaatgtaaaaaatagctagcaatgaagtccagaagttgtcaatggttcatccccagaagaatgcataatgtccaaagttgtatgtgtatgatgtcttcaatggtattaagttatttcaaattcttagttcacctacataaatcatttctaacaagcatcttcttaaccaactttatgcacagtgtatgtttgtaagtgcttctgcacgaatgtttatacatgactgtttccatagtacttatgtttttaaaaatattcagtcatttcctactataatcctcatgtatccatgtaactgactcaaaaatacttcagccacagaaagctaaaactgagcaaatctcattcttcttttccatcccctttgcatgtggctggcatttagtaatgattaataatatggccagctgaataacagaggtttgagacacaattctttctcaaaggagtcagctaagctgggtctacttatggacaaacatctaaatgtgtggaagtatctgatatttgacaatggtaaatttccacttagctagctagcattgtcagacttcaatctcctcatggctctggccgtcctgttttaagcatgataattgttggccacatctcacatagttctcattgagtgagttcataaataaacagggtttttttttttttttaaagagcagccaagcacaaagtgtgactttgttgacattttatgtgactttgtcatatgttcctaacccccaataaaagcaatgttgcatcaactgtgaaaaaaaaatga

SEQ ID NO: 313296 - DNA, 2903 bp, Homo sapiens
gagtagcattgctggatgtgcctcttttgttgaggtgattggatctttgggcaaaaaccagtgactgcaaaggatgagagaaacgatcagaaaaactgaaaagctgtaggagaccaaacactagtgtctcccctgcttcaggggacacccactgtcagagtgaacgacaaagacgcgtgtggatgatttgaagatattagcctaacaagatggaagcaggtttaaaattttacataagaagttacctttttcagttgtgttgatgttcctttcagctggtcctatagtacccctcctcaggaatgtctccccagtgcaaggacaaagactgaagagactgctatattgatggactctcaagccaactatgaagttgaaacaaagaaagtgatcacctgaagacacctcctctgctaagaaacacccccaaattgtgcagcttctgccactagaactctcagaacaagagacaatcttttcaagaaacagaaaaactcaataatgacatctagattttcatgagccaagaactttcccttcctcatgtgtattcctctgtttgtacttaaattcatgtgacattcatttttttcctagtatggatatgcttattaatgcacttgtttcaaaatcccaaattgcacaaatgtgttaatattttaagaaacaaaatgaatcctacaaggagaatgatttttagccacacatagggttggatcttgagagtgacctacagaataaaagtacttttaaaataaagtagtcagaggctattcaaagggtaaaataatcatagtaccacattggtccacttgacactaaccaatcgatcatttttttttaatcaagaaagctagattctatcagataaaatcactgcttctaaagagtttaaatctagttagaaaaagttatagaaatgtttgcaaagataagtaacagatagagtcagtagaggataagatcaaaaacaaaaccaagcaaaagatgagttcaggggagtttgccatcaagttggcaaaactgacttacttagggaagaaagttataaaacaggaaaatatgagatgaaccttgagtgatgtggaagatttagataaatggaaaggaaggagaaaatggagttctttaggtggttgtaattggaggaggaaatgaatacacacatcttgttgacttaaacccagacattcagcagctctctatacatatctggaaaagactgcacagtcacctcctgtctctcaccccaggtattacttagaattattatcatatttcccttcctttaaagtaagtaagggtgattggtgacaatatggagaactatgatttttccattaacctaataataattggtatttattgagttctgttaagcattttacatattaactcacttaagcctttcaacagccttgcaaaataggtattattatccccattttacaggcaagaaaactgaggtttaagtaacttgccgaagtgccatatacagggctcacattcagtattgcagttgcaaagctcatgatctatagtgccaagttgcaatattgtagtcaatgtcacaattattacccctttttatattccttgatatttttccatggcaaacaattagctatttcatttaataatcacctaaaacttttcagtcttctgattaaaattacgctggagtgatagaatgtattttcatgatagaaattgggaaaaaaaatggggaatgaagtttatcagcatttcagacttgtttttttttttttttttttgcaagactttgatgagattgttcacttttgtctatgtaaaatcccaaatccttgagaataaaaaagggggaggtttaagtcacttgttgcaatgccctttttaatagaggcaataaatctaaaggccataaatttagagtgacttacagaagatcgaactttggagtgtggcagagtaagggatggaaaccgggccctccagttcactatcagtagcttttgcactggtctgcccttcctaaattaagtatgcacttcaatttgatgagtggaaacagtctatctgggcagtaaccagggagctttgtgcctagtagattgcttctgttctgcacttctttggtttcccacctcaatgtaaaaaatagctagcaatgaagtccagaagttgtcaatggttcatccccagaagaatgcataatgtccaaagttgtatgtgtatgatgtcttcaatggtattaagttatttcaaattcttagttcacctacataaatcatttctaacaagcatcttcttaaccaactttatgcacagtgtatgtttgtaagtgcttctgcacgaatgtttatacatgactgtttccatagtacttatgtttttaaaaatattcagtcatttcctactataatcctcatgtatccatgtaactgactcaaaaatacttcagccacagaaagctaaaactgagcaaatctcattcttcttttccatcccctttgcatgtggctggcatttagtaatgattaataatatggccagctgaataacagaggtttgagacacaattctttctcaaaggagtcagctaagctgggtctacttatggacaaacatctaaatgtgtggaagtatctgatatttgacaatggtaaatttccacttagctagctagcattgtcagacttcaatctcctcatggctctggccgtcctgttttaagcatgataattgttggccacatctcacatagttctcattgagtgagttcataaataaacagggtttttttttttttttaaagagcagccaagcacaaagtgtgactttgttgacattttatgtgactttgtcatatgttcctaacccccaataaaagcaatgttgcatcaactgtgaaaaaaaaatga

SEQ ID NO: 313297 - DNA, 2886 bp, Homo sapiens
ctgaagcctaggggagccagtaaagattaaatgtgcttctcaaaggcagccacttcatgctgctatgtcgaaagggccattattattattatattttaatggtaaaagagaaaaggagagaggttgagcgagcgagagagaagctaggtgtgatgatgacagactagcttttctgagaggaaaaggaaaagggaagggagagaaaaaggagagcctctgagctcaacggaggattgtgcctgagaagaacccacagagctggtcctatagtacccctcctcaggaatgtctccccagtgcaaggacaaagactgaagagactgctatattgatggactctcaagccaactatgaagttgaaacaaagaaagtgatcacctgaagacacctcctctgctaagaaacacccccaaattgtgcagcttctgccactagaactctcagaacaagagacaatcttttcaagaaacagaaaaactcaataatgacatctagattttcatgagccaagaactttcccttcctcatgtgtattcctctgtttgtacttaaattcatgtgacattcatttttttcctagtatggatatgcttattaatgcacttgtttcaaaatcccaaattgcacaaatgtgttaatattttaagaaacaaaatgaatcctacaaggagaatgatttttagccacacatagggttggatcttgagagtgacctacagaataaaagtacttttaaaataaagtagtcagaggctattcaaagggtaaaataatcatagtaccacattggtccacttgacactaaccaatcgatcatttttttttaatcaagaaagctagattctatcagataaaatcactgcttctaaagagtttaaatctagttagaaaaagttatagaaatgtttgcaaagataagtaacagatagagtcagtagaggataagatcaaaaacaaaaccaagcaaaagatgagttcaggggagtttgccatcaagttggcaaaactgacttacttagggaagaaagttataaaacaggaaaatatgagatgaaccttgagtgatgtggaagatttagataaatggaaaggaaggagaaaatggagttctttaggtggttgtaattggaggaggaaatgaatacacacatcttgttgacttaaacccagacattcagcagctctctatacatatctggaaaagactgcacagtcacctcctgtctctcaccccaggtattacttagaattattatcatatttcccttcctttaaagtaagtaagggtgattggtgacaatatggagaactatgatttttccattaacctaataataattggtatttattgagttctgttaagcattttacatattaactcacttaagcctttcaacagccttgcaaaataggtattattatccccattttacaggcaagaaaactgaggtttaagtaacttgccgaagtgccatatacagggctcacattcagtattgcagttgcaaagctcatgatctatagtgccaagttgcaatattgtagtcaatgtcacaattattacccctttttatattccttgatatttttccatggcaaacaattagctatttcatttaataatcacctaaaacttttcagtcttctgattaaaattacgctggagtgatagaatgtattttcatgatagaaattgggaaaaaaaatggggaatgaagtttatcagcatttcagacttgtttttttttttttttttttgcaagactttgatgagattgttcacttttgtctatgtaaaatcccaaatccttgagaataaaaaagggggaggtttaagtcacttgttgcaatgccctttttaatagaggcaataaatctaaaggccataaatttagagtgacttacagaagatcgaactttggagtgtggcagagtaagggatggaaaccgggccctccagttcactatcagtagcttttgcactggtctgcccttcctaaattaagtatgcacttcaatttgatgagtggaaacagtctatctgggcagtaaccagggagctttgtgcctagtagattgcttctgttctgcacttctttggtttcccacctcaatgtaaaaaatagctagcaatgaagtccagaagttgtcaatggttcatccccagaagaatgcataatgtccaaagttgtatgtgtatgatgtcttcaatggtattaagttatttcaaattcttagttcacctacataaatcatttctaacaagcatcttcttaaccaactttatgcacagtgtatgtttgtaagtgcttctgcacgaatgtttatacatgactgtttccatagtacttatgtttttaaaaatattcagtcatttcctactataatcctcatgtatccatgtaactgactcaaaaatacttcagccacagaaagctaaaactgagcaaatctcattcttcttttccatcccctttgcatgtggctggcatttagtaatgattaataatatggccagctgaataacagaggtttgagacacaattctttctcaaaggagtcagctaagctgggtctacttatggacaaacatctaaatgtgtggaagtatctgatatttgacaatggtaaatttccacttagctagctagcattgtcagacttcaatctcctcatggctctggccgtcctgttttaagcatgataattgttggccacatctcacatagttctcattgagtgagttcataaataaacagggtttttttttttttttaaagagcagccaagcacaaagtgtgactttgttgacattttatgtgactttgtcatatgttcctaacccccaataaaagcaatgttgcatcaactgtgaaaaaaaaatga

SEQ ID NO: 313298 - DNA, 1122 bp, Homo sapiens
ctgaagcctaggggagccagtaaagattaaatgtgcttctcaaaggcagccacttcatgctgctatgtcgaaagggccattattattattatattttaatggtaaaagagaaaaggagagaggttgagcgagcgagagagaagctaggtgtgatgatgacagactagcttttctgagaggaaaaggaaaagggaagggagagaaaaaggagagcctctgagctcaacggaggattgtgcctgagaagaacccacagagtggatgctgtggggcaccacctccttgaggaccaaggcactccagctgccaggaatttggctgctaacctcacacagctgagccttccatgaaaattgctctctgccaaagagaacttcctagtccaaggtcatgtctactctccagagatgtgactggagtgatttgcacccggatgcctagactcgccatctgctcaaagactgctcagaaagccctcccatgcattcccctgctgcataccagcccactctgcctgcagctgctgtctgcaggacttcatatctatgccacactgtgtaaaagctgtgcttcaagaaatcacaaaaacattttcctgcacctactacacagcctgagtgcggcataagttgaccttgcttgctaagaaatggggcaagaaatgcttttttgtgtgtgtcatgtctgtttgtttttcaattaagagaggaaagcattaggcagatggaatgtacatgtgaggatgaggagacagaaaacaagtagccctttccatcaagatagagggttttctggggttgctggctattgaatgtcactcctgatttctctttccaaggcactgtaccaccagcctactgagattgtgtgggagctttcatgggggttgtatttcactgatgaaaataaattttttgcataatgtgaaaaaaaaaaaagaggcctcttggcctaccggggcttgcggcgtcccttagggggtaataataaccccccatgcccttgcctggcgtcggtgggggcggatcgtcctcaggcggattcggttcccaatcagggtcccccggaacactggacaaagctccaggccgacctaaagccggttggctttcaacgcgccct

SEQ ID NO: 313299 - DNA, 404 bp, Homo sapiens
ccaactgcccttttttctctcgtcaaagcataagctacagagttacagtctcgagatttggtgtatcgcttcctgcccccgcctcccctccccgcccccgttctccgtcctctattgaaacacctcgcccagcctagcgcactgagagctctcattttccccccttgctcgggatggtgccacaggaggctgtgcgggccccgctccgcttcgaatgggtgagttcagaacgctattcgtctttacacttctatagcctccgaatcctacttcttggtcttctcctttgaaaacccgatttctatgatttttgcatgcggcatacttgccctgggggaaagagatgcctcctattttctcttcagtcatttgtgctagtcgtaaattaaagctttgaaaagaca

SEQ ID NO: 313300 - DNA, 2821 bp, Homo sapiens
agtctcgagatttggtgtatcgcttcctgcccccgcctcccctccccgcccccgttctccgtcctctattgaaacacctcgcccagcctagcgcactgagagctctcattttccccccttgctcgggatggtgccacaggaggctgtgcgggccccgctccgcttcgaatggttgtgttgatgttcctttcagctggtcctatagtacccctcctcaggaatgtctccccagtgcaaggacaaagactgaagagactgctatattgatggactctcaagccaactatgaagttgaaacaaagaaagtgatcacctgaagacacctcctctgctaagaaacacccccaaattgtgcagcttctgccactagaactctcagaacaagagacaatcttttcaagaaacagaaaaactcaataatgacatctagattttcatgagccaagaactttcccttcctcatgtgtattcctctgtttgtacttaaattcatgtgacattcatttttttcctagtatggatatgcttattaatgcacttgtttcaaaatcccaaattgcacaaatgtgttaatattttaagaaacaaaatgaatcctacaaggagaatgatttttagccacacatagggttggatcttgagagtgacctacagaataaaagtacttttaaaataaagtagtcagaggctattcaaagggtaaaataatcatagtaccacattggtccacttgacactaaccaatcgatcatttttttttaatcaagaaagctagattctatcagataaaatcactgcttctaaagagtttaaatctagttagaaaaagttatagaaatgtttgcaaagataagtaacagatagagtcagtagaggataagatcaaaaacaaaaccaagcaaaagatgagttcaggggagtttgccatcaagttggcaaaactgacttacttagggaagaaagttataaaacaggaaaatatgagatgaaccttgagtgatgtggaagatttagataaatggaaaggaaggagaaaatggagttctttaggtggttgtaattggaggaggaaatgaatacacacatcttgttgacttaaacccagacattcagcagctctctatacatatctggaaaagactgcacagtcacctcctgtctctcaccccaggtattacttagaattattatcatatttcccttcctttaaagtaagtaagggtgattggtgacaatatggagaactatgatttttccattaacctaataataattggtatttattgagttctgttaagcattttacatattaactcacttaagcctttcaacagccttgcaaaataggtattattatccccattttacaggcaagaaaactgaggtttaagtaacttgccgaagtgccatatacagggctcacattcagtattgcagttgcaaagctcatgatctatagtgccaagttgcaatattgtagtcaatgtcacaattattacccctttttatattccttgatatttttccatggcaaacaattagctatttcatttaataatcacctaaaacttttcagtcttctgattaaaattacgctggagtgatagaatgtattttcatgatagaaattgggaaaaaaaatggggaatgaagtttatcagcatttcagacttgtttttttttttttttttttgcaagactttgatgagattgttcacttttgtctatgtaaaatcccaaatccttgagaataaaaaagggggaggtttaagtcacttgttgcaatgccctttttaatagaggcaataaatctaaaggccataaatttagagtgacttacagaagatcgaactttggagtgtggcagagtaagggatggaaaccgggccctccagttcactatcagtagcttttgcactggtctgcccttcctaaattaagtatgcacttcaatttgatgagtggaaacagtctatctgggcagtaaccagggagctttgtgcctagtagattgcttctgttctgcacttctttggtttcccacctcaatgtaaaaaatagctagcaatgaagtccagaagttgtcaatggttcatccccagaagaatgcataatgtccaaagttgtatgtgtatgatgtcttcaatggtattaagttatttcaaattcttagttcacctacataaatcatttctaacaagcatcttcttaaccaactttatgcacagtgtatgtttgtaagtgcttctgcacgaatgtttatacatgactgtttccatagtacttatgtttttaaaaatattcagtcatttcctactataatcctcatgtatccatgtaactgactcaaaaatacttcagccacagaaagctaaaactgagcaaatctcattcttcttttccatcccctttgcatgtggctggcatttagtaatgattaataatatggccagctgaataacagaggtttgagacacaattctttctcaaaggagtcagctaagctgggtctacttatggacaaacatctaaatgtgtggaagtatctgatatttgacaatggtaaatttccacttagctagctagcattgtcagacttcaatctcctcatggctctggccgtcctgttttaagcatgataattgttggccacatctcacatagttctcattgagtgagttcataaataaacagggtttttttttttttttaaagagcagccaagcacaaagtgtgactttgttgacattttatgtgactttgtcatatgttcctaacccccaataaaagcaatgttgcatcaactgtgaaaaaaaaatga

SEQ ID NO: 313301 - DNA, 2055 bp, Homo sapiens
agggggccgcggggagggaggcgggaagagcgcggcacttccgctggccgctggctcgctggccgctcctggaggcggcggcgggagcgcagggggcgcgcggcccggggactcgcattccccggttccccctccaccccacgcggcctggaccatggacgccagatggtgggcagtggtggtgctggctgcgttcccctccctaggggcaggtggggagactcccgaagcccctccggagtcatggacccagctatggttcttccgatttgtggtgaatgctgctggctatgccagctttatggtacctggctacctcctggtgcagtacttcaggcggaagaactacctggagaccggtaggggcctctgctttcccctggtgaaagcttgtgtgtttggcaatgagcccaaggcctctgatgaggttcccctggcgccccgaacagaggcggcagagaccaccccgatgtggcaggccctgaagctgctcttctgtgccacagggctccaggtgtcttatctgacttggggtgtgctgcaggaaagagtgatgacccgcagctatggggccacagccacatcaccgggtgagcgctttacggactcgcagttcctggtgctaatgaaccgagtgctggcactgattgtggctggcctctcctgtgttctctgcaagcagccccggcatggggcacccatgtaccggtactcctttgccagcctgtccaatgtgcttagcagctggtgccaatacgaagctcttaagttcgtcagcttccccacccaggtgctggccaaggcctctaaggtgatccctgtcatgctgatgggaaagcttgtgtctcggcgcagctacgaacactgggagtacctgacagccaccctcatctccattggggtcagcatgtttctgctatccagcggaccagagccccgcagctccccagccaccacactctcaggcctcatcttactggcaggttatattgcttttgacagcttcacctcaaactggcaggatgccctgtttgcctataagatgtcatcggtgcagatgatgtttggggtcaatttcttctcctgcctcttcacagtgggctcactgctagaacagggggccctactggagggaacccgcttcatggggcgacacagtgagtttgctgcccatgccctgctactctccatctgctccgcatgtggccagctcttcatcttttacaccattgggcagtttggggctgccgtcttcaccatcatcatgaccctccgccaggcctttgccatccttctttcctgccttctctatggccacactgtcactgtggtgggagggctgggggtggctgtggtctttgctgccctcctgctcagagtctacgcgcggggccgtctaaagcaacggggaaagaaggctgtgcctgttgagtctcctgtgcagaaggtttgagggtggaaagggcctgaggggtgaagtgaaataggaccctcccaccatccccttctgctgtaacctctgagggagctggctgaaagggcaaaatgcaggtgttttctcagtatcacagaccagctctgcagcaggggattggggagcccaggaggcagccttcccttttgccttaagtcacccatcttccagtaagcagtttattctgagccccgggggtagacagtcctcagtgaggggttttggggagtttggggtcaagagagcataggtaggttccacagttactcttcccacaagttcccttaagtcttgccctagctgtgctctgccaccttccagactcactcccctctgcaaatacctgcatttcttaccctggtgagaaaagcacaagcggtgtaggctccaatgctgctttcccaggagggtgaagatggtgctgtgctgaggaaaggggatgcagagccctgcccagcaccaccacctcctatgctcctggatccctaggctctgttccatgagcctgttgcaggttttggtactttagaaatgtaactttttgctcttataattttattttattaaattaaattactgca

SEQ ID NO: 313302 - DNA, 1978 bp, Homo sapiens
agcggagtggctgaaagggcaaaatgcaggtgttttctcagtatcacagaccagctctgcagcaggggattggggagcccaggaggcagccttccgttttgccttaagtcacccatcttccagtaagcagtttattctgagccccgggggtagacagtccggagtcatggacccagctatggttcttccgatttgtggtgaatgctgctggctatgccagctttatggtacctggctacctcctggtgcagtacttcaggcggaagaactacctggagaccggtaggggcctctgctttcccctggtgaaagcttgtgtgtttggcaatgagcccaaggcctctgatgaggttcccctggcgccccgaacagaggcggcagagaccaccccgatgtggcaggccctgaagctgctcttctgtgccacagggctccaggtgtcttatctgacttggggtgtgctgcaggaaagagtgatgacccgcagctatggggccacagccacatcaccgggtgagcgctttacggactcgcagttcctggtgctaatgaaccgagtgctggcactgattgtggctggcctctcctgtgttctctgcaagcagccccggcatggggcacccatgtaccggtactcctttgccagcctgtccaatgtgcttagcagctggtgccaatacgaagctcttaagttcgtcagcttccccacccaggtgctggccaaggcctctaaggtgatccctgtcatgctgatgggaaagcttgtgtctcggcgcagctacgaacactgggagtacctgacagccaccctcatctccattggggtcagcatgtttctgctatccagcggaccagagccccgcagctccccagccaccacactctcaggcctcatcttactggcaggttatattgcttttgacagcttcacctcaaactggcaggatgccctgtttgcctataagatgtcatcggtgcagatgatgtttggggtcaatttcttctcctgcctcttcacagtgggctcactgctagaacagggggccctactggagggaacccgcttcatggggcgacacagtgagtttgctgcccatgccctgctactctccatctgctccgcatgtggccagctcttcatcttttacaccattgggcagtttggggctgccgtcttcaccatcatcatgaccctccgccaggcctttgccatccttctttcctgccttctctatggccacactgtcactgtggtgggagggctgggggtggctgtggtctttgctgccctcctgctcagagtctacgcgcggggccgtctaaagcaacggggaaagaaggctgtgcctgttgagtctcctgtgcagaaggtttgagggtggaaagggcctgaggggtgaagtgaaataggaccctcccaccatccccttctgctgtaacctctgagggagctggctgaaagggcaaaatgcaggtgttttctcagtatcacagaccagctctgcagcaggggattggggagcccaggaggcagccttcccttttgccttaagtcacccatcttccagtaagcagtttattctgagccccgggggtagacagtcctcagtgaggggttttggggagtttggggtcaagagagcataggtaggttccacagttactcttcccacaagttcccttaagtcttgccctagctgtgctctgccaccttccagactcactcccctctgcaaatacctgcatttcttaccctggtgagaaaagcacaagcggtgtaggctccaatgctgctttcccaggagggtgaagatggtgctgtgctgaggaaaggggatgcagagccctgcccagcaccaccacctcctatgctcctggatccctaggctctgttccatgagcctgttgcaggttttggtactttagaaatgtaactttttgctcttataattttattttattaaattaaattactgca

SEQ ID NO: 313303 - DNA, 1861 bp, Homo sapiens
agggggccgcggggagggaggcgggaagagcgcggcacttccgctggccgctggctcgctggccgctcctggaggcggcggcgggagcgcagggggcgcgcggcccggggactcgcattccccggttccccctccaccccacgcggcctggaccatggacgccaggtaggggcctctgctttcccctggtgaaagcttgtgtgtttggcaatgagcccaaggcctctgatgaggttcccctggcgccccgaacagaggcggcagagaccaccccgatgtggcaggccctgaagctgctcttctgtgccacagggctccaggtgtcttatctgacttggggtgtgctgcaggaaagagtgatgacccgcagctatggggccacagccacatcaccgggtgagcgctttacggactcgcagttcctggtgctaatgaaccgagtgctggcactgattgtggctggcctctcctgtgttctctgcaagcagccccggcatggggcacccatgtaccggtactcctttgccagcctgtccaatgtgcttagcagctggtgccaatacgaagctcttaagttcgtcagcttccccacccaggtgctggccaaggcctctaaggtgatccctgtcatgctgatgggaaagcttgtgtctcggcgcagctacgaacactgggagtacctgacagccaccctcatctccattggggtcagcatgtttctgctatccagcggaccagagccccgcagctccccagccaccacactctcaggcctcatcttactggcaggttatattgcttttgacagcttcacctcaaactggcaggatgccctgtttgcctataagatgtcatcggtgcagatgatgtttggggtcaatttcttctcctgcctcttcacagtgggctcactgctagaacagggggccctactggagggaacccgcttcatggggcgacacagtgagtttgctgcccatgccctgctactctccatctgctccgcatgtggccagctcttcatcttttacaccattgggcagtttggggctgccgtcttcaccatcatcatgaccctccgccaggcctttgccatccttctttcctgccttctctatggccacactgtcactgtggtgggagggctgggggtggctgtggtctttgctgccctcctgctcagagtctacgcgcggggccgtctaaagcaacggggaaagaaggctgtgcctgttgagtctcctgtgcagaaggtttgagggtggaaagggcctgaggggtgaagtgaaataggaccctcccaccatccccttctgctgtaacctctgagggagctggctgaaagggcaaaatgcaggtgttttctcagtatcacagaccagctctgcagcaggggattggggagcccaggaggcagccttcccttttgccttaagtcacccatcttccagtaagcagtttattctgagccccgggggtagacagtcctcagtgaggggttttggggagtttggggtcaagagagcataggtaggttccacagttactcttcccacaagttcccttaagtcttgccctagctgtgctctgccaccttccagactcactcccctctgcaaatacctgcatttcttaccctggtgagaaaagcacaagcggtgtaggctccaatgctgctttcccaggagggtgaagatggtgctgtgctgaggaaaggggatgcagagccctgcccagcaccaccacctcctatgctcctggatccctaggctctgttccatgagcctgttgcaggttttggtactttagaaatgtaactttttgctcttataattttattttattaaattaaattactgca

SEQ ID NO: 313304 - DNA, 1668 bp, Homo sapiens
agggggccgcggggagggaggcgggaagagcgcggcacttccgctggccgctggctcgctggccgctcctggaggcggcggcgggagcgcagggggcgcgcggcccggggactcgcattccccggttccccctccaccccacgcggcctggaccatggacgccagatggtgggcagtggtggtgctggctgcgttcccctccctaggggcaggtggggagactcccgaagcccctccggagtcatggacccagctatggttcttccgatttgtggtgaatgctgctggctatgccagctttatggtacctggctacctcctggtgcagtacttcaggcggaagaactacctggagaccggtaggggcctctgctttcccctggtgaaagcttgtgtgtttggcaatgagcccaaggcctctgatgaggttcccctggcgccccgaacagaggcggcagagaccaccccgatgtggcaggccctgaagctgctcttctgtgccacagggctccaggtgtcttatctgacttggggtgtgctgcaggaaagagtgatgacccgcagctatggggccacagccacatcaccgggtgagcgctttacggactcgcagttcctggtgctaatgaaccgagtgctggcactgattgtggctggcctctcctgtgttctctgcaagcagccccggcatggggcacccatgtaccggtactcctttgccagcctgtccaatgtgcttagcagctggtgccaatacgaagctcttaagttcgtcagcttccccacccaggtgctggccaaggcctctaaggtgatccctgtcatgctgatgggaaagcttgtgtctcggcgcagctacgaacactgggagtacctgacagccaccctcatctccattggggtcagcatgtttctgctatccagcggaccagagccccgcagctccccagccaccacactctcaggcctcatcttactggcaggttatattgcttttgacagcttcacctcaaactggcaggatgccctgtttgcctataagatgtcatcggtgcagatgatgtttggggtcaatttcttctcctgcctcttcacagtgggctcactgctagaacagggggccctactggagggaacccgcttcatggggcgacacagtgagtttgctgcccatgccctgctactctccatctgctccgcatgtggccagctcttcatcttttacaccattgggcagtttggggctgccgtcttcaccatcatcatgaccctccgccaggcctttgccatccttctttcctgccttctctatggccacactgtcactgtggtgggagggctgggggtggctgtggtctttgctgccctcctgctcagagtctacgcgcggggccgtctaaagcaacggggaaagaaggctgtgcctgttgagtctcctgtgcagaaggtttgagggtggaaagggcctgaggggtgaagtgaaataggaccctcccaccatccccttctgctgtaacctctgagggagctggctgaaagggcaaaatgcaggtgttttctcagtatcacagaccagcttctgttccatgagcctgttgcaggttttggtactttagaaatgtaactttttgctcttataattttattttattaaattaaattactgca

SEQ ID NO: 313305 - DNA, 1073 bp, Homo sapiens
agggggccgcggggagggaggcgggaagagcgcggcacttccgctggccgctggctcgctggccgctcctggaggcggcggcgggagcgcagggggcgcgcggcccggggactcgcattccccggttccccctccaccccacgcggcctggaccatggacgccagatggtgggcagtggtggtgctggctgcgttcccctccctaggggcaggtggggagactcccgaagcccctccggagtcatggacccagctatggttcttccgatttgtggtgaatgctgctggctatgccagctttatggtacctggctacctcctggtgcagtacttcaggcggaagaactacctggagaccggtaggggcctctgctttcccctggtgaaagcttgtgtgtttggcaatgagcccaaggcctctgatgaggttcccctggcgccccgaacagaggcggcagagaccaccccgatgtggcaggccctgaagctgctcttctgtgccacagggctccaggtgtcttatctgacttggggtgtgctgcaggaaagagtgatgacccgcagctatggggccacagccacatcaccgggtgagcgctttacggactcgcagttcctggtgctaatgaaccgagtgctggcactgattgtggctggcctctcctgtgttctctgcaagcagccccggcatggggcacccatgtaccggtactcctttgccagcctgtccaatgtgcttagcagctggtgccaatacgaagctcttaagttcgtcagcttccccacccaggtgctggccaaggcctctaaggtgatccctgtcatgctgatgggaaagcttgtgtctcggcgcagctacgaacactgggagtacctgacagccaccctcatctccattggggtcagcatgtttctgctatccagcggaccagagccccgcagctccccagccaccacactctcaggcctcatcttactggcaggttatattgcttttgacagcttcacctcaaactggcaggatgccctgtttgcctataagatgtcaaaagcatgtggaaatgacccaaaca

SEQ ID NO: 313306 - DNA, 2537 bp, Homo sapiens
agggggccgcggggagggaggcgggaagagcgcggcacttccgctggccgctggctcgctggccgctcctggaggcggcggcgggagcgcagggggcgcgcggcccggggactcgcattccccggttccccctccaccccacgcggcctggaccatggacgccagatggtgggcagtggtggtgctggctgcgttcccctccctaggggcaggtggggagactcccgaagcccctccggagtcatggacccagctatggttcttccgatttgtggtgaatgctgctggctatgccagctttatggtacctggctacctcctggtgcagtacttcaggcggaagaactacctggagaccggtaggggcctctgctttcccctggtgaaagcttgtgtgtttggcaatgagcccaaggcctctgatgaggttcccctggcgccccgaacagaggcggcagagaccaccccgatgtggcaggccctgaagctgctcttctgtgccacagggctccaggtgtcttatctgacttggggtgtgctgcaggaaagagtgatgacccgcagctatggggccacagccacatcaccgggtgagcgctttacggactcgcagttcctggtgctaatgaaccgagtgctggcactgattgtggctggcctctcctgtgttctctgcaagcagccccggcatggggcacccatgtaccggtactcctttgccagcctgtccaatgtgcttagcagctggtgccaatacgaagctcttaagttcgtcagcttccccacccaggtgctggccaaggcctctaaggtgatccctgtcatgctgatgggaaagcttgtgtctcggcgcagctacgaacactgggagtacctgacagccaccctcatctccattggggtcagcatgtttctgctatccagcggaccagagccccgcagctccccagccaccacactctcaggcctcatcttactggcaggttatattgcttttgacagcttcacctcaaactggcaggatgccctgtttgcctataagatgtcatcggtgcagatgatgtttggggtcaatttcttctcctgcctcttcacagtgggctcactgctagaacagggggccctactggagggaacccgcttcatggggcgacacagtgagtttgctgcccatgccctgctactctccatctgctccgcatgtggccagctcttcatcttttacaccattgggcagtttggggctgccgtcttcaccatcatcatgaccctccgccaggcctttgccatccttctttcctgccttctctatggccacactgtcactgtggtgggagggctgggggtggctgtggtctttgctgccctcctgctcagagtctacgcgcggggccgtctaaagcaacggggaaagaaggctgtgcctgttgagtctcctgtgcagaaggtttgagggtggaaagggcctgaggggtgaagtgaaataggaccctcccaccatccccttctgctgtaacctctgagggagctggctgaaagggcaaaatgcaggtgttttctcagtatcacagaccagctctgcagcaggggattggggagcccaggaggcagccttcccttttgccttaagtcacccatcttccagtaagcagtttattctgagccccgggggtagacagtcctcagtgaggggttttggggagtttggggtcaagagagcataggtaggttccacagttactcttcccacaagttcccttaagtcttgccctagctgtgctctgccaccttccagactcactcccctctgcaaatacctgcatttcttaccctggtgagaaaagcacaagcggtgtaggctccaatgctgctttcccaggagggtgaagatggtgctgtgctgaggaaaggggatgcagagccctgcccagcaccaccacctcctatgctcctggatccctaggctctgttccatgagcctgttgcaggttttggtactttagaaatgtaactttttgctcttataattttattttattaaattaaattactgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggggggcttaaaacttccccgccggggggggacgtaatatgatgcgtcgaccctgaagttttttttgaaaaggaggggcccccaaagaaaggaggtgattattttcaacacggaaccagacgcgccctttttatatataaccaattagtgcttggcgaggtggaaaaccacacatctggtgtagcgtggaagtacttattggagaagggaacccaataatgtgggtgggggagccaacattggtgcgacaacctcacataagggtattatactaccctgaggtgaattaattaacatatggcgatgttattgtgttcacccgcagttttatctcgcctgcagaaaatattcgtcactacgagttttttcgagaatattagccg

SEQ ID NO: 313307 - DNA, 1900 bp, Homo sapiens
agggggccgcggggagggaggcgggaagagcgcggcacttccgctggccgctggctcgctggccgctcctggaggcggcggcgggagcgcagggggcgcgcggcccggggactcgcattccccggttccccctccaccccacgcggcctggaccatggacgccagatggtgggcagtggtggtgctggctgcgttcccctccctaggggcaggtggggagactcccgaagcccctccggagtcatggacccagctatggttcttccgatttgtggtgaatgctgctggctatgccagctttatggtacctggctacctcctggtgcagtacttcaggcggaagaactacctggagaccggtgtcttatctgacttggggtgtgctgcaggaaagagtgatgacccgcagctatggggccacagccacatcaccgggtgagcgctttacggactcgcagttcctggtgctaatgaaccgagtgctggcactgattgtggctggcctctcctgtgttctctgcaagcagccccggcatggggcacccatgtaccggtactcctttgccagcctgtccaatgtgcttagcagctggtgccaatacgaagctcttaagttcgtcagcttccccacccaggtgctggccaaggcctctaaggtgatccctgtcatgctgatgggaaagcttgtgtctcggcgcagctacgaacactgggagtacctgacagccaccctcatctccattggggtcagcatgtttctgctatccagcggaccagagccccgcagctccccagccaccacactctcaggcctcatcttactggcaggttatattgcttttgacagcttcacctcaaactggcaggatgccctgtttgcctataagatgtcatcggtgcagatgatgtttggggtcaatttcttctcctgcctcttcacagtgggctcactgctagaacagggggccctactggagggaacccgcttcatggggcgacacagtgagtttgctgcccatgccctgctactctccatctgctccgcatgtggccagctcttcatcttttacaccattgggcagtttggggctgccgtcttcaccatcatcatgaccctccgccaggcctttgccatccttctttcctgccttctctatggccacactgtcactgtggtgggagggctgggggtggctgtggtctttgctgccctcctgctcagagtctacgcgcggggccgtctaaagcaacggggaaagaaggctgtgcctgttgagtctcctgtgcagaaggtttgagggtggaaagggcctgaggggtgaagtgaaataggaccctcccaccatccccttctgctgtaacctctgagggagctggctgaaagggcaaaatgcaggtgttttctcagtatcacagaccagctctgcagcaggggattggggagcccaggaggcagccttcccttttgccttaagtcacccatcttccagtaagcagtttattctgagccccgggggtagacagtcctcagtgaggggttttggggagtttggggtcaagagagcataggtaggttccacagttactcttcccacaagttcccttaagtcttgccctagctgtgctctgccaccttccagactcactcccctctgcaaatacctgcatttcttaccctggtgagaaaagcacaagcggtgtaggctccaatgctgctttcccaggagggtgaagatggtgctgtgctgaggaaaggggatgcagagccctgcccagcaccaccacctcctatgctcctggatccctaggctctgttccatgagcctgttgcaggttttggtactttagaaatgtaactttttgctcttataattttattttattaaattaaattactgca

SEQ ID NO: 313308 - DNA, 1505 bp, Homo sapiens
agggggccgcggggagggaggcgggaagagcgcggcacttccgctggccgctggctcgctggccgctcctggaggcggcggcgggagcgcagggggcgcgcggcccggggactcgcattccccggttccccctccaccccacgcggcctggaccatggacgccagatggtgggcagtggtggtgctggctgcgttcccctccctaggggcaggtggggagactcccgaagcccctccggagtcatggacccagctatggttcttccgatttgtggtgaatgctgctggctatgccagctttatggtacctggctacctcctggtgcagtacttcaggcggaagaactacctggagaccggtaggggcctctgctttcccctggtgaaagcttgtgtgtttggcaatgagcccaaggcctctgatgaggttcccctggcgccccgaacagaggcggcagagaccaccccgatgtggcaggccctgaagctgctcttctgtgccacagggctccaggtgtcttatctgacttggggtgtgctgcaggaaagagtgatgacccgcagctatggggccacagccacatcaccgggtgagcgctttacggactcgcagttcctggtgctaatgaaccgagtgctggcactgattgtggctggcctctcctgtgttctctgcaagcagccccggcatggggcacccatgtaccggtactcctttgccagcctgtccaatgtgcttagcagctggtgccaatacgaagctcttaagttcgtcagcttccccacccaggtgctggccaaggcctctaaggtgatccctgtcatgctgatgggaaagcttgtgtctcggcgcagctacgaacactgggagtacctgacagccaccctcatctccattggggtcagcatgtttctgctatccagcggaccagagccccgcagctccccagccaccacactctcaggcctcatcttactggcaggttatattgcttttgacagcttcacctcaaactggcaggatgccctgtttgcctataagatgtcatcggtgcagatgatgtttggggtcaatttcttctcctgcctcttcacagtgggctcactgctagaacagggggccctactggagggaacccgcttcatggggcgacacagtgagtttgctgcccatgccctgctactctccatctgctccgcatgtggccagctcttcatcttttacaccattgggcagtttggggctgccgtcttcaccatcatcatgaccctccgccaggcctttgccatccttctttcctgccttctctatggccacactgtcactgtggtgggagggctgggggtggctgtggtctttgctgccctcctgctcagagtctacgcgcggggccgtctaaagcaacggggaaagaaggctgtgcctgttgagtctcctgtgcagaagggtgactagatgaggttgtgtatcggggatcctcttgattcttcctcaaaatctaggc

SEQ ID NO: 313309 - DNA, 1326 bp, Homo sapiens
  misc_feature (1261)..(1261): n is a, c, g, or t
  misc_feature (1282)..(1282): n is a, c, g, or t
  misc_feature (1314)..(1314): n is a, c, g, or t
agggggccgcggggagggaggcgggaagagcgcggcacttccgctggccgctggctcgctggccgctcctggaggcggcggcgggagcgcagggggcgcgcggcccggggactcgcattccccggttccccctccaccccacgcggcctggaccatggacgccagatggtgggcagtggtggtgctggctgcgttcccctccctaggggcaggtggggagactcccgaagcccctccggagtcatggacccagctatggttcttccgatttgtggtgaatgctgctggctatgccagctttatggtacctggctacctcctggtgcagtacttcaggcggaagaactacctggagaccggtaggggcctctgctttcccctggtgaaagcttgtgtgtttggcaatgagcccaaggcctctgatgaggttcccctggcgccccgaacagaggcggcagagaccaccccgatgtggcaggccctgaagctgctcttctgtgccacagggctccaggtgtcttatctgacttggggtgtgctgcaggaaagagtgatgacccgcagctatggggccacagccacatcaccgggtgagcgctttacggactcgcagttcctggtgctaatgaaccgagtgctggcactgattgtggctggcctctcctgtgttctctgcaagcagccccggcatggggcacccatgtaccggtactcctttgccagcctgtccaatgtgcttagcagctggtgccaatacgaagctcttaagttcgtcagcttccccacccaggtgctggccaaggcctctaaggtgatccctgtcatgctgatgggaaagcttgtgtctcggcgcagctacgaacactgggagtacctgacagccaccctcatctccattggggtcagcatgtttctgctatccagcggaccagagccccgcagctccccagccaccacactctcaggcctcatcttactggcaggttatattgcttttgacagcttcacctcaaactggcaggatgccctgtttgcctataagatgtcatcggtgcagatgatgtttggggtcaatttcttctcctgcctcttcacagtgggctcactgctagaacagggggccctactggagggaacccgcttcatggggcgacacagtgagtttgctgcccatgccctgctactctccatctgctccgcatgtggccagctcttcatcttttacaccattgggcagtttggggctgccgtcttcaccaanctgcatcaccctgttcaacgnggtgactgcggttggacgtggccacacttgtngaggctggtaga

SEQ ID NO: 313310 - DNA, 555 bp, Homo sapiens
agcccccgggccacgtgactgccgcgcctcagcacgggggccgggtggggtcccggctgctcggccgtcggccagcatatcgctgcccggagccagcggggatgggagctgcggcttggttttgtgctccttggggagcttcgggcggaggggctggggaccctgacgtcccggatcgtggaggggagtgtgggggaaggggcgcttcctctgacctgagcagccggctagcgttggagggaacagaggagacctgtgtggccagaggggcggatccgcccccggggagggaggaagctctgcctggccagcgccggcgcaccccctccccgagagagagagagagagagaggctctttgtccgggccggagctgcagcggagggggcggggaggagactccgggcactactccagtgtggtcccctctggagggcggaggggatgaggagctgcgccctaatccttatgtccgctttccttacagatggtgggcagtggtggtgctggctgcgttcccctccctaggggcaggtggggagactcccgaagcccc

SEQ ID NO: 313311 - DNA, 1425 bp, Homo sapiens
agcggggaagtagggcctgatgtaaacacccgagccgggctccaaggcccgggaggtcagaaaaccgggccgcgggcggcaccgacagctggggcccgggtcagggacacgcggaggtcaggccggtgaaggcggcaggaagctggagcacgatcccaggaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctggaccacgagcaggtgggcagcatgggcttggtggagatgctgcaccgctccaaccttctggccttggtgggcggtggtagtagtcccaagttctcagagatctcagtgctgatctgggacgatgcccgggagggcaaggactccaaggagaagctggtgctggagttcaccttcaccaagccagtgctttctgtgcgcatgcgccatgacaagatcgtgatcgtgctgaagaaccgcatctatgtgtactccttccccgacaatccccgaaagctgtttgagtttgatacccgggacaaccccaaggggctctgtgacctctgccccagcctggagaagcaactgctagtgttcccgggacacaagtgtgggagtctgcaacttgtggacctggcgagcacaaagcctggcacctcgtctgctccattcacgatcaatgcacatcagagtgacatagcctgtgtgtctctaaaccagccaggcactgtagtggcctcagcctcccagaagggtacccttattcgcctctttgacacacaatccaaggagaaactggtggagctgcgccgaggcactgaccctgccaccctctactgcattaacttcagccacgactcctccttcctctgcgcttccagtgataagggtactgtccatatctttgctctcaaggatacccgcctcaaccgccgctccgcgctggctcgcgtgggcaaggtggggcctatgattgggcagtacgtggactctcagtggagcctggcgagcttcactgtgcctgctgagtcagcttgcatctgcgccttcggtcgcaatacttccaagaacgtcaactctgtcattgccatctgcgtagatgggaccttccacaaatatgtcttcactcctgatggaaactgcaacagagaggctttcgacgtgtaccttgacatctgtgatgatgatgacttttaaggaccctgggggctgtgctagggacctgcagtggcagaactgcagagctgagccttggcagtggggcgtgcttggaagccaccagccagcaagcattaatggggctggtgcccactttccactcagcagagctatgtctaaataaagagctcacttccccccagc

SEQ ID NO: 313312 - DNA, 2450 bp, Homo sapiens
agcggggaagtagggcctgatgtaaacacccgagccgggctccaaggcccgggaggtcagaaaaccgggccgcgggcggcaccgacagctggggcccgggtcagggacacgcggaggtcaggccggtgaaggcggcaggaagctggagcacgatcccaggaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctgggtgagctgttggcaggggaggggcaatgggcagaagagctgggctgggcattggctcccacctccactgacaccctggtccctgtccagaccacgagcaggtgggcagcatgggcttggtggagatgctgcaccgctccaaccttctggccttggtgggcggtggtagtagtcccaagttctcagagatctcaggtaagtgccctcatcctgccctttggcccagatttctcggattcctggcctcccacaggcaccccaaggtactggcagatgaagacgtcagagtacttcagagtcacacagagaggaggcctacagcttggaagtcatggatcttatagcttgagaagcttggtgctttgttttcattttaaaaattctgattgagtgcctcctgtgtgccatgccctagagcacttactgtgagcctggaactgccctaagcactttacgtttattaactcatttaatcctcacagtaactctatggggtaggaaggatcattatccccatctttaccgatgaggaaactgaggcccagtgcagttaagtgactcatccaaggtcacacaagcaataggttttaaaatcttggagccgtcttcccaatacccccttggcttgagcctcaagtgccatcttactttaagggtttttcttgatgatcccatctggacaaggcaggagttgccctaggtgagtcacagagccctaggattcctcacggaaatctccagggtgcatggactaggaccctggaggcagaaatagttaccgaggggaagttacaggcctgagtgtgagtccctgtttggttgctgatgagctttgaggtccttggccagacactcaaccactttgaacctcagtttcctcatctgtagatgagtgtaacagtctagaacactcctctcagggatcatatccacaagtgctcgtgctgtgcgaggatctcactggttgtttattgaaaggctaagcaagtaggttgaggtccctgggaagcaggggtggatcctgtgtcaccagggctgccccttaccctaaaccttggccccgacaacccacccacctgcccagctgctgatctgggacgatgcccgggagggcaaggactccaaggagaagctggtgctggagttcaccttcaccaagccagtgctttctgtgcgcatgcgccatgacaagatcgtgatcgtgctgaagaaccgcatctatgtgtactccttccccgacaatccccgaaagctgtttgagtttgatacccgggacaaccccaaggggctctgtgacctctgccccagcctggagaagcaactgctagtgttcccgggacacaagtgtgggagtctgcaacttgtggacctggcgagcacaaagcctggcacctcgtctgctccattcacgatcaatgcacatcagagtgacatagcctgtgtgtctctaaaccagccaggcactgtagtggcctcagcctcccagaagggtacccttattcgcctctttgacacacaatccaaggagaaactggtggagctgcgccgaggcactgaccctgccaccctctactgcattaacttcagccacgactcctccttcctctgcgcttccagtgataagggtactgtccatatctttgctctcaaggatacccgcctcaaccgccgctccgcgctggctcgcgtgggcaaggtggggcctatgattgggcagtacgtggactctcagtggagcctggcgagcttcactgtgcctgctgagtcagcttgcatctgcgccttcggtcgcaatacttccaagaacgtcaactctgtcattgtgcagagctgagccttggcagtggggcgtgcttggaagccaccagccagcaagcattaatggggctggtgcccactttccactcagcagagctatgtctaaataaagagctcacttccccccagcacttcttgatgactgtgtgccccaagggccaggccagagacccaggaaggcagcgaccccttgggatccctaacctggaggaaattgccagggacccagagggagtgccctaatccaacctggggattttttaaaagcttcctaggaagagatgatctccgatgtgatgaatacgaataaaaggcccttaatggca

SEQ ID NO: 313313 - DNA, 1420 bp, Homo sapiens
agcggggaagtagggcctgatgtaaacacccgagccgggctccaaggcccgggaggtcagaaaaccgggccgcgggcggcaccgacagctggggcccgggtcagggacacgcggaggtcaggccggtgaaggcggcaggaagctggagcacgatcccaggaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctggaccacgagcaggtgggcagcatgggcttggtggagatgctgcaccgctccaaccttctggccttggtgggcggtggtagtagtcccaagttctcagagatctcagggctctgtgacctctgccccagcctggagaagcaactgctagtgttcccgggacacaagtgtgggagtctgcaacttgtggacctggcgagcacaaagcctggcacctcgtctgctccattcacgatcaatgcacatcagagtgacatagcctgtgtgtctctaaaccagccaggcactgtagtggcctcagcctcccagaagggtacccttattcgcctctttgacacacaatccaaggagaaactggtggagctgcgccgaggcactgaccctgccaccctctactgcattaacttcagccacgactcctccttcctctgcgcttccagtgataagggtactgtccatatctttgctctcaaggatacccgcctcaaccgccgctccgcgctggctcgcgtgggcaaggtggggcctatgattgggcagtacgtggactctcagtggagcctggcgagcttcactgtgcctgctgagtcagcttgcatctgcgccttcggtcgcaatacttccaagaacgtcaactctgtcattgccatctgcgtagatgggaccttccacaaatatgtcttcactcctgatggaaactgcaacagagaggctttcgacgtgtaccttgacatctgtgatgatgatgacttttaaggaccctgggggctgtgctagggacctgcagtggcagaactgcagagctgagccttggcagtggggcgtgcttggaagccaccagccagcaagcattaatggggctggtgcccactttccactcagcagagctatgtctaaataaagagctcacttccccccagcacttcttgatgactgtgtgccccaagggccaggccagagacccaggaaggcagcgaccccttgggatccctaacctggaggaaattgccagggacccagagggagtgccctaatccaacctggggattttttaaaagcttcctaggaagagatgatctccgatgtgatgaatacgaataaaaggcccttaatggca

SEQ ID NO: 313314 - DNA, 1650 bp, Homo sapiens
  misc_feature (1626)..(1626): n is a, c, g, or t
  misc_feature (1628)..(1628): n is a, c, g, or t
agcggggaagtagggcctgatgtaaacacccgagccgggctccaaggcccgggaggtcagaaaaccgggccgcgggcggcaccgacagctggggcccgggtcagggacacgcggaggtcaggccggtgaaggcggcaggaagctggagcacgatcccaggaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctggaccacgagcaggtgggcagcatgggcttggtggagatgctgcaccgctccaaccttctggccttggtgggcggtggtagtagtcccaagttctcagagatctcagtgctgatctgggacgatgcccgggagggcaaggactccaaggagaagctggtgctggagttcaccttcaccaagccagtgctttctgtgcgcatgcgccatgacaagatcgtgatcgtgctgaagaaccgcatctatgtgtactccttccccgacaatccccgaaagctgtttgagtttgatacccgggacaaccccaaggggctctgtgacctctgccccagcctggagaagcaactgctagtgttcccgggacacaagtgtgggagtctgcaacttgtggacctggcgagcacaaagcctggcacctcgtctgctccattcacgatcaatgcacatcagagtgacatagcctgtgtgtctctaaaccagccaggcactgtagtggcctcagcctcccagaagggtacccttattcgcctctttgacacacaatccaaggagaaactggtggagctgcgccgaggcactgaccctgccaccctctactgcattaacttcagccacgactcctccttcctctgcgcttccagtgataagggtactgtccatatctttgctctcaaggatacccgcctcaaccgccgctccgcgctggctcgcgtgggcaaggtggggcctatgattgggcagtacgtggactctcagtggagcctggcgagcttcactgtgcctgctgagtcagcttgcatctgcgccttcggtcgcaatacttccaagaacgtcaactctgtcattgccatctgcgtagatgggaccttccacaaatatgtcttcactcctgatggaaactgcaacagagaggctttcgacgtgtaccttgacatctgtgatgatgatgacttttaaggaccctgggggctgtgctagggacctgcagtggcagaactgcagagctgagccttggcagtggggcgtgcttggaagccaccagccagcaagcattaatggggctggtgcccactttccactcagcagagctatgtctaaataaagagctcacttccccccagcacttcttgatgactgtgtgccccaagggccaggccagagacccaggaaggcagcgaccccttgggatccctaacctggaggaaattgccagggacccagagggagtgccctaatccaacctggggattttttaaaagcttcctaggaagagatgatctccgatgtgatgaatacgaataaaaggcccttaatggcaaaaanancaaccagacaaaaaaccagaca

SEQ ID NO: 313315 - DNA, 2404 bp, Homo sapiens
agcggggaagtagggcctgatgtaaacacccgagccgggctccaaggcccgggaggtcagaaaaccgggccgcgggcggcaccgacagctggggcccgggtcagggacacgcggaggtcaggccggtgaaggcggcaggaagctggagcacgatcccaggaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctgggtgagctgttggcaggggaggggcaatgggcagaagagctgggctgggcattggctcccacctccactgacaccctggtccctgtccagaccacgagcaggtgggcagcatgggcttggtggagatgctgcaccgctccaaccttctggccttggtgggcggtggtagtagtcccaagttctcagagatctcaggtaagtgccctcatcctgccctttggcccagatttctcggattcctggcctcccacaggcaccccaaggtactggcagatgaagacgtcagagtacttcagagtcacacagagaggaggcctacagcttggaagtcatggatcttatagcttgagaagcttggtgctttgttttcattttaaaaattctgattgagtgcctcctgtgtgccatgccctagagcacttactgtgagcctggaactgccctaagcactttacgtttattaactcatttaatcctcacagtaactctatggggtaggaaggatcattatccccatctttaccgatgaggaaactgaggcccagtgcagttaagtgactcatccaaggtcacacaagcaataggttttaaaatcttggagccgtcttcccaatacccccttggcttgagcctcaagtgccatcttactttaagggtttttcttgatgatcccatctggacaaggcaggagttgccctaggtgagtcacagagccctaggattcctcacggaaatctccagggtgcatggactaggaccctggaggcagaaatagttaccgaggggaagttacaggcctgagtgtgagtccctgtttggttgctgatgagctttgaggtccttggccagacactcaaccactttgaacctcagtttcctcatctgtagatgagtgtaacagtctagaacactcctctcagggatcatatccacaagtgctcgtgctgtgcgaggatctcactggttgtttattgaaaggctaagcaagtaggttgaggtccctgggaagcaggggtggatcctgtgtcaccagggctgccccttaccctaaaccttggccccgacaacccacccacctgcccagctgctgatctgggacgatgcccgggagggcaaggactccaaggagaagctggtgctggagttcaccttcaccaagccagtgctttctgtgcgcatgcgccatgacaagatcgtgatcgtgctgaagaaccgcatctatgtgtactccttccccgacaatccccgaaagctgtttgagtttgatacccgggacaaccccaaggggctctgtgacctctgccccagcctggagaagcaactgctagtgttcccgggacacaagtgtgggagtctgcaacttgtggacctggcgagcacaaagcctggcacctcgtctgctccattcacgatcaatgcacatcagagtgacatagcctgtgtgtctctaaaccagccaggcactgtagtggcctcagcctcccagaagggtacccttattcgcctctttgacacacaatccaaggagaaactggtggagctgcgccgaggcactgaccctgccaccctctactgcattaacttcagccacgactcctccttcctctgcgcttccagtgataagggtactgtccatatctttgctctcaaggatacccgcctcaaccgccgctccgcgctggctcgcgtgggcaaggtggggcctatgattgggcagtacgtggactctcagtggagcctggcgagcttcactgtgcctgctgagtcagcttgcatctgcgccttcggtcgcaatacttccaagaacgtcaactctgtcattgccatctgcgtagatgggaccttccacaaatatgtcttcactcctgatggaaactgcaacagagaggctttcgacgtgtaccttgacatctgtgatgatgatgacttttaaggaccctgggggctgtgctagggacctgcagtggcagaactgcagagctgagccttggcagtggggcgtgcttggaagccaccagccagcaagcattaatggggctggtgcccactttccactcagcagagctatgtctaaataaagagctcacttccccccagc

SEQ ID NO: 313316 - DNA, 2864 bp, Homo sapiens
ctgggctccgggaaagtcgtgcttttacggttccgggtactggctcccacaccactgcctcgtgtggggttgttcgcccgtgaaggggcaggacagggtgcgcgctggtggaggttgaaattgttacattttggccgggcgcggtggctcacgcctgtaatcccagcactttgggaggccgaggcaggtggatcacgaggtcaggagatcgagaccatcctggctaacacagtgaaaccccgtctctactaaaaaaatacaaaaaatcagccgggcgtggtgacgggcgcctgtagtcccagctactcaggaggctgaggcaggaggatggcgtgaacccgggaggcggagcttgcagtgagccgagatcgcgccagtgcactccagcctgggcgacagagcgaaactacgtctcaaaaaaaaaaaaaaagaaagaaaagaaattgttacattttatatatatacagtctcggccttgaggaacccccttcgcctccggtcccccagccaaccttcctccgctccccgcgccctccccggagaaccccactgtcactcgcgatgctccgaagacccgggaactaggcgaggaaggcggtggccgcctttttccagctgggaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctgggtgagctgttggcaggggaggggcaatgggcagaagagctgggctgggcattggctcccacctccactgacaccctggtccctgtccagaccacgagcaggtgggcagcatgggcttggtggagatgctgcaccgctccaaccttctggccttggtgggcggtggtagtagtcccaagttctcagagatctcaggtaagtgccctcatcctgccctttggcccagatttctcggattcctggcctcccacaggcaccccaaggtactggcagatgaagacgtcagagtacttcagagtcacacagagaggaggcctacagcttggaagtcatggatcttatagcttgagaagcttggtgctttgttttcattttaaaaattctgattgagtgcctcctgtgtgccatgccctagagcacttactgtgagcctggaactgccctaagcactttacgtttattaactcatttaatcctcacagtaactctatggggtaggaaggatcattatccccatctttaccgatgaggaaactgaggcccagtgcagttaagtgactcatccaaggtcacacaagcaataggttttaaaatcttggagccgtcttcccaatacccccttggcttgagcctcaagtgccatcttactttaagggtttttcttgatgatcccatctggacaaggcaggagttgccctaggtgagtcacagagccctaggattcctcacggaaatctccagggtgcatggactaggaccctggaggcagaaatagttaccgaggggaagttacaggcctgagtgtgagtccctgtttggttgctgatgagctttgaggtccttggccagacactcaaccactttgaacctcagtttcctcatctgtagatgagtgtaacagtctagaacactcctctcagggatcatatccacaagtgctcgtgctgtgcgaggatctcactggttgtttattgaaaggctaagcaagtaggttgaggtccctgggaagcaggggtggatcctgtgtcaccagggctgccccttaccctaaaccttggccccgacaacccacccacctgcccagctgctgatctgggacgatgcccgggagggcaaggactccaaggagaagctggtgctggagttcaccttcaccaagccagtgctttctgtgcgcatgcgccatgacaagatcgtgatcgtgctgaagaaccgcatctatgtgtactccttccccgacaatccccgaaagctgtttgagtttgatacccgggacaaccccaaggggctctgtgacctctgccccagcctggagaagcaactgctagtgttcccgggacacaagtgtgggagtctgcaacttgtggacctggcgagcacaaagcctggcacctcgtctgctccattcacgatcaatgcacatcagagtgacatagcctgtgtgtctctaaaccagccaggcactgtagtggcctcagcctcccagaagggtacccttattcgcctctttgacacacaatccaaggagaaactggtggagctgcgccgaggcactgaccctgccaccctctactgcattaacttcagccacgactcctccttcctctgcgcttccagtgataagggtactgtccatatctttgctctcaaggatacccgcctcaaccgccgctccgcgctggctcgcgtgggcaaggtggggcctatgattgggcagtacgtggactctcagtggagcctggcgagcttcactgtgcctgctgagtcagcttgcatctgcgccttcggtcgcaatacttccaagaacgtcaactctgtcattgccatctgcgtagatgggaccttccacaaatatgtcttcactcctgatggaaactgcaacagagaggctttcgacgtgtaccttgacatctgtgatgatgatgacttttaaggaccctgggggctgtgctagggacctgcagtggcagaactgcagagctgagccttggcagtggggcgtgcttggaagccaccagccagcaagcattaatggggctggtgcccactttccactcagcagagctatgtctaaataaagagctcacttccccccagc

SEQ ID NO: 313317 - DNA, 2152 bp, Homo sapiens
agcggggaagtagggcctgatgtaaacacccgagccgggctccaaggcccgggaggtcagaaaaccgggccgcgggcggcaccgacagctggggcccgggtcagggacacgcggaggtcaggccggtgaaggcggcaggaagctggagcacgatcccaggaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctgggcaccccaaggtactggcagatgaagacgtcagagtacttcagagtcacacagagaggaggcctacagcttggaagtcatggatcttatagcttgagaagcttggtgctttgttttcattttaaaaattctgattgagtgcctcctgtgtgccatgccctagagcacttactgtgagcctggaactgccctaagcactttacgtttattaactcatttaatcctcacagtaactctatggggtaggaaggatcattatccccatctttaccgatgaggaaactgaggcccagtgcagttaagtgactcatccaaggtcacacaagcaataggttttaaaatcttggagccgtcttcccaatacccccttggcttgagcctcaagtgccatcttactttaagggtttttcttgatgatcccatctggacaaggcaggagttgccctaggtgagtcacagagccctaggattcctcacggaaatctccagggtgcatggactaggaccctggaggcagaaatagttaccgaggggaagttacaggcctgagtgtgagtccctgtttggttgctgatgagctttgaggtccttggccagacactcaaccactttgaacctcagtttcctcatctgtagatgagtgtaacagtctagaacactcctctcagggatcatatccacaagtgctcgtgctgtgcgaggatctcactggttgtttattgaaaggctaagcaagtaggttgaggtccctgggaagcaggggtggatcctgtgtcaccagggctgccccttaccctaaaccttggccccgacaacccacccacctgcccagctgctgatctgggacgatgcccgggagggcaaggactccaaggagaagctggtgctggagttcaccttcaccaagccagtgctttctgtgcgcatgcgccatgacaagatcgtgatcgtgctgaagaaccgcatctatgtgtactccttccccgacaatccccgaaagctgtttgagtttgatacccgggacaaccccaaggggctctgtgacctctgccccagcctggagaagcaactgctagtgttcccgggacacaagtgtgggagtctgcaacttgtggacctggcgagcacaaagcctggcacctcgtctgctccattcacgatcaatgcacatcagagtgacatagcctgtgtgtctctaaaccagccaggcactgtagtggcctcagcctcccagaagggtacccttattcgcctctttgacacacaatccaaggagaaactggtggagctgcgccgaggcactgaccctgccaccctctactgcattaacttcagccacgactcctccttcctctgcgcttccagtgataagggtactgtccatatctttgctctcaaggatacccgcctcaaccgccgctccgcgctggctcgcgtgggcaaggtggggcctatgattgggcagtacgtggactctcagtggagcctggcgagcttcactgtgcctgctgagtcagcttgcatctgcgccttcggtcgcaatacttccaagaacgtcaactctgtcattgccatctgcgtagatgggaccttccacaaatatgtcttcactcctgatggaaactgcaacagagaggctttcgacgtgtaccttgacatctgtgatgatgatgacttttaaggaccctgggggctgtgctagggacctgcagtggcagaactgcagagctgagccttggcagtggggcgtgcttggaagccaccagccagcaagcattaatggggctggtgcccactttccactcagcagagctatgtctaaataaagagctcacttccccccagc

SEQ ID NO: 313318 - DNA, 1930 bp, Homo sapiens
agcggggaagtagggcctgatgtaaacacccgagccgggctccaaggcccgggaggtcagaaaaccgggccgcgggcggcaccgacagctggggcccgggtcagggacacgcggaggtcaggccggtgaaggcggcaggaagctggagcacgatcccaggaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctggaccacgagcaggtgggcagcatgggcttggtggagatgctgcaccgctccaaccttctggccttggtgggcggtggtagtagtcccaagttctcagagatctcagtgctgatctgggacgatgcccgggagggcaaggactccaaggagaagctggtgctggagttcaccttcaccaagccagtgctttctgtgcgcatgcgccatgacaagatcgtgatcgtgctgaagaaccgcatctatgtgtactccttccccgacaatccccgaaagctgtttgagtttgatacccgggacaaccccaaggggctctgtgacctctgccccagcctggagaagcaactgctagtgttcccgggacacaagtgtgggagtctgcaacttgtggacctggcgagcacaaagcctggcacctcgtctgctccattcacgatcaatgcacatcagagtgacatagcctgtgtgtctctaaaccagccaggcactgtagtggcctcagcctcccagaagggtacccttattcgcctctttgacacacaatccaaggagaaactggtggagctgcgccgaggcactgaccctgccaccctctactgcattaacttcagccacgactcctccttcctctgcgcttccagtgataagggtactgtccatatctttgctctcaaggatacccgcctcaaccgccgctccgcgcgtgagtaccccctccccaccctaccgtgtccctgtccccctgcccatttaccatacctgggcttagccagtgctgcctgcaggctggctcgcgtgggcaaggtggggcctatgattgggcagtacgtggactctcagtggagcctggcgagcttcactgtgcctgctgagtcagcttgcatctgcgccttcggtcgcaatacttccaagaacgtcaactctgtcattgtggtgagtgggaacagccccttggttgggggtactgcatggggcaaaggcctgcaggttggacctgaaaggattttagggccatgtgaggctcagcttcatcatcagtaagggggacagcactgggcaaaggcctggaggcagaccctaggtcctgagatgcctgagaggactggagcctgtggctgtggcagcctctgaccttttaccaccccccctcccccagccatctgcgtagatgggaccttccacaaatatgtcttcactcctgatggaaactgcaacagagaggctttcgacgtgtaccttgacatctgtgatgatgatgacttttaaggaccctgggggctgtgctagggacctgcagtggcagaactgcagagctgagccttggcagtggggcgtgcttggaagccaccagccagcaagcattaatggggctggtgcccactttccactcagcagagctatgtctaaataaagagctcacttccccccagcacttcttgatgactgtgtgccccaagggccaggccagagacccaggaaggcagcgaccccttgggatccctaacctggaggaaattgccagggacccagagggagtgccctaatccaacctggggattttttaaaagcttcctaggaagagatgatctccgatgtgatgaatacgaataaaaggcccttaatggca

SEQ ID NO: 313319 - DNA, 1320 bp, Homo sapiens
agcggggaagtagggcctgatgtaaacacccgagccgggctccaaggcccgggaggtcagaaaaccgggccgcgggcggcaccgacagctggggcccgggtcagggacacgcggaggtcaggccggtgaaggcggcaggaagctggagcacgatcccaggaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctggtgctgatctgggacgatgcccgggagggcaaggactccaaggagaagctggtgctggagttcaccttcaccaagccagtgctttctgtgcgcatgcgccatgacaagatcgtgatcgtgctgaagaaccgcatctatgtgtactccttccccgacaatccccgaaagctgtttgagtttgatacccgggacaaccccaaggggctctgtgacctctgccccagcctggagaagcaactgctagtgttcccgggacacaagtgtgggagtctgcaacttgtggacctggcgagcacaaagcctggcacctcgtctgctccattcacgatcaatgcacatcagagtgacatagcctgtgtgtctctaaaccagccaggcactgtagtggcctcagcctcccagaagggtacccttattcgcctctttgacacacaatccaaggagaaactggtggagctgcgccgaggcactgaccctgccaccctctactgcattaacttcagccacgactcctccttcctctgcgcttccagtgataagggtactgtccatatctttgctctcaaggatacccgcctcaaccgccgctccgcgctggctcgcgtgggcaaggtggggcctatgattgggcagtacgtggactctcagtggagcctggcgagcttcactgtgcctgctgagtcagcttgcatctgcgccttcggtcgcaatacttccaagaacgtcaactctgtcattgccatctgcgtagatgggaccttccacaaatatgtcttcactcctgatggaaactgcaacagagaggctttcgacgtgtaccttgacatctgtgatgatgatgacttttaaggaccctgggggctgtgctagggacctgcagtggcagaactgcagagctgagccttggcagtggggcgtgcttggaagccaccagccagcaagcattaatggggctggtgcccactttccactcagcagagctatgtctaaataaagagctcacttccccccagc

SEQ ID NO: 313320 - DNA, 1650 bp, Homo sapiens
agcggggaagtagggcctgatgtaaacacccgagccgggctccaaggcccgggaggtcagaaaaccgggccgcgggcggcaccgacagctggggcccgggtcagggacacgcggaggtcaggccggtgaaggcggcaggaagctggagcacgatcccaggaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctggaccacgagcaggtgggcagcatgggcttggtggagatgctgcaccgctccaaccttctggccttggtgggcggtggtagtagtcccaagttctcagagatctcagtgctgatctgggacgatgcccgggagggcaaggactccaaggagaagctggtgctggagttcaccttcaccaagccagtgctttctgtgcgcatgcgccatgacaagatcgtgatcgtgctgaagaaccgcatctatgtgtactccttccccgacaatccccgaaagctgtttgagtttgatacccgggacaaccccaaggggctctgtgacctctgccccagcctggagaagcaactgctagtgttcccgggacacaagtgtgggagtctgcaacttgtggacctggcgagcacaaagcctggcacctcgtctgctccattcacgatcaatgcacatcagagtgacatagcctgtgtgtctctaaaccagccaggcactgtagtggcctcagcctcccagaagggtacccttattcgcctctttgacacacaatccaaggagaaactggtggagctgcgccgaggcactgaccctgccaccctctactgcattaacttcagccacgactcctccttcctctgcgcttccagtgataagggtactgtccatatctttgctctcaaggatacccgcctcaaccgccgctccgcgctggctcgcgtgggcaaggtggggcctatgattgggcagtacgtggactctcagtggagcctggcgagcttcactgtgcctgctgagtcagcttgcatctgcgccttcggtcgcaatacttccaagaacgtcaactctgtcattgtggtgagtgggaacagccccttggttgggggtactgcatggggcaaaggcctgcaggttggacctgaaaggattttagggccatgtgaggctcagcttcatcatcagtaagggggacagcactgggcaaaggcctggaggcagaccctaggtcctgagatgcctgagaggactggagcctgtggctgtggcagcctctgaccttttaccaccccccctcccccagccatctgcgtagatgggaccttccacaaatatgtcttcactcctgatggaaactgcaacagagaggctttcgacgtgtaccttgacatctgtgatgatgatgacttttaaggaccctgggggctgtgctagggacctgcagtggcagaactgcagagctgagccttggcagtggggcgtgcttggaagccaccagccagcaagcattaatggggctggtgcccactttccactcagcagagctatgtctaaataaagagctcacttccccccagc

SEQ ID NO: 313321 - DNA, 2510 bp, Homo sapiens
agcggggaagtagggcctgatgtaaacacccgagccgggctccaaggcccgggaggtcagaaaaccgggccgcgggcggcaccgacagctggggcccgggtcagggacacgcggaggtcaggccggtgaaggcggcaggaagctggagcacgatcccaggaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctgggtgagctgttggcaggggaggggcaatgggcagaagagctgggctgggcattggctcccacctccactgacaccctggtccctgtccagaccacgagcaggtgggcagcatgggcttggtggagatgctgcaccgctccaaccttctggccttggtgggcggtggtagtagtcccaagttctcagagatctcaggtaagtgccctcatcctgccctttggcccagatttctcggattcctggcctcccacaggcaccccaaggtactggcagatgaagacgtcagagtacttcagagtcacacagagaggaggcctacagcttggaagtcatggatcttatagcttgagaagcttggtgctttgttttcattttaaaaattctgattgagtgcctcctgtgtgccatgccctagagcacttactgtgagcctggaactgccctaagcactttacgtttattaactcatttaatcctcacagtaactctatggggtaggaaggatcattatccccatctttaccgatgaggaaactgaggcccagtgcagttaagtgactcatccaaggtcacacaagcaataggttttaaaatcttggagccgtcttcccaatacccccttggcttgagcctcaagtgccatcttactttaagggtttttcttgatgatcccatctggacaaggcaggagttgccctaggtgagtcacagagccctaggattcctcacggaaatctccagggtgcatggactaggaccctggaggcagaaatagttaccgaggggaagttacaggcctgagtgtgagtccctgtttggttgctgatgagctttgaggtccttggccagacactcaaccactttgaacctcagtttcctcatctgtagatgagtgtaacagtctagaacactcctctcagggatcatatccacaagtgctcgtgctgtgcgaggatctcactggttgtttattgaaaggctaagcaagtaggttgaggtccctgggaagcaggggtggatcctgtgtcaccagggctgccccttaccctaaaccttggccccgacaacccacccacctgcccagctgctgatctgggacgatgcccgggagggcaaggactccaaggagaagctggtgctggagttcaccttcaccaagccagtgctttctgtgcgcatgcgccatgacaagatcgtgatcgtgctgaagaaccgcatctatgtgtactccttccccgacaatccccgaaagctgtttgagtttgatacccgggacaaccccaaggggctctgtgacctctgccccagcctggagaagcaactgctagtgttcccgggacacaagtgtgggagtctgcaacttgtgccaggcactgtagtggcctcagcctcccagaagggtacccttattcgcctctttgacacacaatccaaggagaaactggtggagctgcgccgaggcactgaccctgccaccctctactgcattaacttcagccacgactcctccttcctctgcgcttccagtgataagggtactgtccatatctttgctctcaaggatacccgcctcaaccgccgctccgcgctggctcgcgtgggcaaggtggggcctatgattgggcagtacgtggactctcagtggagcctggcgagcttcactgtgcctgctgagtcagcttgcatctgcgccttcggtcgcaatacttccaagaacgtcaactctgtcattgccatctgcgtagatgggaccttccacaaatatgtcttcactcctgatggaaactgcaacagagaggctttcgacgtgtaccttgacatctgtgatgatgatgacttttaaggaccctgggggctgtgctagggacctgcagtggcagaactgcagagctgagccttggcagtggggcgtgcttggaagccaccagccagcaagcattaatggggctggtgcccactttccactcagcagagctatgtctaaataaagagctcacttccccccagcacttcttgatgactgtgtgccccaagggccaggccagagacccaggaaggcagcgaccccttgggatccctaacctggaggaaattgccagggacccagagggagtgccctaatccaacctggggattttttaaaagcttcctaggaagagatgatctccgatgtgatgaatacgaataaaaggcccttaatggca

SEQ ID NO: 313322 - DNA, 2712 bp, Homo sapiens
agcggggaagtagggcctgatgtaaacacccgagccgggctccaaggcccgggaggtcagaaaaccgggccgcgggcggcaccgacagctggggcccgggtcagggacacgcggaggtcaggccggtgaaggcggcaggaagctggagcacgatcccaggaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctgggtgagctgttggcaggggaggggcaatgggcagaagagctgggctgggcattggctcccacctccactgacaccctggtccctgtccagaccacgagcaggtgggcagcatgggcttggtggagatgctgcaccgctccaaccttctggccttggtgggcggtggtagtagtcccaagttctcagagatctcaggtaagtgccctcatcctgccctttggcccagatttctcggattcctggcctcccacaggcaccccaaggtactggcagatgaagacgtcagagtacttcagagtcacacagagaggaggcctacagcttggaagtcatggatcttatagcttgagaagcttggtgctttgttttcattttaaaaattctgattgagtgcctcctgtgtgccatgccctagagcacttactgtgagcctggaactgccctaagcactttacgtttattaactcatttaatcctcacagtaactctatggggtaggaaggatcattatccccatctttaccgatgaggaaactgaggcccagtgcagttaagtgactcatccaaggtcacacaagcaataggttttaaaatcttggagccgtcttcccaatacccccttggcttgagcctcaagtgccatcttactttaagggtttttcttgatgatcccatctggacaaggcaggagttgccctaggtgagtcacagagccctaggattcctcacggaaatctccagggtgcatggactaggaccctggaggcagaaatagttaccgaggggaagttacaggcctgagtgtgagtccctgtttggttgctgatgagctttgaggtccttggccagacactcaaccactttgaacctcagtttcctcatctgtagatgagtgtaacagtctagaacactcctctcagggatcatatccacaagtgctcgtgctgtgcgaggatctcactggttgtttattgaaaggctaagcaagtaggttgaggtccctgggaagcaggggtggatcctgtgtcaccagggctgccccttaccctaaaccttggccccgacaacccacccacctgcccagctgctgatctgggacgatgcccgggagggcaaggactccaaggagaagctggtgctggagttcaccttcaccaagccagtgctttctgtgcgcatgcgccatgacaagatcgtgatcgtgctgaagaaccgcatctatgtgtactccttccccgacaatccccgaaagctgtttgagtttgatacccgggacaaccccaaggggctctgtgacctctgccccagcctggagaagcaactgctagtgttcccgggacacaagtgtgggagtctgcaacttgtggtgagccgtccagtggacaagggtgggtaggttggtggactggcttccttgtggactcttggccccttccctccataccaccccaacctcagactcctccctcctaccccaggacctggcgagcacaaagcctggcacctcgtctgctccattcacgatcaatgcacatcagagtgacatagcctgtgtgtctctaaaccagccaggcactgtagtggcctcagcctcccagaagggtacccttattcgcctctttgacacacaatccaaggagaaactggtggagctgcgccgaggcactgaccctgccaccctctactgcattaacttcagccacgactcctccttcctctgcgcttccagtgataagggtactgtccatatctttgctctcaaggatacccgcctcaaccgccgctccgcgctggctcgcgtgggcaaggtggggcctatgattgggcagtacgtggactctcagtggagcctggcgagcttcactgtgcctgctgagtcagcttgcatctgcgccttcggtcgcaatacttccaagaacgtcaactctgtcattgccatctgcgtagatgggaccttccacaaatatgtcttcactcctgatggaaactgcaacagagaggctttcgacgtgtaccttgacatctgtgatgatgatgacttttaaggaccctgggggctgtgctagggacctgcagtggcagaactgcagagctgagccttggcagtggggcgtgcttggaagccaccagccagcaagcattaatggggctggtgcccactttccactcagcagagctatgtctaaataaagagctcacttccccccagcacttcttgatgactgtgtgccccaagggccaggccagagacccaggaaggcagcgaccccttgggatccctaacctggaggaaattgccagggacccagagggagtgccctaatccaacctggggattttttaaaagcttcctaggaagagatgatctccgatgtgatgaatacgaataaaaggcccttaatggca

SEQ ID NO: 313323 - DNA, 1859 bp, Homo sapiens
agcggggaagtagggcctgatgtaaacacccgagccgggctccaaggcccgggaggtcagaaaaccgggccgcgggcggcaccgacagctggggcccgggtcagggacacgcggaggtcaggccggtgaaggcggcaggaagctggagcacgatcccaggaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctgggtgagctgttggcaggggaggggcaatgggcagaagagctgggctgggcattggctcccacctccactgacaccctggtccctgtccagaccacgagcaggtgggcagcatgggcttggtggagatgctgcaccgctccaaccttctggccttggtgggcggtggtagtagtcccaagttctcagagatctcaggtaagtgccctcatcctgccctttggcccagatttctcggattcctggcctcccacaggcaccccaaggtactggcagatgaagacgtcagagtacttcagagtcacacagagaggaggcctacagcttggaagtcatggatcttatagcttgagaagcttggtgctttgttttcattttaaaaattctgattgagtgcctcctgtgtgccatgccctagagcacttactgtgagcctggaactgccctaagcactttacgtttattaactcatttaatcctcacagtaactctatggggtaggaaggatcattatccccatctttaccgatgaggaaactgaggcccagtgcagttaagtgactcatccaaggtcacacaagcaataggttttaaaatcttggagccgtcttcccaatacccccttggcttgagcctcaagtgccatcttactttaagggtttttcttgatgatcccatctggacaaggcaggagttgccctaggtgagtcacagagccctaggattcctcacggaaatctccagggtgcatggactaggaccctggaggcagaaatagttaccgaggggaagttacaggcctgagtgtgagtccctgtttggttgctgatgagctttgaggtccttggccagacagcgtgagtaccccctccccaccctaccgtgtccctgtccccctgcccatttaccatacctgggcttagccagtgctgcctgcaggctggctcgcgtgggcaaggtggggcctatgattgggcagtacgtggactctcagtggagcctggcgagcttcactgtgcctgctgagtcagcttgcatctgcgccttcggtcgcaatacttccaagaacgtcaactctgtcattgccatctgcgtagatgggaccttccacaaatatgtcttcactcctgatggaaactgcaacagagaggctttcgacgtgtaccttgacatctgtgatgatgatgacttttaaggaccctgggggctgtgctagggacctgcagtggcagaactgcagagctgagccttggcagtggggcgtgcttggaagccaccagccagcaagcattaatggggctggtgcccactttccactcagcagagctatgtctaaataaagagctcacttccccccagcacttcttgatgactgtgtgccccaagggccaggccagagacccaggaaggcagcgaccccttgggatccctaacctggaggaaattgccagggacccagagggagtgccctaatccaacctggggattttttaaaagcttcctaggaagagatgatctccgatgtgatgaatacgaataaaaggcccttaatggca

SEQ ID NO: 313324 - DNA, 796 bp, Homo sapiens
tatctttgctctcaaggatatggacagtacccttatcactggaagcgcagaggaaggaggagtcgtggctgaagttaatgcagtagagggtggcagggtcagtgcctctgcgcttccagtgataagggtactgtccatatctttgctctcaaggatacccgcctcaaccgccgctccgcgctggctcgcgtgggcaaggtggggcctatgattgggcagtacgtggactctcagtggagcctggcgagcttcactgtgcctgctgagtcagcttgcatctgcgccttcggtcgcaatacttccaagaacgtcaactctgtcattgccatctgcgtagatgggaccttccacaaatatgtcttcactcctgatggaaactgcaacagagaggctttcgacgtgtaccttgacatctgtgatgatgatgacttttaaggaccctgggggctgtgctagggacctgcagtggcagaactgcagagctgagccttggcagtggggcgtgcttggaagccaccagccagcaagcattaatggggctggtgcccactttccactcagcagagctatgtctaaataaagagctcacttccccccagcacttcttgatgactgtgtgccccaagggccaggccagagacccaggaaggcagcgaccccttgggatccctaacctggaggaaattgccagggacccagagggagtgccctaatccaacctggggattttttaaaagcttcctaggaagagatgatctccgatgtgatgaatacgaataaaaggcccttaatggca

SEQ ID NO: 313325 - DNA, 387 bp, Homo sapiens
ctagctggcggggcgtgcagctgagctgagccccctcagggttcttcgggttaagcttatcgtggagggttgaagtctggtcctcatccagctctgtccattctgagatgctgcctcctcttcagccgcccaccccaccccccatcttcacaccctagggctctgtgacctctgccccagcctggagaagcaactgctagtgttcccgggacacaagtgtgggagtctgcaacttgtggtgagccgtccagtggacaagggtgggtaggttggtggactggcttccttgtggactcttggccccttccctccataccaccccaacctcagactcctccctcctaccccaggacctggcgagcacaaagcctggcacctcgtctgctc

SEQ ID NO: 313326 - DNA, 368 bp, Homo sapiens
agtagggcctgatgtaaacacccgagccgggctccaaggcccgggaggtcagaaaaccgggccgcgggcggcaccgacagctggggcccgggtcagggacacgcggaggtcaggccggtgaaggcggcaggaagctggagcacgatcccagggttggttgggtctgggggaggctggaagtctttcgagtaggggtctaaggcagaggtcttgagtgggtgctggcgttggaaggagcatgcggctggtcttgggagaggggcgaggcatcccggacagagtcttggaatggaggtgcaaaaaaggggtgttgaaagttggagctgtccagagaataactctaaggcagagctgtccaaagaaagagc

SEQ ID NO: 313327 - DNA, 1621 bp, Homo sapiens
agcggggaagtagggcctgatgtaaacacccgagccgggctccaaggcccgggaggtcagaaaaccgggccgcgggcggcaccgacagctggggcccgggtcagggacacgcggaggtcaggccggtgaaggcggcaggaagctggagcacgatcccaggaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctggaccacgagcaggtgggcagcatgggcttggtggagatgctgcaccgctccaaccttctggccttggtgggcggtggtagtagtcccaagttctcagagatctcagtgctgatctgggacgatgcccgggagggcaaggactccaaggagaagctggtgctggagttcaccttcaccaagccagtgctttctgtgcgcatgcgccatgacaagatcgtgatcgtgctgaagaaccgcatctatgtgtactccttccccgacaatccccgaaagctgtttgagtttgatacccgggacaaccccaaggggctctgtgacctctgccccagcctggagaagcaactgctagtgttcccgggacacaagtgtgggagtctgcaacttgtggacctggcgagcacaaagcctggcacctcgtctgctccattcacgatcaatgcacatcagagtgacatagcctgtgtgtctctaaaccagccaggcactgtagtggcctcagcctcccagaagggtacccttattcgcctctttgacacacaatccaaggagaaactggtggagctgcgccgaggcactgaccctgccaccctctactgcattaacttcagccacgactcctccttcctctgcgcttccagtgataagggtactgtccatatctttgctctcaaggatacccgcctcaaccgccgctccgcgctggctcgcgtgggcaaggtggggcctatgattgggcagtacgtggactctcagtggagcctggcgagcttcactgtgcctgctgagtcagcttgcatctgcgccttcggtcgcaatacttccaagaacgtcaactctgtcattgccatctgcgtagatgggaccttccacaaatatgtcttcactcctgatggaaactgcaacagagaggctttcgacgtgtaccttgacatctgtgatgatgatgacttttaaggaccctgggggctgtgctagggacctgcagtggcagaactgcagagctgagccttggcagtggggcgtgcttggaagccaccagccagcaagcattaatggggctggtgcccactttccactcagcagagctatgtctaaataaagagctcacttccccccagcacttcttgatgactgtgtgccccaagggccaggccagagacccaggaaggcagcgaccccttgggatccctaacctggaggaaattgccagggacccagagggagtgccctaatccaacctggggattttttaaaagcttcctaggaagagatgatctccgatgtgatgaatacgaataaaaggcccttaatggca

SEQ ID NO: 313328 - DNA, 1170 bp, Homo sapiens
  misc_feature (1002)..(1002): n is a, c, g, or t
  misc_feature (1008)..(1010): n is a, c, g, or t
  misc_feature (1014)..(1014): n is a, c, g, or t
  misc_feature (1019)..(1019): n is a, c, g, or t
  misc_feature (1023)..(1024): n is a, c, g, or t
  misc_feature (1040)..(1040): n is a, c, g, or t
  misc_feature (1051)..(1051): n is a, c, g, or t
  misc_feature (1078)..(1078): n is a, c, g, or t
  misc_feature (1080)..(1080): n is a, c, g, or t
  misc_feature (1086)..(1086): n is a, c, g, or t
  misc_feature (1093)..(1094): n is a, c, g, or t
  misc_feature (1100)..(1100): n is a, c, g, or t
  misc_feature (1104)..(1104): n is a, c, g, or t
  misc_feature (1107)..(1107): n is a, c, g, or t
  misc_feature (1110)..(1110): n is a, c, g, or t
  misc_feature (1164)..(1164): n is a, c, g, or t
agcggggaagtagggcctgatgtaaacacccgagccgggctccaaggcccgggaggtcagaaaaccgggccgcgggcggcaccgacagctggggcccgggtcagggacacgcggaggtcaggccggtgaaggcggcaggaagctggagcacgatcccaggaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctggtgctgatctgggacgatgcccgggagggcaaggactccaaggagaagctggtgctggagttcaccttcaccaagccagtgctttctgtgcgcatgcgccatgacaagatcgtgatcgtgctgaagaaccgcatctatgtgtactccttccccgacaatccccgaaagctgtttgagtttgatacccgggacaaccccaaggggctctgtgacctctgccccagcctggagaagcaactgctagtgttcccgggacacaagtgtgggagtctgcaacttgtggacctggcgagcacaaagcctggcacctcgtctgctccattcacgatcaatgcacatcagagtgacatagcctgtgtgtctctaaaccagccaggcactgtagtggcctcagcctcccagaagggtacccttattcgcctctttgacacacaatccaaggagaaactggtggagctgcgccgaggcactgaccctgccaccctctactgcattaacttcagccacgactcctccttcctctgcgcttccagtgataagggtactgtccatatctttgctctcaaggatacccgcctcaaccgccgctccgcgctggctcgcgtgggcaaggtggggcctatgattgggcagtacgtggactctcagtggagcctggcgagcttcactgtgcctgctgagtcagcttgcatctcncttcgnnnatantccanacgnnactctgtattgcatcncgtgatggacntcacaatattttcactctgatgaactnanaaaagnttcgcgnntcttanactntanatntacttaagacctgggctgtcaggactcagtgaactcaactaccttgagtggggntgacac

SEQ ID NO: 313329 - DNA, 2038 bp, Homo sapiens
agcggggaagtagggcctgatgtaaacacccgagccgggctccaaggcccgggaggtcagaaaaccgggccgcgggcggcaccgacagctggggcccgggtcagggacacgcggaggtcaggccggtgaaggcggcaggaagctggagcacgatcccaggaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctggaccacgagcaggtgggcagcatgggcttggtggagatgctgcaccgctccaaccttctggccttggtgggcggtggtagtagtcccaagttctcagagatctcagtgctgatctgggacgatgcccgggagggcaaggactccaaggagaagctggtgctggagttcaccttcaccaagccagtgctttctgtgcgcatgcgccatgacaagatcgtgatcgtgctgaagaaccgcatctatgtgtactccttccccgacaatccccgaaagctgtttgagtttgatacccgggacaaccccaaggggctctgtgacctctgccccagcctggagaagcaactgctagtgttcccgggacacaagtgtgggagtctgcaacttgtggacctggcgagcacaaagcctggcacctcgtctgctccattcacgatcaatgcacatcagagtgacatagcctgtgtgtctctaaaccagccaggcactgtagtggcctcagcctcccagaagggtacccttattcgcctctttgacacacaatccaaggagaaactggtggagctgcgccgaggcactgaccctgccaccctctactgcattaacttcagccacgactcctccttcctctgcgcttccagtgataagggtactgtccatatctttgctctcaaggatacccgcctcaaccgccgctccgcgctggctcgcgtgggcaaggtggggcctatgattgggcagtacgtggactctcagtggagcctggcgagcttcactgtgcctgctgagtcagcttgcatctgcgccttcggtcgcaatacttccaagaacgtcaactctgtcattgccatctgcgtagatgggaccttccacaaatatgtcttcactcctgatggaaactgcaacagagaggctttcgacgtgtaccttgacatctgtgatgatgatgacttttaaggaccctgggggctgtgctagggacctgcagtggcagaactgcagagctgagccttggcagtggggcgtgcttggaagccaccagccagcaagcattaatggggctggtgcccactttccactcagcagagctatgtctaaataaagagctcacttccccccagcacttcttgatgactgtgtgccccaagggccaggccagagacccaggaaggcagcgaccccttgggatccctaacctggaggaaattgccagggacccagagggagtgccctaatccaacctggggattttttaaaagcttcctaggaagagatgatctccgatgtgatgaatacgaataaaaggcccttaatggcaaaaaaaaaaacaaacaacacacaaaaagaaacaaaaaacaaacacacaaacaaaaaaaacacaacaaaaaacaaccaaaacccaacaagaccaacaatcacaccaacactagacaaacacacaacaacacaacaaacacaacccacacaacactacagcgaggcggagcgtcgcgccgtacacacgccacaagtaaatacctccgttcgcagagaggccgccccccaccgttatttggcacgcacagcgtcaccacactaagatctaaagtactcgcagacgcacgcagccagtcccctcataatgtagtggtctaacaattatataaactacagcctcagagatagagggcggctgagcctcagatatacaaaaaataccaagtaataagtgggaagagaaaaatccctctgtaca

SEQ ID NO: 313330 - DNA, 3216 bp, Homo sapiens
ctgggctccgggaaagtcgtgcttttacggttccgggtactggctcccacaccactgcctcgtgtggggttgttcgcccgtgaaggggcaggacagggtgcgcgctggtggaggttagtgaggtcacacaccgggccgtggcgcctggtgcgctgggcgcttccacctcaaccttcgtagcaaacccagcggggttctgtgcctgcgcaccgtggttcctgcgttcatttactgtcccgtttctcactccggaaagtgtggctttgagtttgatctgcaggagtaggacgggcacagcgggtgtctggtcttcctcgcaccataaatcgcagagcgagccctctgtggtctctggatacagtataccaaagttagattaactgtactccttctcacaagccggtccaacgtttgcagcagtgaaaaagccctaagtgtcagggcctttggcgaagcctgtgtaagggaataaacactttccccagttttccaggcgcaaactgatggttttggagcattcaaggtctggtcggatggggcaggatggctgcgttgacacgtcttatttaatccacatcataggtctccaggtccgcccccgcctgtaacccccagcgccgcccctctggaagcctgggaggactgtgtgttgcgaaccggtgcggctactctcggccgccgcggaggtccgcgtcttgttagcagggaaggtttactcccccattgtgggtgaccaaggggctgagggcttggccggtttcgctttgctgggggcaaggcacgctctctctccccacccttccgggttccctcagacagtctcggccttgaggaacccccttcgcctccggtcccccagccaaccttcctccgctccccgcgccctccccggagaaccccactgtcactcgcgatgctccgaagacccgggaactaggcgaggaaggcggtggccgcctttttccagctgggaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctgggtgagctgttggcaggggaggggcaatgggcagaagagctgggctgggcattggctcccacctccactgacaccctggtccctgtccagaccacgagcaggtgggcagcatgggcttggtggagatgctgcaccgctccaaccttctggccttggtgggcggtggtagtagtcccaagttctcagagatctcaggtaagtgccctcatcctgccctttggcccagatttctcggattcctggcctcccacaggcaccccaaggtactggcagatgaagacgtcagagtacttcagagtcacacagagaggaggcctacagcttggaagtcatggatcttatagcttgagaagcttggtgctttgttttcattttaaaaattctgattgagtgcctcctgtgtgccatgccctagagcacttactgtgagcctggaactgccctaagcactttacgtttattaactcatttaatcctcacagtaactctatggggtaggaaggatcattatccccatctttaccgatgaggaaactgaggcccagtgcagttaagtgactcatccaaggtcacacaagcaataggttttaaaatcttggagccgtcttcccaatacccccttggcttgagcctcaagtgccatcttactttaagggtttttcttgatgatcccatctggacaaggcaggagttgccctaggtgagtcacagagccctaggattcctcacggaaatctccagggtgcatggactaggaccctggaggcagaaatagttaccgaggggaagttacaggcctgagtgtgagtccctgtttggttgctgatgagctttgaggtccttggccagacactcaaccactttgaacctcagtttcctcatctgtagatgagtgtaacagtctagaacactcctctcagggatcatatccacaagtgctcgtgctgtgcgaggatctcactggttgtttattgaaaggctaagcaagtaggttgaggtccctgggaagcaggggtggatcctgtgtcaccagggctgccccttaccctaaaccttggccccgacaacccacccacctgcccagctgctgatctgggacgatgcccgggagggcaaggactccaaggagaagctggtgctggagttcaccttcaccaagccagtgctttctgtgcgcatgcgccatgacaagatcgtgatcgtgctgaagaaccgcatctatgtgtactccttccccgacaatccccgaaagctgtttgagtttgatacccgggacaaccccaaggggctctgtgacctctgccccagcctggagaagcaactgctagtgttcccgggacacaagtgtgggagtctgcaacttgtggacctggcgagcacaaagcctggcacctcgtctgctccattcacgatcaatgcacatcagagtgacatagcctgtgtgtctctaaaccagccaggcactgtagtggcctcagcctcccagaagggtacccttattcgcctctttgacacacaatccaaggagaaactggtggagctgcgccgaggcactgaccctgccaccctctactgcattaacttcagccacgactcctccttcctctgcgcttccagtgataagggtactgtccatatctttgctctcaaggatacccgcctcaaccgccgctccgcgctggctcgcgtgggcaaggtggggcctatgattgggcagtacgtggactctcagtggagcctggcgagcttcactgtgcctgctgagtcagcttgcatctgcgccttcggtcgcaatacttccaagaacgtcaactctgtcattgccatctgcgtagatgggaccttccacaaatatgtcttcactcctgatggaaactgcaacagagaggctttcgacgtgtaccttgacatctgtgatgatgatgacttttaaggaccctgggggctgtgctagggacctgcagtggcagaactgcagagctgagccttggcagtggggcgtgcttggaagccaccagccagcaagcattaatggggctggtgcccactttccactcagcagagctatgtctaaataaagagctcacttccccccagc

SEQ ID NO: 313331 - DNA, 3127 bp, Homo sapiens
ctgggctccgggaaagtcgtgcttttacggttccgggtactggctcccacaccactgcctcgtgtggggttgttcgcccgtgaaggggcaggacagggtgcgcgctggtggaggttagtgaggtcacacaccgggccgtggcgcctggtgcgctgggcgcttccacctcaaccttcgtagcaaacccagcggggttctgtgcctgcgcaccgtggttcctgcgttcatttactgtcccgtttctcactccggaaagtgtggctttgagtttgatctgcaggagtaggacgggcacagcgggtgtctggtcttcctcgcaccataaatcgcagagcgagccctctgtggtctctggatacagtataccaaagttagattaactgtactccttctcacaagccggtccaacgtttgcagcagtgaaaaagccctaagtgtcagggcctttggcgaagcctgtgtaagggaataaacactttccccagttttccaggcgcaaactgatggttttggagcattcaaggtctggtcggatggggcaggatggctgcgttgacacgtcttatttaatccacatcataggtctccaggtccgcccccgcctgtaacccccagcgccgcccctctggaagcctgggaggactgtgtgttgcgaaccggtgcggctactctcggccgccgcggaggtccgcgtcttgttagcagggaaggtttactcccccattgtgggtgaccaaggggctgagggcttggccggtttcgctttgctgggggcaaggcacgctctctctccccacccttccgggttccctcagacagtctcggccttgaggaacccccttcgcctccggtcccccagccaaccttcctccgctccccgcgccctccccggagaaccccactgtcactcgcgatgctccgaagacccgggaactaggcgaggaaggcggtggccgcctttttccagctgggaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctggaccacgagcaggtgggcagcatgggcttggtggagatgctgcaccgctccaaccttctggccttggtgggcggtggtagtagtcccaagttctcagagatctcaggtaagtgccctcatcctgccctttggcccagatttctcggattcctggcctcccacaggcaccccaaggtactggcagatgaagacgtcagagtacttcagagtcacacagagaggaggcctacagcttggaagtcatggatcttatagcttgagaagcttggtgctttgttttcattttaaaaattctgattgagtgcctcctgtgtgccatgccctagagcacttactgtgagcctggaactgccctaagcactttacgtttattaactcatttaatcctcacagtaactctatggggtaggaaggatcattatccccatctttaccgatgaggaaactgaggcccagtgcagttaagtgactcatccaaggtcacacaagcaataggttttaaaatcttggagccgtcttcccaatacccccttggcttgagcctcaagtgccatcttactttaagggtttttcttgatgatcccatctggacaaggcaggagttgccctaggtgagtcacagagccctaggattcctcacggaaatctccagggtgcatggactaggaccctggaggcagaaatagttaccgaggggaagttacaggcctgagtgtgagtccctgtttggttgctgatgagctttgaggtccttggccagacactcaaccactttgaacctcagtttcctcatctgtagatgagtgtaacagtctagaacactcctctcagggatcatatccacaagtgctcgtgctgtgcgaggatctcactggttgtttattgaaaggctaagcaagtaggttgaggtccctgggaagcaggggtggatcctgtgtcaccagggctgccccttaccctaaaccttggccccgacaacccacccacctgcccagctgctgatctgggacgatgcccgggagggcaaggactccaaggagaagctggtgctggagttcaccttcaccaagccagtgctttctgtgcgcatgcgccatgacaagatcgtgatcgtgctgaagaaccgcatctatgtgtactccttccccgacaatccccgaaagctgtttgagtttgatacccgggacaaccccaaggggctctgtgacctctgccccagcctggagaagcaactgctagtgttcccgggacacaagtgtgggagtctgcaacttgtggacctggcgagcacaaagcctggcacctcgtctgctccattcacgatcaatgcacatcagagtgacatagcctgtgtgtctctaaaccagccaggcactgtagtggcctcagcctcccagaagggtacccttattcgcctctttgacacacaatccaaggagaaactggtggagctgcgccgaggcactgaccctgccaccctctactgcattaacttcagccacgactcctccttcctctgcgcttccagtgataagggtactgtccatatctttgctctcaaggatacccgcctcaaccgccgctccgcgctggctcgcgtgggcaaggtggggcctatgattgggcagtacgtggactctcagtggagcctggcgagcttcactgtgcctgctgagtcagcttgcatctgcgccttcggtcgcaatacttccaagaacgtcaactctgtcattgccatctgcgtagatgggaccttccacaaatatgtcttcactcctgatggaaactgcaacagagaggctttcgacgtgtaccttgacatctgtgatgatgatgacttttaaggaccctgggggctgtgctagggacctgcagtggcagaactgcagagctgagccttggcagtggggcgtgcttggaagccaccagccagcaagcattaatggggctggtgcccactttccactcagcagagctatgtctaaataaagagctcacttccccccagc

SEQ ID NO: 313332 - DNA, 1471 bp, Homo sapiens
agcggggaagtagggcctgatgtaaacacccgagccgggctccaaggcccgggaggtcagaaaaccgggccgcgggcggcaccgacagctggggcccgggtcagggacacgcggaggtcaggccggtgaaggcggcaggaagctggagcacgatcccaggaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctggaccacgagcaggtgggcagcatgggcttggtggagatgctgcaccgctccaaccttctggccttggtgggcggtggtagtagtcccaagttctcagagatctcagtgctgatctgggacgatgcccgggagggcaaggactccaaggagaagctggtgctggagttcaccttcaccaagccagtgctttctgtgcgcatgcgccatgacaagatcgtgatcgtgctgaagaaccgcatctatgtgtactccttccccgacaatccccgaaagctgtttgagtttgatacccgggacaaccccaaggggctctgtgacctctgccccagcctggagaagcaactgctagtgttcccgggacacaagtgtgggagtctgcaacttgtggacctggcgagcacaaagcctggcacctcgtctgctccattcacgatcaatgcacatcagagtgacatagcctgtgtgtctctaaaccagccaggcactgtagtggcctcagcctcccagaagggtacccttattcgcctctttgacacacaatccaaggagaaactggtggagctgcgccgaggcactgaccctgccaccctctactgcattaacttcagccacgactcctccttcctctgcgcttccagtgataagggtactgtccatatctttgctctcaaggatacccgcctcaaccgccgctccgcgctggctcgcgtgggcaaggtggggcctatgattgggcagtacgtggactctcagtggagcctggcgagcttcactgtgcctgctgagtcagcttgcatctgcgccttcggtcgcaatacttccaagaacgtcaactctgtcattgtgcagagctgagccttggcagtggggcgtgcttggaagccaccagccagcaagcattaatggggctggtgcccactttccactcagcagagctatgtctaaataaagagctcacttccccccagcacttcttgatgactgtgtgccccaagggccaggccagagacccaggaaggcagcgaccccttgggatccctaacctggaggaaattgccagggacccagagggagtgccctaatccaacctggggattttttaaaagcttcctaggaagagatgatctccgatgtgatgaatacgaataaaaggcccttaatggca

SEQ ID NO: 313333 - DNA, 1458 bp, Homo sapiens
agcggggaagtagggcctgatgtaaacacccgagccgggctccaaggcccgggaggtcagaaaaccgggccgcgggcggcaccgacagctggggcccgggtcagggacacgcggaggtcaggccggtgaaggcggcaggaagctggagcacgatcccaggaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctggaccacgagcaggtgggcagcatgggcttggtggagatgctgcaccgctccaaccttctggccttggtgggcggtggtagtagtcccaagttctcagagatctcagtgctgatctgggacgatgcccgggagggcaaggactccaaggagaagctggtgctggagttcaccttcaccaagccagtgctttctgtgcgcatgcgccatgacaagatcgtgatcgtgctgaagaaccgcatctatgtgtactccttccccgacaatccccgaaagctgtttgagtttgatacccgggacaaccccaaggccgcccaccccaccccccatcttcacaccctagggctctgtgacctctgccccagcctggagaagcaactgctagtgttcccgggacacaagtgtgggagtctgcaacttgtggacctggcgagcacaaagcctggcacctcgtctgctccattcacgatcaatgcacatcagagtgacatagcctgtgtgtctctaaaccagccaggcactgtagtggcctcagcctcccagaagggtacccttattcgcctctttgacacacaatccaaggagaaactggtggagctgcgccgaggcactgaccctgccaccctctactgcattaacttcagccacgactcctccttcctctgcgcttccagtgataagggtactgtccatatctttgctctcaaggatacccgcctcaaccgccgctccgcgctggctcgcgtgggcaaggtggggcctatgattgggcagtacgtggactctcagtggagcctggcgagcttcactgtgcctgctgagtcagcttgcatctgcgccttcggtcgcaatacttccaagaacgtcaactctgtcattgccatctgcgtagatgggaccttccacaaatatgtcttcactcctgatggaaactgcaacagagaggctttcgacgtgtaccttgacatctgtgatgatgatgacttttaaggaccctgggggctgtgctagggacctgcagtggcagaactgcagagctgagccttggcagtggggcgtgcttggaagccaccagccagcaagcattaatggggctggtgcccactttccactcagcagagctatgtctaaataaagagctcacttccccccagc

SEQ ID NO: 313334 - DNA, 1888 bp, Homo sapiens
agcggggaagtagggcctgatgtaaacacccgagccgggctccaaggcccgggaggtcagaaaaccgggccgcgggcggcaccgacagctggggcccgggtcagggacacgcggaggtcaggccggtgaaggcggcaggaagctggagcacgatcccaggaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctggaccacgagcaggtgggcagcatgggcttggtggagatgctgcaccgctccaaccttctggccttggtgggcggtggtagtagtcccaagttctcagagatctcagtgctgatctgggacgatgcccgggagggcaaggactccaaggagaagctggtgctggagttcaccttcaccaagccagtgctttctgtgcgcatgcgccatgacaagatcgtgatcgtgctgaagaaccgcatctatgtgtactccttccccgacaatccccgaaagctgtttgagtttgatacccgggacaaccccaaggggctctgtgacctctgccccagcctggagaagcaactgctagtgttcccgggacacaagtgtgggagtctgcaacttgtggacctggcgagcacaaagcctggcacctcgtctgctccattcacgatcaatgcacatcagagtgacatagcctgtgtgtctctaaaccagccaggcactgtagtggcctcagcctcccagaagggtacccttattcgcctctttgacacacaatccaaggagaaactggtggagctgcgccgaggcactgaccctgccaccctctactgcattaacttcagccacgactcctccttcctctgcgcttccagtgataagggtactgtccatatctttgctctcaaggatacccgcctcaaccgccgctccgcgctggctcgcgtgggcaaggtggggcctatgattgggcagtacgtggactctcagtggagcctggcgagcttcactgtgcctgctgagtcagcttgcatctgcgccttcggtcgcaatacttccaagaacgtcaactctgtcattgtgcagagctgagccttggcagtggggcgtgcttggaagccaccagccagcaagcattaatggggctggtgcccactttccactcagcagagctatgtctaaataaagagctcacttccccccagcacttcttgatgactgtgtgccccaagggccaggccagagacccaggaaggcagcgaccccttgggatccctaacctggaggaaattgccagggacccagagggagtgccctaatccaacctggggattttttaaaagcttcctaggaagagatgatctccgatgtgatgaatacgaataaaaggcccttaatggcaaaaaaaaaaacaaacaacacacaaaaagaaacaaaaaacaaacacacaaacaaaaaaaacacaacaaaaaacaaccaaaacccaacaagaccaacaatcacaccaacactagacaaacacacaacaacacaacaaacacaacccacacaacactacagcgaggcggagcgtcgcgccgtacacacgccacaagtaaatacctccgttcgcagagaggccgccccccaccgttatttggcacgcacagcgtcaccacactaagatctaaagtactcgcagacgcacgcagccagtcccctcataatgtagtggtctaacaattatataaactacagcctcagagatagagggcggctgagcctcagatatacaaaaaataccaagtaataagtgggaagagaaaaatccctctgtaca

SEQ ID NO: 313335 - DNA, 2684 bp, Homo sapiens
agcggggaagtagggcctgatgtaaacacccgagccgggctccaaggcccgggaggtcagaaaaccgggccgcgggcggcaccgacagctggggcccgggtcagggacacgcggaggtcaggccggtgaaggcggcaggaagctggagcacgatcccaggaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctgggtgagctgttggcaggggaggggcaatgggcagaagagctgggctgggcattggctcccacctccactgacaccctggtccctgtccagaccacgagcaggtgggcagcatgggcttggtggagatgctgcaccgctccaaccttctggccttggtgggcggtggtagtagtcccaagttctcagagatctcaggtaagtgccctcatcctgccctttggcccagatttctcggattcctggcctcccacaggcaccccaaggtactggcagatgaagacgtcagagtacttcagagtcacacagagaggaggcctacagcttggaagtcatggatcttatagcttgagaagcttggtgctttgttttcattttaaaaattctgattgagtgcctcctgtgtgccatgccctagagcacttactgtgagcctggaactgccctaagcactttacgtttattaactcatttaatcctcacagtaactctatggggtaggaaggatcattatccccatctttaccgatgaggaaactgaggcccagtgcagttaagtgactcatccaaggtcacacaagcaataggttttaaaatcttggagccgtcttcccaatacccccttggcttgagcctcaagtgccatcttactttaagggtttttcttgatgatcccatctggacaaggcaggagttgccctaggtgagtcacagagccctaggattcctcacggaaatctccagggtgcatggactaggaccctggaggcagaaatagttaccgaggggaagttacaggcctgagtgtgagtccctgtttggttgctgatgagctttgaggtccttggccagacactcaaccactttgaacctcagtttcctcatctgtagatgagtgtaacagtctagaacactcctctcagggatcatatccacaagtgctcgtgctgtgcgaggatctcactggttgtttattgaaaggctaagcaagtaggttgaggtccctgggaagcaggggtggatcctgtgtcaccagggctgccccttaccctaaaccttggccccgacaacccacccacctgcccagctgctgatctgggacgatgcccgggagggcaaggactccaaggagaagctggtgctggagttcaccttcaccaagccagtgctttctgtgcgcatgcgccatgacaagatcgtgatcgtgctgaagaaccgcatctatgtgtactccttccccgacaatccccgaaagctgtttgagtttgatacccgggacaaccccaaggggctctgtgacctctgccccagcctggagaagcaactgctagtgttcccgggacacaagtgtgggagtctgcaacttgtggacctggcgagcacaaagcctggcacctcgtctgctccattcacgatcaatgcacatcagagtgacatagcctgtgtgtctctaaaccagccaggcactgtagtggcctcagcctcccagaagggtacccttattcgcctctttgacacacaatccaaggagaaactggtggagctgcgccgaggcactgaccctgccaccctctactgcattaacttcagccacgactcctccttcctctgcgcttccagtgataagggtactgtccatatctttgctctcaaggatacccgcctcaaccgccgctccgcgcgtgagtaccccctccccaccctaccgtgtccctgtccccctgcccatttaccatacctgggcttagccagtgctgcctgcaggctggctcgcgtgggcaaggtggggcctatgattgggcagtacgtggactctcagtggagcctggcgagcttcactgtgcctgctgagtcagcttgcatctgcgccttcggtcgcaatacttccaagaacgtcaactctgtcattgccatctgcgtagatgggaccttccacaaatatgtcttcactcctgatggaaactgcaacagagaggctttcgacgtgtaccttgacatctgtgatgatgatgacttttaaggaccctgggggctgtgctagggacctgcagtggcagaactgcagagctgagccttggcagtggggcgtgcttggaagccaccagccagcaagcattaatggggctggtgcccactttccactcagcagagctatgtctaaataaagagctcacttccccccagcacttcttgatgactgtgtgccccaagggccaggccagagacccaggaaggcagcgaccccttgggatccctaacctggaggaaattgccagggacccagagggagtgccctaatccaacctggggattttttaaaagcttcctaggaagagatgatctccgatgtgatgaatacgaataaaaggcccttaatggca

SEQ ID NO: 313336 - DNA, 2566 bp, Homo sapiens
agcggggaagtagggcctgatgtaaacacccgagccgggctccaaggcccgggaggtcagaaaaccgggccgcgggcggcaccgacagctggggcccgggtcagggacacgcggaggtcaggccggtgaaggcggcaggaagctggagcacgatcccaggaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctgggtgagctgttggcaggggaggggcaatgggcagaagagctgggctgggcattggctcccacctccactgacaccctggtccctgtccagaccacgagcaggtgggcagcatgggcttggtggagatgctgcaccgctccaaccttctggccttggtgggcggtggtagtagtcccaagttctcagagatctcaggtaagtgccctcatcctgccctttggcccagatttctcggattcctggcctcccacaggcaccccaaggtactggcagatgaagacgtcagagtacttcagagtcacacagagaggaggcctacagcttggaagtcatggatcttatagcttgagaagcttggtgctttgttttcattttaaaaattctgattgagtgcctcctgtgtgccatgccctagagcacttactgtgagcctggaactgccctaagcactttacgtttattaactcatttaatcctcacagtaactctatggggtaggaaggatcattatccccatctttaccgatgaggaaactgaggcccagtgcagttaagtgactcatccaaggtcacacaagcaataggttttaaaatcttggagccgtcttcccaatacccccttggcttgagcctcaagtgccatcttactttaagggtttttcttgatgatcccatctggacaaggcaggagttgccctaggtgagtcacagagccctaggattcctcacggaaatctccagggtgcatggactaggaccctggaggcagaaatagttaccgaggggaagttacaggcctgagtgtgagtccctgtttggttgctgatgagctttgaggtccttggccagacactcaaccactttgaacctcagtttcctcatctgtagatgagtgtaacagtctagaacactcctctcagggatcatatccacaagtgctcgtgctgtgcgaggatctcactggttgtttattgaaaggctaagcaagtaggttgaggtccctgggaagcaggggtggatcctgtgtcaccagggctgccccttaccctaaaccttggccccgacaacccacccacctgcccagctgctgatctgggacgatgcccgggagggcaaggactccaaggagaagctggtgctggagttcaccttcaccaagccagtgctttctgtgcgcatgcgccatgacaagatcgtgatcgtgctgaagaaccgcatctatgtgtactccttccccgacaatccccgaaagctgtttgagtttgatacccgggacaaccccaaggggctctgtgacctctgccccagcctggagaagcaactgctagtgttcccgggacacaagtgtgggagtctgcaacttgtggtgagccgtccagtggacaagggtgggtaggttggtggactggcttccttgtggactcttggccccttccctccataccaccccaacctcagactcctccctcctaccccaggacctggcgagcacaaagcctggcacctcgtctgctccattcacgatcaatgcacatcagagtgacatagcctgtgtgtctctaaaccagccaggcactgtagtggcctcagcctcccagaagggtacccttattcgcctctttgacacacaatccaaggagaaactggtggagctgcgccgaggcactgaccctgccaccctctactgcattaacttcagccacgactcctccttcctctgcgcttccagtgataagggtactgtccatatctttgctctcaaggatacccgcctcaaccgccgctccgcccatctgcgtagatgggaccttccacaaatatgtcttcactcctgatggaaactgcaacagagaggctttcgacgtgtaccttgacatctgtgatgatgatgacttttaaggaccctgggggctgtgctagggacctgcagtggcagaactgcagagctgagccttggcagtggggcgtgcttggaagccaccagccagcaagcattaatggggctggtgcccactttccactcagcagagctatgtctaaataaagagctcacttccccccagcacttcttgatgactgtgtgccccaagggccaggccagagacccaggaaggcagcgaccccttgggatccctaacctggaggaaattgccagggacccagagggagtgccctaatccaacctggggattttttaaaagcttcctaggaagagatgatctccgatgtgatgaatacgaataaaaggcccttaatggca

SEQ ID NO: 313337 - DNA, 1638 bp, Homo sapiens
agcggggaagtagggcctgatgtaaacacccgagccgggctccaaggcccgggaggtcagaaaaccgggccgcgggcggcaccgacagctggggcccgggtcagggacacgcggaggtcaggccggtgaaggcggcaggaagctggagcacgatcccaggaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctgggtgagctgttggcaggggaggggcaatgggcagaagagctgggctgggcattggctcccacctccactgacaccctggtccctgtccagaccacgagcaggtgggcagcatgggcttggtggagatgctgcaccgctccaaccttctggccttggtgggcggtggtagtagtcccaagttctcagagatctcaggtaagtgccctcatcctgccctttggcccagatttctcggattcctggcctcccacaggcaccccaaggtactggcagatgaagacgtcagagtacttcagagtcacacagagaggaggcctacagcttggaagtcatggatcttatagcttgagaagcttggtgctttgttttcattttaaaaattctgattgagtgcctcctgtgtgccatgccctagagcacttactgtgagcctggaactgccctaagcactttacgtttattaactcatttaatcctcacagtaactctatggggtaggaaggatcattatccccatctttaccgatgaggaaactgaggcccagtgcagttaagtgactcatccaaggtcacacaagcaataggttttaaaatcttggagccgtcttcccaatacccccttggcttgagcctcaagtgccatcttactttaagggtttttcttgatgatcccatctggacaaggcaggagttgccctaggtgagtcacagagccctaggattcctcacggaaatctccagggtgcatggactaggaccctggaggcagaaatagttaccgaggggaagttacaggcctgagtgtgagtccctgtttggttgctgatgagctttgaggtccttggccagacactcaaccactttgaacctcagtttcctcatctgtagatgagtgtaacagtctagaacactcctctcagggatcatatccacaagtgctcgtgctgtgcgaggatctcactggttgtttattgaaaggctaagcaagtaggttgaggtccctgggaagcaggggtggatcctgtgtcaccagggctgccccttaccctaaaccttggccccgacaacccacccacctgcccagctgctgatctgggacgatgcccgggagggcaaggactccaaggagaagctggtgctggagttcaccttcaccaagccagtgctttctgtgcgcatgcgccatgacaagatcgtgatcgtgctgaagaaccgcatctatgtgtactccttccccgacaatccccgaaagctgtttgagtttgatacccgggacaaccccaaggctctgtgacctcgtcctgcctgagatgggatcctctagatcgcctc

SEQ ID NO: 313338 - DNA, 3456 bp, Homo sapiens
gaattcggcacgagttcccgagcctgggagcaacctcagcttctagtatccagactccagcgccgccccgggcgcggaccccaaccccgacccagagcttctccagcggcggcgcagcgagcagggctccccgccttaacttcctccgcggggcccagccaccttcgggagtccgggttgcccacctgcaaactctccgccttctgcacctgccacccctgagccagcgcgggcgcccgagcgagtcatggccaacgcggggctgcagctgttgggcttcattctcgccttcctgggatggatcggcgccatcgtcagcactgccctgccccagtggaggatttactcctatgccggcgacaacatcgtgaccgcccaggccatgtacgaggggctgtggatgtcctgcgtgtcgcagagcaccgggcagatccagtgcaaagtctttgactccttgctgaatctgagcagcacattgcaagcaacccgtgccttgatggtggttggcatcctcctgggagtgatagcaatctttgtggccaccgttggcatgaagtgtatgaagtgcttggaagacgatgaggtgcagaagatgaggatggctgtcattgggggcgcgatatttcttcttgcaggtctggctattttagttgccacagcatggtatggcaatagaatcgttcaagaattctatgaccctatgaccccagtcaatgccaggtacgaatttggtcaggctctcttcactggctgggctgctgcttctctctgccttctgggaggtgccctactttgctgttcctgtccccgaaaaacaacctcttacccaacaccaaggccctatccaaaacctgcaccttccagcgggaaagactacgtgtgacacagaggcaaaaggagaaaatcatgttgaaacaaaccgaaaatggacattgagatactatcattaacattaggaccttagaattttgggtattgtaatctgaagtatggtattacaaaacaaacaaacaaacaaaaaacccatgtgttaaaatactcagtgctaaacatggcttaatcttattttatcttctttcctcaatataggagggaagatttttccatttgtattactgcttcccattgagtaatcatactcaaatgggggaaggggtgctccttaaatatatatagatatgtatatatacatgtttttctattaaaaatagacagtaaaatactattctcattatgttgatactagcatacttaaaatatctctaaaataggtaaatgtatttaattccatattgatgaagatgtttattggtatattttctttttcgtccttatatacatatgtaacagtcaaatatcatttactcttcttcattagctttgggtgcctttgccacaagacctagcctaatttaccaaggatgaattctttcaattcttcatgcgtgcccttttcatatacttattttattttttaccataatcttatagcacttgcatcgttattaagcccttatttgttttgtgtttcattggtctctatctcctgaatctaacacatttcatagcctacattttagtttctaaagccaagaagaatttattacaaatcagaactttggaggcaaatctttctgcatgaccaaagtgataaattcctgttgaccttcccacacaatccctgtactctgacccatagcactcttgtttgctttgaaaatatttgtccaattgagtagctgcatgctgttcccccaggtgttgtaacacaactttattgattgaatttttaagctacttattcatagttttatatccccctaaactacctttttgttccccattccttaattgtattgttttcccaagtgtaattatcatgcgttttatatcttcctaataaggtgtggtctgtttgtctgaacaaagtgctagactttctggagtgataatctggtgacaaatattctctctgtagctgtaagcaagtcacttaatctttctacctcttttttctatctgccaaattgagataatgatacttaaccagttagaagaggtagtgtgaatattaattagtttatattactctcattctttgaacatgaactatgcctatgtagtgtctttatttgctcagctggctgagacactgaagaagtcactgaacaaaacctacacacgtaccttcatgtgattcactgccttcctctctctaccagtctatttccactgaacaaaacctacacacataccttcatgtggttcagtgccttcctctctctaccagtctatttccactgaacaaaacctacgcacataccttcatgtggctcagtgccttcctctctctaccagtctatttccattctttcagctgtgtctgacatgtttgtgctctgttccattttaacaactgctcttacttttccagtctgtacagaatgctatttcacttgagcaagatgatgtaatggaaagggtgttggcactggtgtctggagacctggatttgagtcttggtgctatcaatcaccgtctgtgtttgagcaaggcatttggctgctgtaagcttattgcttcatctgtaagcggtggtttgtaattcctgatcttcccacctcacagtgatgttgtggggatccagtgagatagaatacatgtaagtgtggttttgtaatttaaaaagtgctatactaagggaaagaattgaggaattaactgcatacgttttggtgttgcttttcaaatgtttgaaaataaaaaaaatgttaagaaatgggtttcttgccttaaccagtctctcaagtgatgagacagtgaagtaaaattgagtgcactaaacgaataagattctgaggaagtcttatcttctgcagtgagtatggcccaatgctttctgtggctaaacagatgtaatgggaagaaataaaagcctacgtgttggtaaatccaacagcaagggagatttttgaatcataataactcataaggtgctatctgttcagtgatgccctcagagctcttgctgttagctggcagctgacgctgctaggatagttagtttggaaatggtacttcataataaactacacaaggaaagtcagccaccgtgtcttatgaggaattggacctaataaattttagtgtgccttccaaacctgagaatatatgcttttggaagttaaaatttaaatggcttttgccacatacatagatcttcatgatgtgtgagtgtaattccatgtggatatcagttaccaaacattacaaaaaaattttatggcccaaaatgaccaacgaaattgttacaatagaatttatccaattttgatctttttatattcttctaccacacctggaaacagaccaatagacattttggggttttataatgggaatttgtataaagcattactctttttcaataaattgttttttaatttaaaaaaagga

SEQ ID NO: 313339 - DNA, 268 bp, Homo sapiens
gcggccgcctactactactactgctcgaattcaagcttctaacgatgtacggggacatgtggatatcagttaccaaacattacaaaaaaattttatggcccaaaatgaccaacgaaattgttacaatagaatttatccaattttgatctttttatattcttctaccacacctggaaacagaccaatagacattttggggttttataatgggaatttgtataaagcattactctttttcaataaattgttttttaatttaaaaaaagga

SEQ ID NO: 313340 - DNA, 3163 bp, Homo sapiens
tctggagaagatactgtatattgggttaccagcggaaacatcagtatgactggggtctctagattcctagtccagttttctctcttccatacaacagtgacatatacttggtcttcttccatttttctcttgttggtccaagcatatttttacatgttttaaaatgttttctgccaggcacattgcaagcaacccgtgccttgatggtggttggcatcctcctgggagtgatagcaatctttgtggccaccgttggcatgaagtgtatgaagtgcttggaagacgatgaggtgcagaagatgaggatggctgtcattgggggcgcgatatttcttcttgcaggtctggctattttagttgccacagcatggtatggcaatagaatcgttcaagaattctatgaccctatgaccccagtcaatgccaggtacgaatttggtcaggctctcttcactggctgggctgctgcttctctctgccttctgggaggtgccctactttgctgttcctgtccccgaaaaacaacctcttacccaacaccaaggccctatccaaaacctgcaccttccagcgggaaagactacgtgtgacacagaggcaaaaggagaaaatcatgttgaaacaaaccgaaaatggacattgagatactatcattaacattaggaccttagaattttgggtattgtaatctgaagtatggtattacaaaacaaacaaacaaacaaaaaacccatgtgttaaaatactcagtgctaaacatggcttaatcttattttatcttctttcctcaatataggagggaagatttttccatttgtattactgcttcccattgagtaatcatactcaaatgggggaaggggtgctccttaaatatatatagatatgtatatatacatgtttttctattaaaaatagacagtaaaatactattctcattatgttgatactagcatacttaaaatatctctaaaataggtaaatgtatttaattccatattgatgaagatgtttattggtatattttctttttcgtccttatatacatatgtaacagtcaaatatcatttactcttcttcattagctttgggtgcctttgccacaagacctagcctaatttaccaaggatgaattctttcaattcttcatgcgtgcccttttcatatacttattttattttttaccataatcttatagcacttgcatcgttattaagcccttatttgttttgtgtttcattggtctctatctcctgaatctaacacatttcatagcctacattttagtttctaaagccaagaagaatttattacaaatcagaactttggaggcaaatctttctgcatgaccaaagtgataaattcctgttgaccttcccacacaatccctgtactctgacccatagcactcttgtttgctttgaaaatatttgtccaattgagtagctgcatgctgttcccccaggtgttgtaacacaactttattgattgaatttttaagctacttattcatagttttatatccccctaaactacctttttgttccccattccttaattgtattgttttcccaagtgtaattatcatgcgttttatatcttcctaataaggtgtggtctgtttgtctgaacaaagtgctagactttctggagtgataatctggtgacaaatattctctctgtagctgtaagcaagtcacttaatctttctacctcttttttctatctgccaaattgagataatgatacttaaccagttagaagaggtagtgtgaatattaattagtttatattactctcattctttgaacatgaactatgcctatgtagtgtctttatttgctcagctggctgagacactgaagaagtcactgaacaaaacctacacacgtaccttcatgtgattcactgccttcctctctctaccagtctatttccactgaacaaaacctacacacataccttcatgtggttcagtgccttcctctctctaccagtctatttccactgaacaaaacctacgcacataccttcatgtggctcagtgccttcctctctctaccagtctatttccattctttcagctgtgtctgacatgtttgtgctctgttccattttaacaactgctcttacttttccagtctgtacagaatgctatttcacttgagcaagatgatgtaatggaaagggtgttggcactggtgtctggagacctggatttgagtcttggtgctatcaatcaccgtctgtgtttgagcaaggcatttggctgctgtaagcttattgcttcatctgtaagcggtggtttgtaattcctgatcttcccacctcacagtgatgttgtggggatccagtgagatagaatacatgtaagtgtggttttgtaatttaaaaagtgctatactaagggaaagaattgaggaattaactgcatacgttttggtgttgcttttcaaatgtttgaaaataaaaaaaatgttaagaaatgggtttcttgccttaaccagtctctcaagtgatgagacagtgaagtaaaattgagtgcactaaacgaataagattctgaggaagtcttatcttctgcagtgagtatggcccaatgctttctgtggctaaacagatgtaatgggaagaaataaaagcctacgtgttggtaaatccaacagcaagggagatttttgaatcataataactcataaggtgctatctgttcagtgatgccctcagagctcttgctgttagctggcagctgacgctgctaggatagttagtttggaaatggtacttcataataaactacacaaggaaagtcagccaccgtgtcttatgaggaattggacctaataaattttagtgtgccttccaaacctgagaatatatgcttttggaagttaaaatttaaatggcttttgccacatacatagatcttcatgatgtgtgagtgtaattccatgtggatatcagttaccaaacattacaaaaaaattttatggcccaaaatgaccaacgaaattgttacaatagaatttatccaattttgatctttttatattcttctaccacacctggaaacagaccaatagacattttggggttttataatgggaatttgtataaagcattactctttttcaataaattgttttttaatttaaaaaaagga

SEQ ID NO: 313341 - DNA, 3320 bp, Homo sapiens
gaattcggcacgagttcccgagcctgggagcaacctcagcttctagtatccagactccagcgccgccccgggcgcggaccccaaccccgacccagagcttctccagcggcggcgcagcgagcagggctccccgccttaacttcctccgcggggcccagccaccttcgggagtccgggttgcccacctgcaaactctccgccttctgcacctgccacccctgagccagcgcgggcgcccgagcgagtcatggccaacgcggggctgcagctgttgggcttcattctcgccttcctgggatggatcggcgccatcgtcagcactgccctgccccagtggaggatttactcctatgccggcgacaacatcgtgaccgcccaggccatgtacgaggggctgtggatgtcctgcgtgtcgcagagcaccgggcagatccagtgcaaagtctttgactccttgctgaatctgagcagcacattgcaagcaacccgtgccttgatggtggttggcatcctcctgggagtgatagcaatctttgtggccaccgttggcatgaagtgtatgaagtgcttggaagacgatgaggtgcagaagatgaggatggctgtcattgggggcgcgatatttcttcttgcaggtctggctattttagttgccacagcatggtatggcaatagaatcgttcaagaattctatgaccctatgaccccagtcaatgccaggtacgaatttggtcaggctctcttcactggctgggctgctgcttctctctgccttctgggaggtgccctactttgctgttcctgtccccgaaaaacaacctcttacccaacaccaaggccctatccaaaacctgcaccttccagcgggaaagactacgtgtgacacagaggcaaaaggagaaaatcatgttgaaacaaaccgaaaatggacattgagatactatcattaacattaggaccttagaattttgggtattgtaatctgaagtatggtattacaaaacaaacaaacaaacaaaaaacccatgtgttaaaatactcagtgctaaacatggcttaatcttattttatcttctttcctcaatataggagggaagatttttccatttgtattactgcttcccattgagtaatcatactcaaatgggggaaggggtgctccttaaatatatatagatatgtatatatacatgtttttctattaaaaatagacagtaaaatactattctcattatgttgatactagcatacttaaaatatctctaaaataggtaaatgtatttaattccatattgatgaagatgtttattggtatattttctttttcgtccttatatacatatgtaacagtcaaatatcatttactcttcttcattagctttgggtgcctttgccacaagacctagcctaatttaccaaggatgaattctttcaattcttcatgcgtgcccttttcatatacttattttattttttaccataatcttatagcacttgcatcgttattaagcccttatttgttttgtgtttcattggtctctatctcctgaatctaacacatttcatagcctacattttagtttctaaagccaagaagaatttattacaaatcagaactttggaggcaaatctttctgcatgaccaaagtgataaattcctgttgaccttcccacacaatccctgtactctgacccatagcactcttgtttgctttgaaaatatttgtccaattgagtagctgcatgctgttcccccaggtgttgtaacacaactttattgattgaatttttaagctacttattcatagttttatatccccctaaactacctttttgttccccattccttaattgtattgttttcccaagtgtaattatcatgcgttttatatcttcctaataaggtgtggtctgtttgtctgaacaaagtgctagactttctggagtgataatctggtgacaaatattctctctgtagctgtaagcaagtcacttaatctttctacctcttttttctatctgccaaattgagataatgatacttaaccagttagaagaggtagtgtgaatattaattagtttatattactctcattctttgaacatgaactatgcctatgtagtgtctttatttgctcagctggctgagacactgaagaagtcactgaacaaaacctacacacgtaccttcatgtgattcactgccttcctctctctaccagtctatttccattctttcagctgtgtctgacatgtttgtgctctgttccattttaacaactgctcttacttttccagtctgtacagaatgctatttcacttgagcaagatgatgtaatggaaagggtgttggcactggtgtctggagacctggatttgagtcttggtgctatcaatcaccgtctgtgtttgagcaaggcatttggctgctgtaagcttattgcttcatctgtaagcggtggtttgtaattcctgatcttcccacctcacagtgatgttgtggggatccagtgagatagaatacatgtaagtgtggttttgtaatttaaaaagtgctatactaagggaaagaattgaggaattaactgcatacgttttggtgttgcttttcaaatgtttgaaaataaaaaaaatgttaagaaatgggtttcttgccttaaccagtctctcaagtgatgagacagtgaagtaaaattgagtgcactaaacgaataagattctgaggaagtcttatcttctgcagtgagtatggcccaatgctttctgtggctaaacagatgtaatgggaagaaataaaagcctacgtgttggtaaatccaacagcaagggagatttttgaatcataataactcataaggtgctatctgttcagtgatgccctcagagctcttgctgttagctggcagctgacgctgctaggatagttagtttggaaatggtacttcataataaactacacaaggaaagtcagccaccgtgtcttatgaggaattggacctaataaattttagtgtgccttccaaacctgagaatatatgcttttggaagttaaaatttaaatggcttttgccacatacatagatcttcatgatgtgtgagtgtaattccatgtggatatcagttaccaaacattacaaaaaaattttatggcccaaaatgaccaacgaaattgttacaatagaatttatccaattttgatctttttatattcttctaccacacctggaaacagaccaatagacattttggggttttataatgggaatttgtataaagcattactctttttcaataaattgttttttaatttaaaaaaagga

SEQ ID NO: 313342 - DNA, 3734 bp, Homo sapiens
gaattcggcacgagttcccgagcctgggagcaacctcagcttctagtatccagactccagcgccgccccgggcgcggaccccaaccccgacccagagcttctccagcggcggcgcagcgagcagggctccccgccttaacttcctccgcggggcccagccaccttcgggagtccgggttgcccacctgcaaactctccgccttctgcacctgccacccctgagccagcgcgggcgcccgagcgagtcatggccaacgcggggctgcagctgttgggcttcattctcgccttcctgggatggatcggcgccatcgtcagcactgccctgccccagtggaggatttactcctatgccggcgacaacatcgtgaccgcccaggccatgtacgaggggctgtggatgtcctgcgtgtcgcagagcaccgggcagatccagtgcaaagtctttgactccttgctgaatctgagcagcacattgcaagcaacccgtgccttgatggtggttggcatcctcctgggagtgatagcaatctttgtggccaccgttggcatgaagtgtatgaagtgcttggaagacgatgaggtgcagaagatgaggatggctgtcattgggggcgcgatatttcttcttgcaggtctggctattttagttgccacagcatggtatggcaatagaatcgttcaagaattctatgaccctatgaccccagtcaatgccaggtacgaatttggtcaggctctcttcactggctgggctgctgcttctctctgccttctgggaggtgccctactttgctgttcctgtccccgaaaaacaacctcttacccaacaccaaggccctatccaaaacctgcaccttccagcgggaaagactacgtgtgacacagaggcaaaaggagaaaatcatgttgaaacaaaccgaaaatggacattgagatactatcattaacattaggaccttagaattttgggtattgtaatctgaagtatggtattacaaaacaaacaaacaaacaaaaaacccatgtgttaaaatactcagtgctaaacatggcttaatcttattttatcttctttcctcaatataggagggaagatttttccatttgtattactgcttcccattgagtaatcatactcaaatgggggaaggggtgctccttaaatatatatagatatgtatatatacatgtttttctattaaaaatagacagtaaaatactattctcattatgttgatactagcatacttaaaatatctctaaaataggtaaatgtatttaattccatattgatgaagatgtttattggtatattttctttttcgtccttatatacatatgtaacagtcaaatatcatttactcttcttcattagctttgggtgcctttgccacaagacctagcctaatttaccaaggatgaattctttcaattcttcatgcgtgcccttttcatatacttattttattttttaccataatcttatagcacttgcatcgttattaagcccttatttgttttgtgtttcattggtctctatctcctgaatctaacacatttcatagcctacattttagtttctaaagccaagaagaatttattacaaatcagaactttggaggcaaatctttctgcatgaccaaagtgataaattcctgttgaccttcccacacaatccctgtactctgacccatagcactcttgtttgctttgaaaatatttgtccaattgagtagctgcatgctgttcccccaggtgttgtaacacaactttattgattgaatttttaagctacttattcatagttttatatccccctaaactacctttttgttccccattccttaattgtattgttttcccaagtgtaattatcatgcgttttatatcttcctaataaggtgtggtctgtttgtctgaacaaagtgctagactttctggagtgataatctggtgacaaatattctctctgtagctgtaagcaagtcacttaatctttctacctcttttttctatctgccaaattgagataatgatacttaaccagttagaagaggtagtgtgaatattaattagtttatattactctcattctttgaacatgaactatgcctatgtagtgtctttatttgctcagctggctgagacactgaagaagtcactgaacaaaacctacacacgtaccttcatgtgattcactgccttcctctctctaccagtctatttccactgaacaaaacctacacacataccttcatgtggttcagtgccttcctctctctaccagtctatttccactgaacaaaacctacgcacataccttcatgtggctcagtgccttcctctctctaccagtctatttccattctttcagctgtgtctgacatgtttgtgctctgttccattttaacaactgctcttacttttccagtctgtacagaatgctatttcacttgagcaagatgatgtaatggaaagggtgttggcactggtgtctggagacctggatttgagtcttggtgctatcaatcaccgtctgtgtttgagcaaggcatttggctgctgtaagcttattgcttcatctgtaagcggtggtttgtaattcctgatcttcccacctcacagtgatgttgtggggatccagtgagatagaatacatgtaagtgtggttttgtaatttaaaaagtgctatactaagggaaagaattgaggaattaactgcatacgttttggtgttgcttttcaaatgtttgaaaataaaaaaaatgttaagaaatgggtttcttgccttaaccagtctctcaagtgatgagacagtgaagtaaaattgagtgcactaaacgaataagattctgaggaagtcttatcttctgcagtgagtatggcccaatgctttctgtggctaaacagatgtaatgggaagaaataaaagcctacgtgttggtaaatccaacagcaagggagatttttgaatcataataactcataaggtgctatctgttcagtgatgccctcagagctcttgctgttagctggcagctgacgctgctaggatagttagtttggaaatggtacttcataataaactacacaaggaaagtcagccaccgtgtcttatgaggaattggacctaataaattttagtgtgccttccaaacctgagaatatatgcttttggaagttaaaatttaaatggcttttgccacatacatagatcttcatgatgtgtgagtgtaattccatgtggatatcagttaccaaacattacaaaaaaattttatggcccaaaatgaccaacgaaattgttacaatagaatttatccaattttgatctttttatattcttctaccacacctggaaacagaccaatagacattttggggttttataatgggaatttgtataaagcattactctttttcaataaattgttttttaatttaaaaaaaggaaaaaaagaaaactcgagtgttttttttttttttttttttttcaacgaaactgatctttactcaacaaagttctacacagggggatactcccccacctcggggccaatcccaaaacagacaggacaaagggcagacccggagcccccaaggggaaaaggtgaggagggaaataggacttgtgttaaaggccaatctggtccacaaaccccgggtaggggagaagggtgagaaacttaaaacttattgggcggaaaaccccccaaataatttacaaataa

SEQ ID NO: 313343 - DNA, 851 bp, Homo sapiens
gcggccgcctactactactactgctcgaattcaagcttctaacgatgtacggggaatgtaagtgtggttttgtaatttaaaaagtgctatactaagggaaagaattgaggaattaactgcatacgttttggtgttgcttttcaaatgtttgaaaataaaaaaaatgttaagaaatgggtttcttgccttaaccagtctctcaagtgatgagacagtgaagtaaaattgagtgcactaaacgaataagattctgaggaagtcttatcttctgcagtgagtatggcccaatgctttctgtggctaaacagatgtaatgggaagaaataaaagcctacgtgttggtaaatccaacagcaagggagatttttgaatcataataactcataaggtgctatctgttcagtgatgccctcagagctcttgctgttagctggcagctgacgctgctaggatagttagtttggaaatggtacttcataataaactacacaaggaaagtcagccaccgtgtcttatgaggaattggacctaataaattttagtgtgccttccaaacctgagaatatatgcttttggaagttaaaatttaaatggcttttgccacatacatagatcttcatgatgtgtgagtgtaattccatgtggatatcagttaccaaacattacaaaaaaattttatggcccaaaatgaccaacgaaattgttacaatagaatttatccaattttgatctttttatattcttctaccacacctggaaacagaccaatagacattttggggttttataatgggaatttgtataaagcattactctttttcaataaattgttttttaatttaaaaaaagga

SEQ ID NO: 313344 - DNA, 1216 bp, Homo sapiens
gaattcggcacgagttcccgagcctgggagcaacctcagcttctagtatccagactccagcgccgccccgggcgcggaccccaaccccgacccagagcttctccagcggcggcgcagcgagcagggctccccgccttaacttcctccgcggggcccagccaccttcgggagtccgggttgcccacctgcaaactctccgccttctgcacctgccacccctgagccagcgcgggcgcccgagcgagtcatggccaacgcggggctgcagctgttgggcttcattctcgccttcctgggatggatcggcgccatcgtcagcactgccctgccccagtggaggatttactcctatgccggcgacaacatcgtgaccgcccaggccatgtacgaggggctgtggatgtcctgcgtgtcgcagagcaccgggcagatccagtgcaaagtctttgactccttgctgaatctgagcagcacattgcaagcaacccgtgccttgatggtggttggcatcctcctgggagtgatagcaatctttgtggccaccgttggcatgaagtgtatgaagtgcttggaagacgatgaggtgcagaagatgaggatggctgtcattgggggcgcgatatttcttcttgcaggtctggctattttagttgccacagcatggtatggcaatagaatcgttcaagaattctatgaccctatgaccccagtcaatgccaggtacgaatttggtcaggctctcttcactggctgggctgctgcttctctctgccttctgggaggtgccctactttgctgttcctgtccccgaaaaacaacctcttacccaacaccaaggccctatccaaaacctgcaccttccagcgggaaagactacgtgtgacacagaggcaaaaggagaaaatcatgttgaaacaaaccgaaaatggacattgagatactatcattaacattaggaccttagaattttgggtattgtaatctgaagtatggtattacaaaacaaacaaacaaacaaaaaacccatgtgttaaaatactcagtgctaaacatggcttaatcttattttatcttctttcctcaatataggagggaagatttttccatttgtattactgcttcccattgagtaatcatactcaaatgggggaaggggtgctccttaaatatatatagatatgtatatatacatgtttttctattaaaaatagacagt

SEQ ID NO: 313345 - DNA, 3425 bp, Homo sapiens
gaattcggcacgagttcccgagcctgggagcaacctcagcttctagtatccagactccagcgccgccccgggcgcggaccccaaccccgacccagagcttctccagcggcggcgcagcgagcagggctccccgccttaacttcctccgcggggcccagccaccttcgggagtccgggttgcccacctgcaaactctccgccttctgcacctgccacccctgagccagcgcgggcgcccgagcgagtcatggccaacgcggggctgcagctgttgggcttcattctcgccttcctgggatggatcggcgccatcgtcagcactgccctgccccagtggaggatttactcctatgccggcgacaacatcgtgaccgcccaggccatgtacgaggggctgtggatgtcctgcgtgtcgcagagcaccgggcagatccagtgcaaagtctttgactccttgctgaatctgagcagcacattgcaagcaacccgtgccttgatggtggttggcatcctcctgggagtgatagcaatctttgtggccaccgttggcatgaagtgtatgaagtgcttggaagacgatgaggtgcagaagatgaggatggctgtctggctattttagttgccacagcatggtatggcaatagaatcgttcaagaattctatgaccctatgaccccagtcaatgccaggtacgaatttggtcaggctctcttcactggctgggctgctgcttctctctgccttctgggaggtgccctactttgctgttcctgtccccgaaaaacaacctcttacccaacaccaaggccctatccaaaacctgcaccttccagcgggaaagactacgtgtgacacagaggcaaaaggagaaaatcatgttgaaacaaaccgaaaatggacattgagatactatcattaacattaggaccttagaattttgggtattgtaatctgaagtatggtattacaaaacaaacaaacaaacaaaaaacccatgtgttaaaatactcagtgctaaacatggcttaatcttattttatcttctttcctcaatataggagggaagatttttccatttgtattactgcttcccattgagtaatcatactcaaatgggggaaggggtgctccttaaatatatatagatatgtatatatacatgtttttctattaaaaatagacagtaaaatactattctcattatgttgatactagcatacttaaaatatctctaaaataggtaaatgtatttaattccatattgatgaagatgtttattggtatattttctttttcgtccttatatacatatgtaacagtcaaatatcatttactcttcttcattagctttgggtgcctttgccacaagacctagcctaatttaccaaggatgaattctttcaattcttcatgcgtgcccttttcatatacttattttattttttaccataatcttatagcacttgcatcgttattaagcccttatttgttttgtgtttcattggtctctatctcctgaatctaacacatttcatagcctacattttagtttctaaagccaagaagaatttattacaaatcagaactttggaggcaaatctttctgcatgaccaaagtgataaattcctgttgaccttcccacacaatccctgtactctgacccatagcactcttgtttgctttgaaaatatttgtccaattgagtagctgcatgctgttcccccaggtgttgtaacacaactttattgattgaatttttaagctacttattcatagttttatatccccctaaactacctttttgttccccattccttaattgtattgttttcccaagtgtaattatcatgcgttttatatcttcctaataaggtgtggtctgtttgtctgaacaaagtgctagactttctggagtgataatctggtgacaaatattctctctgtagctgtaagcaagtcacttaatctttctacctcttttttctatctgccaaattgagataatgatacttaaccagttagaagaggtagtgtgaatattaattagtttatattactctcattctttgaacatgaactatgcctatgtagtgtctttatttgctcagctggctgagacactgaagaagtcactgaacaaaacctacacacgtaccttcatgtgattcactgccttcctctctctaccagtctatttccactgaacaaaacctacacacataccttcatgtggttcagtgccttcctctctctaccagtctatttccactgaacaaaacctacgcacataccttcatgtggctcagtgccttcctctctctaccagtctatttccattctttcagctgtgtctgacatgtttgtgctctgttccattttaacaactgctcttacttttccagtctgtacagaatgctatttcacttgagcaagatgatgtaatggaaagggtgttggcactggtgtctggagacctggatttgagtcttggtgctatcaatcaccgtctgtgtttgagcaaggcatttggctgctgtaagcttattgcttcatctgtaagcggtggtttgtaattcctgatcttcccacctcacagtgatgttgtggggatccagtgagatagaatacatgtaagtgtggttttgtaatttaaaaagtgctatactaagggaaagaattgaggaattaactgcatacgttttggtgttgcttttcaaatgtttgaaaataaaaaaaatgttaagaaatgggtttcttgccttaaccagtctctcaagtgatgagacagtgaagtaaaattgagtgcactaaacgaataagattctgaggaagtcttatcttctgcagtgagtatggcccaatgctttctgtggctaaacagatgtaatgggaagaaataaaagcctacgtgttggtaaatccaacagcaagggagatttttgaatcataataactcataaggtgctatctgttcagtgatgccctcagagctcttgctgttagctggcagctgacgctgctaggatagttagtttggaaatggtacttcataataaactacacaaggaaagtcagccaccgtgtcttatgaggaattggacctaataaattttagtgtgccttccaaacctgagaatatatgcttttggaagttaaaatttaaatggcttttgccacatacatagatcttcatgatgtgtgagtgtaattccatgtggatatcagttaccaaacattacaaaaaaattttatggcccaaaatgaccaacgaaattgttacaatagaatttatccaattttgatctttttatattcttctaccacacctggaaacagaccaatagacattttggggttttataatgggaatttgtataaagcattactctttttcaataaattgttttttaatttaaaaaaagga

SEQ ID NO: 313346 - DNA, 2277 bp, Homo sapiens
gaattcggcacgagttcccgagcctgggagcaacctcagcttctagtatccagactccagcgccgccccgggcgcggaccccaaccccgacccagagcttctccagcggcggcgcagcgagcagggctccccgccttaacttcctccgcggggcccagccaccttcgggagtccgggttgcccacctgcaaactctccgccttctgcacctgccacccctgagccagcgcgggcgcccgagcgagtcatggccaacgcggggctgcagctgttgggcttcattctcgccttcctgggatggatcggcgccatcgtcagcactgccctgccccagtggaggatttactcctatgccggcgacaacatcgtgaccgcccaggccatgtacgaggggctgtggatgtcctgcgtgtcgcagagcaccgggcagatccagtgcaaagtctttgactccttgctgaatctgagcagcacattgcaagcaacccgtgccttgatggtggttggcatcctcctgggagtgatagcaatctttgtggccaccgttggcatgaagtgtatgaagtgcttggaagacgatgaggtgcagaagatgaggatggctgtcattgggggcgcgatatttcttcttgcaggtctggctattttagttgccacagcatggtatggcaatagaatcgttcaagaattctatgaccctatgaccccagtcaatgccaggtacgaatttggtcaggctctcttcactggctgggctgctgcttctctctgccttctgggaggtgccctactttgctgttcctgtccccgaaaaacaacctcttacccaacaccaaggccctatccaaaacctgcaccttccagcgggaaagactacgtgtgacacagaggcaaaaggagaaaatcatgttgaaacaaaccgaaaatggacattgagatactatcattaacattaggaccttagaattttgggtattgtaatctgaagtatggtattacaaaacaaacaaacaaacaaaaaacccatgtgttaaaatactcagtgctaaacatggcttaatcttattttatcttctttcctcaatataggagggaagatttttccatttgtattactgcttcccattgagtaatcatactcaaatgggggaaggggtgctccttaaatatatatagatatgtatatatacatgtttttctattaaaaatagacagtaaaatactattctcattatgttgatactagcatacttaaaatatctctaaaataggtaaatgtatttaattccatattgatgaagatgtttattggtatattttctttttcgtccttatatacatatgtaacagtcaaatatcatttactcttcttcattagctttgggtgcctttgccacaagacctagcctaatttaccaaggatgaattctttcaattcttcatgcgtgcccttttcatatacttattttattttttaccataatcttatagcacttgcatctttaaaaagtgctatactaagggaaagaattgaggaattaactgcatacgttttggtgttgcttttcaaatgtttgaaaataaaaaaaatgttaagaaatgggtttcttgccttaaccagtctctcaagtgatgagacagtgaagtaaaattgagtgcactaaacgaataagattctgaggaagtcttatcttctgcagtgagtatggcccaatgctttctgtggctaaacagatgtaatgggaagaaataaaagcctacgtgttggtaaatccaacagcaagggagatttttgaatcataataactcataaggtgctatctgttcagtgatgccctcagagctcttgctgttagctggcagctgacgctgctaggatagttagtttggaaatggtacttcataataaactacacaaggaaagtcagccaccgtgtcttatgaggaattggacctaataaattttagtgtgccttccaaacctgagaatatatgcttttggaagttaaaatttaaatggcttttgccacatacatagatcttcatgatgtgtgagtgtaattccatgtggatatcagttaccaaacattacaaaaaaattttatggcccaaaatgaccaacgaaattgttacaatagaatttatccaattttgatctttttatattcttctaccacacctggaaacagaccaatagacattttggggttttataatgggaatttgtataaagcattactctttttcaataaattgttttttaatttaaaaaaagga

SEQ ID NO: 313347 - DNA, 763 bp, Homo sapiens
aaggatagtgattaatgtttttctttgtattctatcatctatgtatgcatagctaagcaatataatttgtccacttatataaagcaatatgtttagttatttgttccctcatatatacattctctttgcttacttttgtgctttctttttctcatccaacatgtttgcaatatttatccatattgtgtataactttaatctgtgctctttcttttttttttttttttgagacagactctcgctctgttgcccaggctggagtgcagtggtgtgatctcggctcactgcaacctctgcctcctggggttcacaccattctcttgcctcagcctcccaagtaggctgggattacaggtgcccacgaccatgcccgggctaattttttgtatttttaggcagagacagggtttcaccgtgttagccaggacggtctcgatcttctgacctcgtgatcccgcccgcctcggcctcccaaagtgctgggattacagacgtgagccaccacgccaggcctaatctgtgcttttaaaatgctgtataatgtttcagtatatgaatataccacagtttttaaaaatccattcaactattgataacatttggagtctttccagttttatgctattaaaacaatgttgctgcaaacattcttatgcatgttcctgatgtactacatatgtgcacatttttctgggatatgagttagattgttggggcatagttgtctattcttgggtaacaaatcactctggaagtaaatgga

SEQ ID NO: 313348 - DNA, 2070 bp, Homo sapiens
ttgccagctatccacctcagagtggatatgctaacagggatgtactaaaaattgcaaacattgaaggcttctctaatcccagatacacaacaaaataccatccaagaccataccacacagagacttccaaggccatccttggaaaaatggagaagtagaaggcccccattattttattttatttttatttttttgagatggagtctcgctctttcacccaggctggagtgcagtggcgcgaacttggctcactgcaagctctgcctcctgggttcaagccattctcctgcctcagcctcctgagtagctgggactacaggtgcccatcaccaggcccggctaatttttttgtatttttagtaaagacagggtttcaccatgttagccaggatggtctcgatctcccgacctcataatccgcccgcctcagcctcccaaagtgctgcgattacaggcgtgagccaccgcgccttaaggcccccattcttaactgttaactcctgaattggggatttctgtcaatctagcagaaactccaaaaggattctctgtactagaaccttgattgtctgatcacccctgtttcttatttttcttatttttaggcattaattccaaaaacatccatcagacagacatttaggaagtgttctttctatacaacagagacttggacaggtgaatcagaccacagtccttgtttcattaagttttcaattttggagggggaaggaaaggagaatgagacagccaaaaacttgtgctaactggtaactgaagtgatgggtgaggacaggagacagagccattaattctgtctggactagtcagatggggccttccagaggaggcaaccctgagttgaatttctcccagtaatctttttttttctttttcttttttttctttttctttttttttgcttcctcctcctcttcctctctctcccagcagattttttttttttaatttaaatttttgagaacagggtcccactatattgctcaggcaggtcttgaactcctgggctcaagccatcctcctgcctctgcctcccaaagagctgggattacaggcgtgagccaccgcgcccgacctctcctagtaaccctaaccctcacaaataaccaccattttcttctagaagatgcctgggaatatacatgtgtgcgtgtgcaagagttcttgacagcatatagttaggaaaggaattgctgagtagggtgtgctccccttcaattttatcatatattgtctggttttcaaagtggcgtaatgcattgccctcccatcagggatgtgtgagacttccatttgttctactttttgcacaacacttgattaaacttggttggacttttaaattgtttccagtctggtgggagtgtaatggtagtttttttgtgtattttcaaaaaaaccttttattatgagctattacctacatatggaaaaatgcataaaacaaggccgggagcagtggctcacgcctgtaatgccagctcttagggaggctgaggtgggaggattgcttgaacccaggagtttgaaatcagctgggcgagacccttcctctaacaaaaaaaaaaaaaaagtgtataaaacaatgcactgtgtaacgaaccgtgaagtaaacatcacctgtattaagaactagaataaccctagatgctctctgtgtatctttttctaatcataatctctttactgcctcccagaggtaaccatcataaaagtcaggatagtggttactatattgcttagtagatacgcatacatagatgatcaaatgtaaagaaaaacaaccaccacgccaggcctaatctgtgcttttaaaatgctgtataatgtttcagtatatgaatataccacagtttttaaaaatccattcaactattgataacatttggagtctttccagttttatgctattaaaacaatgttgctgcaaacattcttatgcatgttcctgatgtactacatatgtgcacatttttctgggatatgagttagattgttggggcatagttgtctattcttgggtaacaaatcactctggaagtaaatgga

SEQ ID NO: 313349 - DNA, 801 bp, Homo sapiens
cgcagagaatcggcgggaaaggccgcgcgccaggcagatcgaggggtgtcgcccaaaccgatctgtcgacgcctgaaggggcctgaggagattgctaggcttctcagctggggcttcttcaccctcatttttgtccgactggctggactgaagaacctggcagaagccttggggctagggtgagggtcacggcccagggagccctaaaatgttcccacatctggggtgtgtggggctgggcgccattttcgaggcccgggcccactgggctccactgacgggtgacaggtgactggctgggagcctcctggttgccctgggctctgtggagctgagggatcaaaggggtccctcctttaccccccacgtaggacagaggaaactgtcttcggctctcctcactcatccagtccgagtttgagccaattccttgacaggattcggccatcagtccctgcctttggggaaagccatcagtgtcaagtgcccgagtggcagaaacccgggtctagccccatcactggtctgttagggcagttattttctgctttttgcagaaatgggacaccagctccttattttccttttctggaggttatagttccagggaaggaggtaatgtgaggggaatgggcatttctgggggatcctgagcactccccacagggcatgagcctaggagttgcttgggatgacggtgtaggggcaccatggagggttgcacccatatgggaagaggagtccgcctggggctcaaggggctttatggatgttggaagtggccagctggccaaaactcag

SEQ ID NO: 313350 - DNA, 2943 bp, Homo sapiens
cgcagagaatcggcgggaaaggccgcgcgccaggcagatcgaggggtgtcgcccaaaccgatctgtcgacgcctgaaggggcctgaggagattgctaggcttctcagctggggcttcttcaccctcatttttgtccgactggctggactgaagaacctggcagaagccttggggctagggtctcctcaggaagatgaaccctcccttgcagaagcgggagctgccccagagagtctgtgtgagatgaagacagaggcccagccttcgacatccttgctggcaaacacctcatggactggcacagtgatttctgacagtgtcccaggaagtcaaacgtgggaagacaagggttcattgacccggtctgcaacatcttggacctcagaggcccaagtttcagcagcccgggttgcagaggctcaggccaggaccagtcagcccaagcaaatttctgtattggaggcgttaactgcctcagccctgaaccagaaacccacgcatgagaaggtgcagatgacagagaagaaagagagtgaggtcctccttgcccgtccgttctggtccagcaaaactgagtatattctggctcaggtgggcttctctatgaagccatcttgtctctggcgctttgcctacctgtggcttaacagtggaggctgcagtttcgctgccatctacatcttcatgctgttcctggtcggggttcctcttctcttcctggagatggcagctggtcagagcatgcgtcagggtggcatgggtgtatggaagatcattgccccctggattggtggtgtggggtattctagcttcatggtgtgcttcatcctcggcctgtacttcaatgtggtcaattcctggatcatcttctacatgagccagtccttccagtttcccgttccatgggagaaatgtcccttaacgatgaactctagtggctttgatcctgaatgtgaacggacaacaccctccatatacttctggtaccagcaggccttgaaggcctcagacagaatcgaggatggcgggtcaccagtctacagtctggtcctgcccttctttctttgctggtgtcttgttggtgctttcatgatcaatgggctcaagtccactgggaaggtaatctatgtcttggtactgctcccctgtttcatcattgtcggtttcttcatccggactctactcctggaaggggcaaaatttggccttcaacagttggtggttgccaagatatcggatgtgtacaatatgagtgtgtggtctctagcagggggtcaagttttgtctaacacaggcataggccttggctccgttgcctccttagcctcctacatgccccagtccaacaactgtctcagtgatgcctttctcgtgtctgtgataaacctgctcactttgttggttttcacatctttcaacttctgtgtcctgggcttctgggcgacagtcatcacacatcgctgctgtgagaggaatgctgaaatacttttaaagctgataaacctagggaaactgcctcctgatgccaagccccctgtcaacctgctttacaacccaacctccatctacaatgcctggctcagtggccttccccagcacatcaaaagcatggttctccgcgaggtgactgagtgcaacatagagactcagtttcttaaggctagcgagggcccaaagtttgcattcctgtcctttgttgaagccatgtccttccttcctccgtctgtcttctggtcttttatcttcttcctgatgttgctggccatggggctgagcagcgcaatagggattatgcagggcatcattactccactccaggacaccttctctttcttcaggaaacatacaaagctgctcatagtgggagtctttttgctcatgttcgtgtgcggcctcttcttcactcgaccttcaggcagctacttcatcagactgctgagtgactactggatagtcttccccatcatcgtcgttgtcgtatttgaaaccatggctgtatcctgggcctatggggccaggaggttccttgcagacctgacgatcctgttgggccaccccatctctcccatctttggttggctgtggccccatctgtgtccagttgtgctgctaatcatctttgtgaccatgatggttcatctttgtatgaagccgatcacctacatgtcctgggactcaagcacctcaaaagaggtgcttcgaccatacccaccgtgggcactgctcttgatgatcaccctttttgccattgtcatcctccccatccctgcatactttgtatactgccgcatacataggattcccttcaggcccaagagcggagacgggcctatgacagcctccacatccctacccctaagtcaccagctaacacccagtaaagaggttcaaaaggaagaaattctacaagttgatgaaacaaagtacccatcaacttgtaatgtgacttcctaacttcattaatttggcttcacataacatatcccttagaacagatccaatagacaactcttaatatcagcttgcaactgttgatctccctggatccagaaccacttttatttccaagaggaggggcattctttgggggtgttcatggggcctggacttgcaatcccttcctgggtcccatcttacctggtgaccaccatcattgttttccccatcctcttcctcaacacacatacatgcacaacacatatacaatactagtgatgtctaccagtcctgctacttctggggtgcctgtctcctggaatggagctggaggagcaatgctgttggtgaataaatcagtctactggaactccaaggactggatgtaagcagatctttttttcctatagatgtctcagatgttcagttttcctgtcacaaggcttccagtctgtattagttcattttcacactgctaataaagacatacctgaaactgggaacaaa

SEQ ID NO: 313351 - DNA, 1862 bp, Homo sapiens
cgcagagaatcggcgggaaaggccgcgcgccaggcagatcgaggggtgtcgcccaaaccgatctgtcgacgcctgaaggggcctgaggagattgctaggcttctcagctggggcttcttcaccctcatttttgtccgactggctggactgaagaacctggcagaagccttggggctagggaatgctgaaatacttttaaagctgataaacctagggaaactgcctcctgatgccaagccccctgtcaacctgctttacaacccaacctccatctacaatgcctggctcagtggccttccccagcacatcaaaagcatggttctccgcgaggtgactgagtgcaacatagagactcagtttcttaaggctagcgagggcccaaagtttgcattcctgtcctttgttgaagccatgtccttccttcctccgtctgtcttctggtcttttatcttcttcctgatgttgctggccatggggctgagcagcgcaatagggattatgcagggcatcattactccactccaggacaccttctctttcttcaggaaacatacaaagctgctcatagtgggagtctttttgctcatgttcgtgtgcggcctcttcttcactcgaccttcaggcagctacttcatcagactgctgagtgactactggatagtcttccccatcatcgtcgttgtcgtatttgaaaccatggctgtatcctgggcctatggggccaggaggttccttgcagacctgacgatcctgttgggccaccccatctctcccatctttggttggctgtggccccatctgtgtccagttgtgctgctaatcatctttgtgaccatgatggttcatctttgtatgaagccgatcacctacatgtcctgggactcaagcaccgtgagcctcccccaggacccagaacccctttgggagtaggggccagacctttcaattcactctgggtgaaagaacccagtcatctcattctcttactgcccgaagactcatgggttttctgctttggttccccacccatccttcccctccacaactcttccttttctcttggggattttgatattctgaacccttttcccatctctccacagtcaaaagaggtgcttcgaccatacccaccgtgggcactgctcttgatgatcaccctttttgccattgtcatcctccccatccctgcatactttgtatactgccgcatacataggattcccttcaggcccaagagcggagacgggcctatgacagcctccacatccctacccctaagtcaccagctaacacccagtaaagaggttcaaaaggaagaaattctacaagttgatgaaacaaagtacccatcaacttgtaatgtgacttcctaacttcattaatttggcttcacataacatatcccttagaacagatccaatagacaactcttaatatcagcttgcaactgttgatctccctggatccagaaccacttttatttccaagaggaggggcattctttgggggtgttcatggggcctggacttgcaatcccttcctgggtcccatcttacctggtgaccaccatcattgttttccccatcctcttcctcaacacacatacatgcacaacacatatacaatactagtgatgtctaccagtcctgctacttctggggtgcctgtctcctggaatggagctggaggagcaatgctgttggtgaataaatcagtctactggaactccaaggactggatgtaagcagatctttttttcctatagatgtctcagatgttcagttttcctgtcacaaggcttccagtctgtattagttcattttcacactgctaataaagacatacctgaaactgggaacaaa

SEQ ID NO: 313352 - DNA, 963 bp, Homo sapiens
cgcagagaatcggcgggaaaggccgcgcgccaggcagatcgaggggtgtcgcccaaaccgatctgtcgacgcctgaaggggcctgaggagattgctaggcttctcagctggggcttcttcaccctcatttttgtccgactggctggactgaagaacctggcagaagccttggggctagggtctcctcaggaagatgaaccctcccttgcagaagcgggagctgccccagagagtctgtgtgagatgaagacagaggcccagccttcgacatccttgctggcaaacacctcatggactggcacagtgatttctgacagtgtcccaggaagtcaaacgtgggaagacaagggttcattgacccggtctgcaacatcttggacctcagaggcccaagtttcagcagcccgggttgcagaggctcaggccaggaccagtcagcccaagcaaatttctgtattggaggcgttaactgcctcagccctgaaccagaaacccacgcatgagaaggtgcagatgacagagaagaaagagagtgaggtcctccttgcccgtccgttctggtccagcaaaactgagtatattctggctcaggtgggcttctctatgaagccatcttgtctctggcgctttgcctacctgtggcttaacagtggaggctgtaagtctggggaccaggaaacctgggtccacaaggggcaatcaggacagagtcctgtccaggctttaaccatgaatgtttctgagatatgtagagactaaagacctggtgctctgagcaggataggagccaggtccctggacacttaggatcatgagaggttcagggtatctgaacatggggatggcaaagctggaggcctgggcccaagatgggctggaaactaggtacttgggtcttccaggatttgggggccagaggactggacacttgggaccgtgagggatgtagacatgggtgagccc

SEQ ID NO: 313353 - DNA, 407 bp, Homo sapiens
catgtcagggggttagcttggacatctgattttctcagtgatccagggattttcaggagttttccagggaagatagaatgtatacttgtctatatttttttgttattgtttagttcaatgacactttaacacctctttgttctctttgcaggctagcgagggcccaaagtttgcattcctgtcctttgttgaagccatgtccttccttcctccgtctgtcttctggtcttttatcttcttcctgatgttgctggccatggggctgagcagcgcaatagggattatgcagggcatcattactccactccaggacaccttctctttcttcaggaaacatacaaagctgctcataggtactctgacctaggccctactcctaacaatgaccctgacccctgacaccactg

SEQ ID NO: 313354 - DNA, 369 bp, Homo sapiens
gggagagggaaagagaaaagggaggtgggggaggggataaggaagaagagggggtaccttgtctagcaggcatgtctaaagccaggtccccccagatcctgaatgtgaacggacaacaccctccatatacttctggtaccagcaggccttgaaggcctcagacagaatcgaggatggcgggtcaccagtctacagtctggtcctgcccttctttctttgctggtgtcttgttggtgctttcatgatcaatgggctcaagtccactgggaaggtgagccaccagtattggattccttgaaattctcagatgctttagcccttacctcaatttgttacttgttgatctcctaatctcttactcctttggct

SEQ ID NO: 313355 - DNA, 3155 bp, Homo sapiens
cgcagagaatcggcgggaaaggccgcgcgccaggcagatcgaggggtgtcgcccaaaccgatctgtcgacgcctgaaggggcctgaggagattgctaggcttctcagctggggcttcttcaccctcatttttgtccgactggctggactgaagaacctggcagaagccttggggctagggtctcctcaggaagatgaaccctcccttgcagaagcgggagctgccccagagagtctgtgtgagatgaagacagaggcccagccttcgacatccttgctggcaaacacctcatggactggcacagtgatttctgacagtgtcccaggaagtcaaacgtgggaagacaagggttcattgacccggtctgcaacatcttggacctcagaggcccaagtttcagcagcccgggttgcagaggctcaggccaggaccagtcagcccaagcaaatttctgtattggaggcgttaactgcctcagccctgaaccagaaacccacgcatgagaaggtgcagatgacagagaagaaagagagtgaggtcctccttgcccgtccgttctggtccagcaaaactgagtatattctggctcaggtgggcttctctatgaagccatcttgtctctggcgctttgcctacctgtggcttaacagtggaggctgcagtttcgctgccatctacatcttcatgctgttcctggtcggggttcctcttctcttcctggagatggcagctggtcagagcatgcgtcagggtggcatgggtgtatggaagatcattgccccctggattggtggtgtggggtattctagcttcatggtgtgcttcatcctcggcctgtacttcaatgtggtcaattcctggatcatcttctacatgagccagtccttccagtttcccgttccatgggagaaatgtcccttaacgatgaactctagtggctttgatcctgaatgtgaacggacaacaccctccatatacttctggtaccagcaggccttgaaggcctcagacagaatcgaggatggcgggtcaccagtctacagtctggtcctgcccttctttctttgctggtgtcttgttggtgctttcatgatcaatgggctcaagtccactgggaaggtaatctatgtcttggtactgctcccctgtttcatcattgtcggtttcttcatccggactctactcctggaaggggcaaaatttggccttcaacagttggtggttgccaagatatcggatgtgtacaatatgagtgtgtggtctctagcagggggtcaagttttgtctaacacaggcataggccttggctccgttgcctccttagcctcctacatgccccagtccaacaactgtctcagtgatgcctttctcgtgtctgtgataaacctgctcactttgttggttttcacatctttcaacttctgtgtcctgggcttctgggcgacagtcatcacacatcgctgctgtgagaggaatgctgaaatacttttaaagctgataaacctagggaaactgcctcctgatgccaagccccctgtcaacctgctttacaacccaacctccatctacaatgcctggctcagtggccttccccagcacatcaaaagcatggttctccgcgaggtgactgagtgcaacatagagactcagtttcttaaggctagcgagggcccaaagtttgcattcctgtcctttgttgaagccatgtccttccttcctccgtctgtcttctggtcttttatcttcttcctgatgttgctggccatggggctgagcagcgcaatagggattatgcagggcatcattactccactccaggacaccttctctttcttcaggaaacatacaaagctgctcatagtgggagtctttttgctcatgttcgtgtgcggcctcttcttcactcgaccttcaggcagctacttcatcagactgctgagtgactactggatagtcttccccatcatcgtcgttgtcgtatttgaaaccatggctgtatcctgggcctatggggccaggaggttccttgcagacctgacgatcctgttgggccaccccatctctcccatctttggttggctgtggccccatctgtgtccagttgtgctgctaatcatctttgtgaccatgatggttcatctttgtatgaagccgatcacctacatgtcctgggactcaagcaccgtgagcctcccccaggacccagaacccctttgggagtaggggccagacctttcaattcactctgggtgaaagaacccagtcatctcattctcttactgcccgaagactcatgggttttctgctttggttccccacccatccttcccctccacaactcttccttttctcttggggattttgatattctgaacccttttcccatctctccacagtcaaaagaggtgcttcgaccatacccaccgtgggcactgctcttgatgatcaccctttttgccattgtcatcctccccatccctgcatactttgtatactgccgcatacataggattcccttcaggcccaagagcggagacgggcctatgacagcctccacatccctacccctaagtcaccagctaacacccagtaaagaggttcaaaaggaagaaattctacaagttgatgaaacaaagtacccatcaacttgtaatgtgacttcctaacttcattaatttggcttcacataacatatcccttagaacagatccaatagacaactcttaatatcagcttgcaactgttgatctccctggatccagaaccacttttatttccaagaggaggggcattctttgggggtgttcatggggcctggacttgcaatcccttcctgggtcccatcttacctggtgaccaccatcattgttttccccatcctcttcctcaacacacatacatgcacaacacatatacaatactagtgatgtctaccagtcctgctacttctggggtgcctgtctcctggaatggagctggaggagcaatgctgttggtgaataaatcagtctactggaactccaaggactggatgtaagcagatctttttttcctatagatgtctcagatgttcagttttcctgtcacaaggcttccagtctgtattagttcattttcacactgctaataaagacatacctgaaactgggaacaaa

SEQ ID NO: 313356 - DNA, 1486 bp, Homo sapiens
cgcagagaatcggcgggaaaggccgcgcgccaggcagatcgaggggtgtcgcccaaaccgatctgtcgacgcctgaaggggcctgaggagattgctaggcttctcagctggggcttcttcaccctcatttttgtccgactggctggactgaagaacctggcagaagccttggggctagggtctcctcaggaagatgaaccctcccttgcagaagcgggagctgccccagagagtctgtgtgagatgaagacagaggcccagccttcgacatccttgctggcaaacacctcatggactggcacagtgatttctgacagtgtcccaggaagtcaaacgtgggaagacaagggttcattgacccggtctgcaacatcttggacctcagaggcccaagtttcagcagcccgggttgcagaggctcaggccaggaccagtcagcccaagcaaatttctgtattggaggcgttaactgcctcagccctgaaccagaaacccacgcatgagaaggtgcagatgacagagaagaaagagagtgaggtcctccttgcccgtccgttctggtccagcaaaactgagtatattctggctcaggtgggcttctctatgaagccatcttgtctctggcgctttgcctacctgtggcttaacagtggaggctgcagtttcgctgccatctacatcttcatgctgttcctggtcggggttcctcttctcttcctggagatggcagctggtcagagcatgcgtcagggtggcatgggtgtatggaagatcattgccccctggattggtggtgtggggtattctagcttcatggtgtgcttcatcctcggcctgtacttcaatgtggtcaattcctggatcatcttctacatgagccagtccttccagtttcccgttccatgggagaaatgtcccttaacgatgaactctagtggctttgatcctgaatgtgaacggacaacaccctccatatacttctggtaccagcaggccttgaaggcctcagacagaatcgaggatggcgggtcaccagtctacagtctggtcctgcccttctttctttgctggtgtcttgttggtgctttcatgatcaatgggctcaagtccactgggaagcagagacagggtttcaccgtgttagccaggacggtctcgatcttctgacctcgtgatcccgcccgcctcggcctcccaaagtgctgggattacagacgtgagccaccacgccaggcctaatctgtgcttttaaaatgctgtataatgtttcagtatatgaatataccacagtttttaaaaatccattcaactattgataacatttggagtctttccagttttatgctattaaaacaatgttgctgcaaacattcttatgcatgttcctgatgtactacatatgtgcacatttttctgggatatgagttagattgttggggcatagttgtctattcttgggtaacaaatcactctggaagtaaatgga

SEQ ID NO: 313357 - DNA, 1153 bp, Homo sapiens
ggtcagaccaagggcactcagactggaaaggttgttgctgggcttgggtgtccgtcctttcctgtctccttttcttcctcttttcacttaaatccactgagtctctcgccaagtcagtgatttaggtaatcccgccgcccctggcggaacctttgtgacgccggaactgatgtgccgtagggtggctgcggtcggaggactgttttggtaaaggactagcagttctctgcggagggccggttgatacagttccggtgggagaacgcggctgcgaggttttcggctttggctcctgatatgcagcgacagaattttcggcccccaactcctccttaccctggtccgggtggaggaggttggggtagcggaagcagcttccggggaaccccgggcgggggcggaccacggccgccctcccctcgagacgggtacgggagtccgcaccacacgccgccgtacgggccccggtctaggccgtacgggagcagtcactctccgcgacacggcggcagcttcccggggggccggttcgggtctccgtcccctggcggctaccctggctcctactccaggtcccccgcggggtcccagcagcaattcggctactccccagggcagcagcagacccacccccagggttctccaaggacatctacaccatttggatcagggcgtgttagagaaaaaagaatgtctaatgagttggaaaattatttcaagccttcaatgcttgaagatccttgggctggcctagaaccagtatctgtagtggatataagccaacaatacagcaatactcaaacattcacaggcaaaaaaggaagatacttttgttaacatttctgaaattcaactggaagcttcatgtgtcaggaacatcttggacaaaactttaagttgtgttgatataaatttacccaaagatgatgactttgattggataattagtaaggtctttttgttatttttcatcgtatcaggtattgttgatattagagaaaaaagtaggataacttgcaacatttagctctggaagtacctaccacattttagagatttaccgtttccatatatttaacattcctggttacataatggacatttgtcttttaatgttttttcaatgttttaaaataaaacattttgtcttcta

SEQ ID NO: 313358 - DNA, 1333 bp, Homo sapiens
  misc_feature (1095)..(1095): n is a, c, g, or t
ggtcagaccaagggcactcagactggaaaggttgttgctgggcttgggtgtccgtcctttcctgtctccttttcttcctcttttcacttaaatccactgagtctctcgccaagtcagtgatttaggtaatcccgccgcccctggcggaacctttgtgacgccggaactgatgtgccgtagggtggctgcggtcggaggactgttttggtaaaggactagcagttctctgcggagggccggttgatacagttccggtgggagaacgcggctgcgaggttttcggcttcctcccctcgagacgggtacgggagtccgcaccacacgccgccgtacgggccccggtctaggccgtacgggagcagtcactctccgcgacacggcggcagcttcccggggggccggttcgggtctccgtcccctggcggctaccctggctcctactccaggtcccccgcggggtcccagcagcaattcggctactccccagggcagcagcagacccacccccagggttctccaaggacatctacaccatttggatcagggcgtgttagagaaaaaagaatgtctaatgagttggaaaattatttcaagccttcaatgcttgaagatccttgggctggcctagaaccagtatctgtagtggatataagccaacaatacagcaatactcaaacattcacaggcaaaaaaggaagatacttttgttaacatttctgaaattcaactggaagcttcatgtgtcaggaacatcttggacaaaactttaagttgtgttgatataaatttacccaaagatgatgactttgattggataattagtaaggtctttttgttatttttcatcgtatcaggtattgttgatattagagaaaaaagtaggataacttgcaacatttagctctggaagtacctaccacattttagagatttaccgtttccatatatttaacattcctggttacataatggacatttgtcttttaatgttttttcaatgttttaaaataaaacattttgtcttctaaaaaaaaaaaaaaaaaaaaaaaaaaaaaaaaaaaaaaaaaaaaaaaaaaaaaaaaaaaaaaaaaaaanaaaaaaaaaaaaaaaaacaaaaaaacacacaatacaccacaaaacacctcccaaaacacacttttctcctatcccccctccttccactttcaccttatttctattcttttaaaacttcacattctcttactttaacacctttactttcctctacccttatctcacttatcctcacctcttctaaactctctattcactaaaccttcctccccttctcaaactttccttttctttcata

SEQ ID NO: 313359 - DNA, 1447 bp, Homo sapiens
  misc_feature (1209)..(1209): n is a, c, g, or t
tttctttcgagctacactggcttctgctccaacttccctgaaaagaaaatcggtggtagtggaagttttccattcctttagtgagagtaaatacaaaagacagagagagtatctctagcatgtctgggatttctgtggtttacaacttgcaactacgtggttttccaacttgctgtattctacaccaaccccctaccccttttgagcctggagctaaggagtaaagaaaatgttcatgagctagaaaggttctagaaactttaaaactatagtattgttttctcctgaaaaaagtgaaaatttcgagggaaaattgaatataattacttgatttcatcactgcttgtatttaattactgcaaagttactacattagacacaaaagtatttgagatgacagtggtcatggaattataaataaatgagaataacgaattgctttaagtactttttttaaaaaataggaacacttgattaaaggaagcatggactttgtaattgaacattatttaggttcaagtcacaacttttaagcagcaatgtgattcccgctaacctttagctaaaggaagaagtaccaattatctttactaagtgtttttttaactgattttttttctaaagggttctccaaggacatctacaccatttggatcagggcgtgttagagaaaaaagaatgtctaatgagttggaaaattatttcaagccttcaatgcttgaagatccttgggctggcctagaaccagtatctgtagtggatataagccaacaatacagcaatactcaaacattcacaggcaaaaaaggaagatacttttgttaacatttctgaaattcaactggaagcttcatgtgtcaggaacatcttggacaaaactttaagttgtgttgatataaatttacccaaagatgatgactttgattggataattagtaaggtctttttgttatttttcatcgtatcaggtattgttgatattagagaaaaaagtaggataacttgcaacatttagctctggaagtacctaccacattttagagatttaccgtttccatatatttaacattcctggttacataatggacatttgtcttttaatgttttttcaatgttttaaaataaaacattttgtcttctaaaaaaaaaaaaaaaaaaaaaaaaaaaaaaaaaaaaaaaaaaaaaaaaaaaaaaaaaaaaaaaaaaaanaaaaaaaaaaaaaaaaacaaaaaaacacacaatacaccacaaaacacctcccaaaacacacttttctcctatcccccctccttccactttcaccttatttctattcttttaaaacttcacattctcttactttaacacctttactttcctctacccttatctcacttatcctcacctcttctaaactctctattcactaaaccttcctccccttctcaaactttccttttctttcata

SEQ ID NO: 313360 - DNA, 973 bp, Homo sapiens
ggtcagaccaagggcactcagactggaaaggttgttgctgggcttgggtgtccgtcctttcctgtctccttttcttcctcttttcacttaaatccactgagtctctcgccaagtcagtgatttaggtaatcccgccgcccctggcggaacctttgtgacgccggaactgatgtgccgtagggtggctgcggtcggaggactgttttggtaaaggactagcagttctctgcggagggccggttgatacagttccggtgggagaacgcggctgcgaggttttcggcttcctcccctcgagacgggtacgggagtccgcaccacacgccgccgtacgggccccggtctaggccgtacgggagcagtcactctccgcgacacggcggcagcttcccggggggccggttcgggtctccgtcccctggcggctaccctggctcctactccaggtcccccgcggggtcccagcagcaattcggctactccccagggcagcagcagacccacccccagggttctccaaggacatctacaccatttggatcagggcgtgttagagaaaaaagaatgtctaatgagttggtatctgtagtggatataagccaacaatacagcaatactcaaacattcacaggcaaaaaaggaagatacttttgttaacatttctgaaattcaactggaagcttcatgtgtcaggaacatcttggacaaaactttaagttgtgttgatataaatttacccaaagatgatgactttgattggataattagtaaggtctttttgttatttttcatcgtatcaggtattgttgatattagagaaaaaagtaggataacttgcaacatttagctctggaagtacctaccacattttagagatttaccgtttccatatatttaacattcctggttacataatggacatttgtcttttaatgttttttcaatgttttaaaataaaacattttgtcttcta

SEQ ID NO: 313361 - DNA, 1459 bp, Homo sapiens
  misc_feature (1221)..(1221): n is a, c, g, or t
ggtcagaccaagggcactcagactggaaaggttgttgctgggcttgggtgtccgtcctttcctgtctccttttcttcctcttttcacttaaatccactgagtctctcgccaagtcagtgatttaggtaatcccgccgcccctggcggaacctttgtgacgccggaactgatgtgccgtagggtggctgcggtcggaggactgttttggtaaaggactagcagttctctgcggagggccggttgatacagttccggtgggagaacgcggctgcgaggttttcggctttggctcctgatatgcagcgacagaattttcggcccccaactcctccttaccctggtccgggtggaggaggttggggtagcggaagcagcttccggggaaccccgggcgggggcggaccacggccgccctcccctcgagacgggtacgggagtccgcaccacacgccgccgtacgggccccggtctaggccgtacgggagcagtcactctccgcgacacggcggcagcttcccggggggccggttcgggtctccgtcccctggcggctaccctggctcctactccaggtcccccgcggggtcccagcagcaattcggctactccccagggcagcagcagacccacccccagggttctccaaggacatctacaccatttggatcagggcgtgttagagaaaaaagaatgtctaatgagttggaaaattatttcaagccttcaatgcttgaagatccttgggctggcctagaaccagtatctgtagtggatataagccaacaatacagcaatactcaaacattcacaggcaaaaaaggaagatacttttgttaacatttctgaaattcaactggaagcttcatgtgtcaggaacatcttggacaaaactttaagttgtgttgatataaatttacccaaagatgatgactttgattggataattagtaaggtctttttgttatttttcatcgtatcaggtattgttgatattagagaaaaaagtaggataacttgcaacatttagctctggaagtacctaccacattttagagatttaccgtttccatatatttaacattcctggttacataatggacatttgtcttttaatgttttttcaatgttttaaaataaaacattttgtcttctaaaaaaaaaaaaaaaaaaaaaaaaaaaaaaaaaaaaaaaaaaaaaaaaaaaaaaaaaaaaaaaaaaaanaaaaaaaaaaaaaaaaacaaaaaaacacacaatacaccacaaaacacctcccaaaacacacttttctcctatcccccctccttccactttcaccttatttctattcttttaaaacttcacattctcttactttaacacctttactttcctctacccttatctcacttatcctcacctcttctaaactctctattcactaaaccttcctccccttctcaaactttccttttctttcata

SEQ ID NO: 313362 - DNA, 2696 bp, Homo sapiens
tctccggccccatggaggaagtgagaaagttggcacagtcacgccgggcttcgcaggaccaggtcactcagtgacagatggacaatgcaagaatgaactccttcctggaataccccatacttagcagtggcgactcggggacctgctcagcccgagcctacccctcggaccataggattacaactttccagtcgtgcgcggtcagcgccaacagttgcggcggcgacgaccgcttcctagtgggcaggggggtgcagatcggttcgccccaccaccaccaccaccaccaccatcaccacccccagccggctacctaccagacttccgggaacctgggggtgtcctactcccactcaagttgtggtccaagctatggctcacagaacttcagtgcgccttacagcccctacgcgttaaatcaggaagcagacgtaagtggtgggtacccccagtgcgctcccgctgtttactctggaaatctctcatctcccatggtccagcatcaccaccaccaccagggttatgctgggggcgcggtgggctcgcctcaatacattcaccactcatatggacaggagcaccagagcctggccctggctacgtataataactccttgtcccctctccacgccagccaccaagaagcctgtcgctcccccgcatcggagacatcttctccagcgcagacttttgactggatgaaagtcaaaagaaaccctcccaaaacaggtcagtcctgctggttggtggatgctccttgattattctggaaggagctggtatgcttaatttccaaggaaattaataatgatcttttttttaaaaggcttttgtatcagactagtgttgtagtgcatggagagggtgcccagaggtgttggggcaaagaagtctcagggattggtgtgttttcaaggattttatacatttgggaaataggaagtatgtgggggtggttattgtgacggtagtgttctgttaatatcttgaggctccattaatcaccggtctgaccatgctaatggtttacatcaggttaacactttacacctcatcactcaccctccacagcccgatttgtgctgagttcttgatcttttctttacctgagtgttgccatgaagcgtgtggggaatctcaagtcgatttaaaaatttttacatttccgtctcatggcttcccactttgccccaggggaaagttggagagtacggctacctgggtcaacccaacgcggtgcgcaccaacttcactaccaagcagctcacggaactggagaaggagttccacttcaacaagtacctgacgcgcgcccgcagggtggagatcgctgcatccctgcagctcaacgagacccaagtgaagatctggttccagaaccgccgaatgaagcaaaagaaacgtgagaaggagggtctcttgcccatctctccggccaccccgccaggaaacgacgagaaggccgaggaatcctcagagaagtccagctcttcgccctgcgttccttccccggggtcttctacctcagacactctgactacctcccactgaggcggctccagccccagacaacagcccaggcatctccttgggctgggacttcttacccaaagcacatgcttagcttatctttctttccatttacagtctctttcttcctttctaatcctatctggggagctcctggccaggataatatatttgcagataattctggaccagagacttggtgcggggttaacaccttcatccagattgggtgccagcatacattttctggtgggccttaacatccctcctgcttttaggagaattcacagaacctactgttcctttcagatgaccttttggaaaatagttccctttgccaacagaaacatgccagaaggaatgttctcatcttttttatctaactatatgtacagctctcccctcccttgtccttgaaagtaggatatagcgaaaggcgagtccaggagctcaggaagaagagatgcactatatgtttacacaattaattcatcccttaatttaagtcattttcatgtgtgtgagtttgctggttgtaaatactttgtcctaagagatttatctttatacagattttctagaaatgtttaggttactaaaacagggtgggcaaactctctaaactggtacaattttataggtgaaagaaaaaattccctcatttaaacccaatcagatgcctcagagggtagccttgatttgttcttacagttaagaagccctgcagagcacaaacttcagaaacccggcttcctgtgctaagtctttcccaatctctacccctttcttctcgggccaccctctgtttaaaatttgtgctgggttattcagaacctaaaagtattattcaaaccaatttcttccttccacagttatcttagctggatataatgtattttcagctcaattgttaatgtgatggatggcacaatgaatgtatattttgtgttattcgtgaatagtcttttgcatgtcgcacaatgtttgatgtccccaaagtaccacactgagttctatcagttatcctttgtgagcctatgatattccccatttcctgtacaatcatgaacagctctgagatcctggagtgatatgatccagagcagagtttacgggtcttaggatgtctgtaataaataaatatactcaagtttcaggtaaaataa

SEQ ID NO: 313363 - DNA, 2027 bp, Homo sapiens
tctccggccccatggaggaagtgagaaagttggcacagtcacgccgggcttcgcaggaccaggtcactcagtgacagatggacaatgcaagaatgaactccttcctggaataccccatacttagcagtggcgactcggggacctgctcagcccgagcctacccctcggaccataggattacaactttccagtcgtgcgcggtcagcgccaacagttgcggcggcgacgaccgcttcctagtgggcaggggggtgcagatcggttcgccccaccaccaccaccaccaccaccatcaccacccccagccggctacctaccagacttccgggaacctgggggtgtcctactcccactcaagttgtggtccaagctatggctcacagaacttcagtgcgccttacagcccctacgcgttaaatcaggaagcagacccaccaagaagcctgtcgctcccccgcatcggagacatcttctccagcgcagacttttgactggatgaaagtcaaaagaaaccctcccaaaacagggaaagttggagagtacggctacctgggtcaacccaacgcggtgcgcaccaacttcactaccaagcagctcacggaactggagaaggagttccacttcaacaagtacctgacgcgcgcccgcagggtggagatcgctgcatccctgcagctcaacgagacccaagtgaagatctggttccagaaccgccgaatgaagcaaaagaaacgtgagaaggagggtctcttgcccatctctccggccaccccgccaggaaacgacgagaaggccgaggaatcctcagagaagtccagctcttcgccctgcgttccttccccggggtcttctacctcagacactctgactacctcccactgaggcggctccagccccagacaacagcccaggcatctccttgggctgggacttcttacccaaagcacatgcttagcttatctttctttccatttacagtctctttcttcctttctaatcctatctggggagctcctggccaggataatatatttgcagataattctggaccagagacttggtgcggggttaacaccttcatccagattgggtgccagcatacattttctggtgggccttaacatccctcctgcttttaggagaattcacagaacctactgttcctttcagatgaccttttggaaaatagttccctttgccaacagaaacatgccagaaggaatgttctcatcttttttatctaactatatgtacagctctcccctcccttgtccttgaaagtaggatatagcgaaaggcgagtccaggagctcaggaagaagagatgcactatatgtttacacaattaattcatcccttaatttaagtcattttcatgtgtgtgagtttgctggttgtaaatactttgtcctaagagatttatctttatacagattttctagaaatgtttaggttactaaaacagggtgggcaaactctctaaactggtacaattttataggtgaaagaaaaaattccctcatttaaacccaatcagatgcctcagagggtagccttgatttgttcttacagttaagaagccctgcagagcacaaacttcagaaacccggcttcctgtgctaagtctttcccaatctctacccctttcttctcgggccaccctctgtttaaaatttgtgctgggttattcagaacctaaaagtattattcaaaccaatttcttccttccacagttatcttagctggatataatgtattttcagctcaattgttaatgtgatggatggcacaatgaatgtatattttgtgttattcgtgaatagtcttttgcatgtcgcacaatgtttgatgtccccaaagtaccacactgagttctatcagttatcctttgtgagcctatgatattccccatttcctgtacaatcatgaacagctctgagatcctggagtgatatgatccagagcagagtttacgggtcttaggatgtctgtaataaataaatatactcaagtttcaggtaaaataa

SEQ ID NO: 313364 - DNA, 2230 bp, Homo sapiens
tctccggccccatggaggaagtgagaaagttggcacagtcacgccgggcttcgcaggaccaggtcactcagtgacagatggacaatgcaagaatgaactccttcctggaataccccatacttagcagtggcgactcggggacctgctcagcccgagcctacccctcggaccataggattacaactttccagtcgtgcgcggtcagcgccaacagttgcggcggcgacgaccgcttcctagtgggcaggggggtgcagatcggttcgccccaccaccaccaccaccaccaccatcaccacccccagccggctacctaccagacttccgggaacctgggggtgtcctactcccactcaagttgtggtccaagctatggctcacagaacttcagtgcgccttacagcccctacgcgttaaatcaggaagcagacgtaagtggtgggtacccccagtgcgctcccgctgtttactctggaaatctctcatctcccatggtccagcatcaccaccaccaccagggttatgctgggggcgcggtgggctcgcctcaatacattcaccactcatatggacaggagcaccagagcctggccctggctacgtataataactccttgtcccctctccacgccagccaccaagaagcctgtcgctcccccgcatcggagacatcttctccagcgcagacttttgactggatgaaagtcaaaagaaaccctcccaaaacagggaaagttggagagtacggctacctgggtcaacccaacgcggtgcgcaccaacttcactaccaagcagctcacggaactggagaaggagttccacttcaacaagtacctgacgcgcgcccgcagggtggagatcgctgcatccctgcagctcaacgagacccaagtgaagatctggttccagaaccgccgaatgaagcaaaagaaacgtgagaaggagggtctcttgcccatctctccggccaccccgccaggaaacgacgagaaggccgaggaatcctcagagaagtccagctcttcgccctgcgttccttccccggggtcttctacctcagacactctgactacctcccactgaggcggctccagccccagacaacagcccaggcatctccttgggctgggacttcttacccaaagcacatgcttagcttatctttctttccatttacagtctctttcttcctttctaatcctatctggggagctcctggccaggataatatatttgcagataattctggaccagagacttggtgcggggttaacaccttcatccagattgggtgccagcatacattttctggtgggccttaacatccctcctgcttttaggagaattcacagaacctactgttcctttcagatgaccttttggaaaatagttccctttgccaacagaaacatgccagaaggaatgttctcatcttttttatctaactatatgtacagctctcccctcccttgtccttgaaagtaggatatagcgaaaggcgagtccaggagctcaggaagaagagatgcactatatgtttacacaattaattcatcccttaatttaagtcattttcatgtgtgtgagtttgctggttgtaaatactttgtcctaagagatttatctttatacagattttctagaaatgtttaggttactaaaacagggtgggcaaactctctaaactggtacaattttataggtgaaagaaaaaattccctcatttaaacccaatcagatgcctcagagggtagccttgatttgttcttacagttaagaagccctgcagagcacaaacttcagaaacccggcttcctgtgctaagtctttcccaatctctacccctttcttctcgggccaccctctgtttaaaatttgtgctgggttattcagaacctaaaagtattattcaaaccaatttcttccttccacagttatcttagctggatataatgtattttcagctcaattgttaatgtgatggatggcacaatgaatgtatattttgtgttattcgtgaatagtcttttgcatgtcgcacaatgtttgatgtccccaaagtaccacactgagttctatcagttatcctttgtgagcctatgatattccccatttcctgtacaatcatgaacagctctgagatcctggagtgatatgatccagagcagagtttacgggtcttaggatgtctgtaataaataaatatactcaagtttcaggtaaaataa

SEQ ID NO: 313365 - DNA, 1401 bp, Homo sapiens
tccggctaggtacgaggctgggtgtggatgagtcacctcgcaagtggttccctcattcgagtgctccggcgcacagacccgcgccccgccgtccgcgagcctcccgagagccgtcccttcgtccggccctggagcattgcgtttgtcgccggtgtcgcagtgcgaggatggcgccgcgggtgtagcggctctctgcgcaggccgagtgggcccagagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaatgattgccccgtcagacttttaaatccaaacatagcaaaaatgaaagaagatattctctatcatttcaatctcaccactagcagacacaatttcccagccttgtttggagatgtgaagtttgtgtgtgttggtggaagcccctcccggatgaaagccttcatcaggtgcgttggtgcagagctgggccttgactgcccaggtagagactatcccaacatctgtgcgggaactgaccgctatgccatgtataaagtaggaccggtgctgtctgtcagtcatggtatgggcattccttctatctcaatcatgttgcatgagctcataaagctgctgtactatgcccggtgctccaacgtcactatcatccgcattggcacttctggtgggatagggtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtccaaa

SEQ ID NO: 313366 - DNA, 1598 bp, Homo sapiens
tccggctaggtacgaggctgggtgtggatgagtcacctcgcaagtggttccctcattcgagtgctccggcgcacagacccgcgccccgccgtccgcgagcctcccgagagccgtcccttcgtccggccctggagcattgcgtttgtcgccggtgtcgcagtgcgaggatggcgccgcgggtgtagcggctctctgcgcaggccgagtgggcccagagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaatgattgccccgtcagacttttaaatccaaacatagcaaaaatgaaagaagatattctctatcatttcaatctcaccactagcagacacaatttcccagccttgtttggagatgtgaagtttgtgtgtgttggtggaagcccctcccggatgaaagccttcatcaggtgcgttggtgcagagctgggccttgactgcccaggtagagactatcccaacatctgtgcgggaactgaccgctatgccatgtataaagtaggaccggtgctgtctgtcagtcatggtatgggcattccttctatctcaatcatgttgcatgagctcataaagctgctgtactatgcccggtgctccaacgtcactatcatccgcattggcacttctggtgggatagggtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtccaaacccaaagggggcgtttaagtttctcgagggcgaagttacggtaccggttttggtcaagggcccataggggggatttagaaggcggggggtttaaagggatgggaagggatggattgggaggacccttgggtggtatggacaccccagagtagtaggtataattggattgtgagattttgggaatttgtttataaagc

SEQ ID NO: 313367 - DNA, 1601 bp, Homo sapiens
tagcctacgctaggtgcgaggctgggtttgatgagtcacctcgcaagtggttccctcattcgagtgctccggcgcacagacccgcgccccgccgtccgcgagcctcccgagagccgtcccttcgtccggccctggagcattgcgtttgtcgccggtgtcgcagtgcgaggatggcgccgcgggtgtagcggctctctgcgcaggccgagtgggcccagagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaatgattgccccgtcagacttttaaatccaaacatagcaaaaatgaaagaagatattctctatcatttcaatctcaccactagcagacacaatttcccagccttgtttggagatgtgaagtttgtgtgtgttggtggaagcccctcccggatgaaagccttcatcaggtgcgttggtgcagagctgggccttgactgcccaggtagagactatcccaacatctgtgcgggaactgaccgctatgccatgtataaagtaggaccggtgctgtctgtcagtcatggtatgggcattccttctatctcaatcatgttgcatgagctcataaagctgctgtactatgcccggtgctccaacgtcactatcatccgcattggcacttctggtgggatagggtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtccaaacccaaagggggcgtttaagtttctcgagggcgaagttacggtaccggttttggtcaagggcccataggggggatttagaaggcggggggtttaaagggatgggaagggatggattgggaggacccttgggtggtatggacaccccagagtagtaggtataattggattgtgagattttgggaatttgtttataaagc

SEQ ID NO: 313368 - DNA, 1267 bp, Homo sapiens
ggtcagctgagttcgccggcccagggcaggcggggcccgagcctagcggtaacccccgggcagggcggggccgctcgcagactccatatgagattcacctcgcaagtggttccctcattcgagtgctccggcgcacagacccgcgccccgccgtccgcgagcctcccgagagccgtcccttcgtccggccctggagcattgcgtttgtcgccggtgtcgcagtgcgaggatggcgccgcgggtgtagcggctctctgcgcaggccgagtgggcccagagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaagtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtccaaacccaaagggggcgtttaagtttctcgagggcgaagttacggtaccggttttggtcaagggcccataggggggatttagaaggcggggggtttaaagggatgggaagggatggattgggaggacccttgggtggtatggacaccccagagtagtaggtataattggattgtgagattttgggaatttgtttataaagc

SEQ ID NO: 313369 - DNA, 2009 bp, Homo sapiens
atagctagtacgaggccgcgcttaatcggacgagggagtcacttcccctcctcgggcgagctcctggctttgccccagcaagcgggaactcccaggatcaggaaggtcccagagaaactccccaggggggaagccgaggccgtccagagagatccagggtacacacagtgacagtgccagctccacattcccgaccaccgggccagggctggttccacgctgtcatttctctccgctggccccagccgcggggccaccgccagacagacagaccggggatcctgcctggcggcgtgaccttgggttagtcctagagccgcttctagcccggtttcctccgccccaggttaggaccagggcggggccgctcgcagactccatatgagattcacctcgcaagtggttccctcattcgagtgctccggcgcacagacccgcgccccgccgtccgcgagcctcccgagagccgtcccttcgtccggccctggagcattgcgtttgtcgccggtgtcgcagtgcgaggatggcgccgcgggtgtagcggctctctgcgcaggccgagtgggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaatgattgccccgtcagacttttaaatccaaacatagcaaaaatgaaagaagatattctctatcatttcaatctcaccactagcagacacaatttcccagccttgtttggagatgtgaagtttgtgtgtgttggtggaagcccctcccggatgaaagccttcatcaggtgcgttggtgcagagctgggccttgactgcccaggtagagactatcccaacatctgtgcgggaactgaccgctatgccatgtataaagtaggaccggtgctgtctgtcagtcatggtatgggcattccttctatctcaatcatgttgcatgagctcataaagctgctgtactatgcccggtgctccaacgtcactatcatccgcattggcacttctggtgggatagggtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtccaaaatcccctgttgtgtggactttgagcacactttacacaagaatctagaaaatcagatcgcgattaagagacagagaatcttggattaaccgcatgggagatgttcttccttttgaagtttcattggagcattttcaatgatgttagcctgatttggggtttcttcaagaacattctaccaaatttttgtactatttctagggaaatttttcagactttaaaattctaatggtagtcagatttcatgtcactaaacaagaaatctgacaatagtgccaggaaactaatttcctgatacattaaaaaaattccatgc

SEQ ID NO: 313370 - DNA, 1165 bp, Homo sapiens
acccacgcgtccgcggacgcgtgggtcggcgcacagacccgcgccccgccgtccgcgagcctcccgagagccgtcccttcgtccggccctggagcattgcgtttgtcgccggtgtcgcagtgcgaggatggcgccgcgggtgtagcggctctctgcgcaggccgagtgggcccagagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaagtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtccaaacccaaagggggcgtttaagtttctcgagggcgaagttacggtaccggttttggtcaagggcccataggggggatttagaaggcggggggtttaaagggatgggaagggatggattgggaggacccttgggtggtatggacaccccagagtagtaggtataattggattgtgagattttgggaatttgtttataaagc

SEQ ID NO: 313371 - DNA, 1434 bp, Homo sapiens
ggtcagctgagttcgccggcccagggcaggcggggcccgagcctagcggtaacccccgggcagggcggggccgctcgcagactccatatgagattcacctcgcaagtggttccctcattcgagtgctccggcgcacagacccgcgccccgccgtccgcgagcctcccgagagccgtcccttcgtccggccctggagcattgcgtttgtcgccggtgtcgcagtgcgaggatggcgccgcgggtgtagcggctctctgcgcaggccgagtgggcccagagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaatgattgccccgtcagacttttaaatccaaacatagcaaaaatgaaagaagatattctctatcatttcaatctcaccactagcagacacaatttcccagccttgtttggagatgtgaagtttgtgtgtgttggtggaagcccctcccggatgaaagccttcatcaggtgtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtccaaacccaaagggggcgtttaagtttctcgagggcgaagttacggtaccggttttggtcaagggcccataggggggatttagaaggcggggggtttaaagggatgggaagggatggattgggaggacccttgggtggtatggacaccccagagtagtaggtataattggattgtgagattttgggaatttgtttataaagc

SEQ ID NO: 313372 - DNA, 1533 bp, Homo sapiens
ataggctaggtgcgggcctgggtgttgcatcacctcgcaagtggttccctcattcgagtgctccggcgcacagacccgcgccccgccgtccgcgagcctcccgagagccgtcccttcgtccggccctggagcattgcgtttgtcgccggtgtcgcagtgcgaggatggcgccgcgggtgtagcggctctctgcgcaggccgagtgggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaatgattgccccgtcagacttttaaatccaaacatagcaaaaatgaaagaagatattctctatcatttcaatctcaccactagcagacacaatttcccagccttgtttggagatgtgaagtttgtgtgtgttggtggaagcccctcccggatgaaagccttcatcaggtgcgttggtgcagagctgggccttgactgcccaggtagagactatcccaacatctgtgcgggaactgaccgctatgccatgtataaagtaggaccggtgctgtctgtcagtcatggtatgggcattccttctatctcaatcatgttgcatgagctcataaagctgctgtactatgcccggtgctccaacgtcactatcatccgcattggcacttctggtgggatagggtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtccaaacccaaagggggcgtttaagtttctcgagggcgaagttacggtaccggttttggtcaagggcccataggggggatttagaaggcggggggtttaaagggatgggaagggatggattgggaggacccttgggtggtatggacaccccagagtagtaggtataattggattgtgagattttgggaatttgtttataaagc

SEQ ID NO: 313373 - DNA, 1653 bp, Homo sapiens
atagctagtacgaggccgcgcttaatcggacgagggagtcacttcccctcctcgggcgagctcctggctttgccccagcaagcgggaactcccaggatcaggaaggtcccagagaaactccccaggggggaagccgaggccgtccagagagatccagggtacacacagtgacagtgccagctccacattcccgaccaccgggccagggctggttccacgctgtcatttctctccgctggccccagccgcggggccaccgccagacagacagaccggggatcctgcctggcggcgtgaccttgggttagtcctagagccgcttctagcccggtttcctccgccccaggttaggaccaggcgcacagacccgcgccccgccgtccgcgagcctcccgagagccgtcccttcgtccggccctggagcattgcgtttgtcgccggtgtcgcagtgcgaggatggcgccgcgggtgtagcggctctctgcgcaggccgagtgggcccagagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaatttgtgtgtgttggtggaagcccctcccggatgaaagccttcatcaggtgcgttggtgcagagctgggccttgactgcccaggtagagactatcccaacatctgtgcgggaactgaccgctatgccatgtataaagtaggaccggtgctgtctgtcagtgtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtccaaacccaaagggggcgtttaagtttctcgagggcgaagttacggtaccggttttggtcaagggcccataggggggatttagaaggcggggggtttaaagggatgggaagggatggattgggaggacccttgggtggtatggacaccccagagtagtaggtataattggattgtgagattttgggaatttgtttataaagc

SEQ ID NO: 313374 - DNA, 1501 bp, Homo sapiens
taggctaggtacgaggctgggtggtgaattcctgcgcacagacccgcgccccgccgtccgcgagcctcccgagagccgtcccttcgtccggccctggagcattgcgtttgtcgccggtgtcgcagtgcgaggatggcgccgcgggtgtagcggctctctgcgcaggccgagtgggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaatgattgccccgtcagacttttaaatccaaacatagcaaaaatgaaagaagatattctctatcatttcaatctcaccactagcagacacaatttcccagccttgtttggagatgtgaagtttgtgtgtgttggtggaagcccctcccggatgaaagccttcatcaggtgcgttggtgcagagctgggccttgactgcccaggtagagactatcccaacatctgtgcgggaactgaccgctatgccatgtataaagtaggaccggtgctgtctgtcagtcatggtatgggcattccttctatctcaatcatgttgcatgagctcataaagctgctgtactatgcccggtgctccaacgtcactatcatccgcattggcacttctggtgggatagggtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtccaaacccaaagggggcgtttaagtttctcgagggcgaagttacggtaccggttttggtcaagggcccataggggggatttagaaggcggggggtttaaagggatgggaagggatggattgggaggacccttgggtggtatggacaccccagagtagtaggtataattggattgtgagattttgggaatttgtttataaagc

SEQ ID NO: 313375 - DNA, 296 bp, Homo sapiens
tgatgttttgtccccaccgccttttaaagggagaagggggtaaaatttcatttggaggatgattgttacgcgagctttcagagttcagatggcgtcaagtggccatcgagtcaacatttaacaaaatgttaccgcataaaatattgtcatcgagttatctggcagctccgcagagaaacttcacaggcatatgcgttatatgacataatttgcatggggaagggggtcccttcacgattcttttatatggcaacctgttcttggacctggcagggcccagagaagcgaggaactcc

SEQ ID NO: 313376 - DNA, 771 bp, Homo sapiens
ggggtttcaccatgttgggcaggctggtctcgaactcctgacctcaggtgatccatccgcctcggccttccaaagtgctgggattacaggcgtgagccaccactcccggcccaaccccatgttttctcaggaactggagttccctttaggaagcaagtaacagaggtgctgggctgcccgggcctctaggtcgtcttctttcccaggctctgtgctctcaccagagtgcgcgttcgggaagcagggagaggaccaggaaagacgcctgagacggagagtgggcaccggccgggggcaggcaggtccggcccctgggggtcagagtgcagcgccggtttgaggcagttcggccacttagctgcgactcgaagtgaatgagtcacttcccctcctcgggcgagctcctggctttgccccagcaagcgggaactcccaggatcaggaaggtcccagagaaactccccaggggggaagccgaggccgtccagagagatccagggtacacacagtgacagtgccagctccacattcccgaccaccgggccagggctggttccacgctgtcatttctctccgctggccccagccgcggggccaccgccagacagacagaccggggatcctgcctggcggcgtgaccttgggttagtcctagagccgcttctagcccggtttcctccgccccaggttaggaccagacgtgggtaagaagatttcctctgtagtaggggctgtttaatgtgtaacagaactggctgctggttctttaca

SEQ ID NO: 313377 - DNA, 828 bp, Homo sapiens
tgtgagctgcagaggagcagagagcggcccggcgcggctgcgcggggaggcgggcgcgcggccgggaggttctggggctgggcccagagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaatgattgccccgtcagacttttaaatccaaacatagcaaaaatgaaagaagatattctctatcatttcaatctcaccactagcagacacaatttcccagccttgtttggagatgtgaagttatgtgtgtgttggtggagagacagacaggatgagaggaaatataaggtaagaaaggagcagactggagaaagaagtgagaggagaaacaaacgagaacagttgagaagagaagagaacagcaagagcaaagaaatcaagacagacccgaggaagacacgaaagcaacggaacagagcataaacagacaacacaaaacagaagacaagaggcagtacagaagaagaactcacaccggaagctacacaccaacaacaatcaaaagaaacaggacaaatagaccgcgacagagacaagagaccgaaacaagagaacagaacaaaccacagcgaagacgcaggagcacagacacaaaggaacagaaagcagagacaacagacaagaacat

SEQ ID NO: 313378 - DNA, 1660 bp, Homo sapiens
ggtcagctgagttcgccggcccagggcaggcggggcccgagcctagcggtaacccccgggcagggcggggccgctcgcagactccatatgagattcacctcgcaagtggttccctcattcgagtgctccggcgcacagacccgcgccccgccgtccgcgagcctcccgagagccgtcccttcgtccggccctggagcattgcgtttgtcgccggtgtcgcagtgcgaggatggcgccgcgggtgtagcggctctctgcgcaggccgagtgggcccagagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaatgattgccccgtcagacttttaaatccaaacatagcaaaaatgaaagaagatattctctatcatttcaatctcaccactagcagacacaatttcccagccttgtttggagatgtgaagtttgtgtgtgttggtggaagcccctcccggatgaaagccttcatcaggtgcgttggtgcagagctgggccttgactgcccaggtagagactatcccaacatctgtgcgggaactgaccgctatgccatgtataaagtaggaccggtgctgtctgtcagtcatggtatgggcattccttctatctcaatcatgttgcatgagctcataaagctgctgtactatgcccggtgctccaacgtcactatcatccgcattggcacttctggtgggatagggtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtccaaacccaaagggggcgtttaagtttctcgagggcgaagttacggtaccggttttggtcaagggcccataggggggatttagaaggcggggggtttaaagggatgggaagggatggattgggaggacccttgggtggtatggacaccccagagtagtaggtataattggattgtgagattttgggaatttgtttataaagc

SEQ ID NO: 313379 - DNA, 1887 bp, Homo sapiens
atagctagtacgaggccgcgcttaatcggacgagggagtcacttcccctcctcgggcgagctcctggctttgccccagcaagcgggaactcccaggatcaggaaggtcccagagaaactccccaggggggaagccgaggccgtccagagagatccagggtacacacagtgacagtgccagctccacattcccgaccaccgggccagggctggttccacgctgtcatttctctccgctggccccagccgcggggccaccgccagacagacagaccggggatcctgcctggcggcgtgaccttgggttagtcctagagccgcttctagcccggtttcctccgccccaggttaggaccaggcgcacagacccgcgccccgccgtccgcgagcctcccgagagccgtcccttcgtccggccctggagcattgcgtttgtcgccggtgtcgcagtgcgaggatggcgccgcgggtgtagcggctctctgcgcaggccgagtgggcccagagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaatgattgccccgtcagacttttaaatccaaacatagcaaaaatgaaagaagatattctctatcatttcaatctcaccactagcagacacaatttcccagccttgtttggagatgtgaagtttgtgtgtgttggtggaagcccctcccggatgaaagccttcatcaggtgcgttggtgcagagctgggccttgactgcccaggtagagactatcccaacatctgtgcgggaactgaccgctatgccatgtataaagtaggaccggtgctgtctgtcagtcatggtatgggcattccttctatctcaatcatgttgcatgagctcataaagctgctgtactatgcccggtgctccaacgtcactatcatccgcattggcacttctggtgggatagggtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtccaaacccaaagggggcgtttaagtttctcgagggcgaagttacggtaccggttttggtcaagggcccataggggggatttagaaggcggggggtttaaagggatgggaagggatggattgggaggacccttgggtggtatggacaccccagagtagtaggtataattggattgtgagattttgggaatttgtttataaagc

SEQ ID NO: 313380 - DNA, 1568 bp, Homo sapiens
ctaggctaggtacgaggccggtgggtgaatcggccgaggcgcacagacccgcgccccgccgtccgcgagcctcccgagagccgtcccttcgtccggccctggagcattgcgtttgtcgccggtgtcgcagtgcgaggatggcgccgcgggtgtagcggctctctgcgcaggccgagtgggcccagagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaatgattgccccgtcagacttttaaatccaaacatagcaaaaatgaaagaagatattctctatcatttcaatctcaccactagcagacacaatttcccagccttgtttggagatgtgaagtttgtgtgtgttggtggaagcccctcccggatgaaagccttcatcaggtgcgttggtgcagagctgggccttgactgcccaggtagagactatcccaacatctgtgcgggaactgaccgctatgccatgtataaagtaggaccggtgctgtctgtcagtcatggtatgggcattccttctatctcaatcatgttgcatgagctcataaagctgctgtactatgcccggtgctccaacgtcactatcatccgcattggcacttctggtgggatagggtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtccaaacccaaagggggcgtttaagtttctcgagggcgaagttacggtaccggttttggtcaagggcccataggggggatttagaaggcggggggtttaaagggatgggaagggatggattgggaggacccttgggtggtatggacaccccagagtagtaggtataattggattgtgagattttgggaatttgtttataaagc

SEQ ID NO: 313381 - DNA, 1173 bp, Homo sapiens
actatgctaggtcgagctgggttaatcggccgaggcgcgcacagacccgcgccccgccgtccgcgagcctcccgagagccgtcccttcgtccggccctggagcattgcgtttgtcgccggtgtcgcagtgcgaggatggcgccgcgggtgtagcggctctctgcgcaggccgagtgggcccagagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaagtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtccaaacccaaagggggcgtttaagtttctcgagggcgaagttacggtaccggttttggtcaagggcccataggggggatttagaaggcggggggtttaaagggatgggaagggatggattgggaggacccttgggtggtatggacaccccagagtagtaggtataattggattgtgagattttgggaatttgtttataaagc

SEQ ID NO: 313382 - DNA, 1499 bp, Homo sapiens
atagctagtacgaggccgcgcttaatcggacgagggagtcacttcccctcctcgggcgagctcctggctttgccccagcaagcgggaactcccaggatcaggaaggtcccagagaaactccccaggggggaagccgaggccgtccagagagatccagggtacacacagtgacagtgccagctccacattcccgaccaccgggccagggctggttccacgctgtcatttctctccgctggccccagccgcggggccaccgccagacagacagaccggggatcctgcctggcggcgtgaccttgggttagtcctagagccgcttctagcccggtttcctccgccccaggttaggaccagggcggggccgctcgcagactccatatgagattcacctcgcaagtggttccctcattcgagtgctccggcgcacagacccgcgccccgccgtccgcgagcctcccgagagccgtcccttcgtccggccctggagcattgcgtttgtcgccggtgtcgcagtgcgaggatggcgccgcgggtgtagcggctctctgcgcaggccgagtgggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaagtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtccaaacccaaagggggcgtttaagtttctcgagggcgaagttacggtaccggttttggtcaagggcccataggggggatttagaaggcggggggtttaaagggatgggaagggatggattgggaggacccttgggtggtatggacaccccagagtagtaggtataattggattgtgagattttgggaatttgtttataaagc

SEQ ID NO: 313383 - DNA, 1037 bp, Homo sapiens
atagctagtacgaggccgcgcttaatcggacgagggagtcacttcccctcctcgggcgagctcctggctttgccccagcaagcgggaactcccaggatcaggaaggtcccagagaaactccccaggggggaagccgaggccgtccagagagatccagggtacacacagtgacagtgccagctccacattcccgaccaccgggccagggctggttccacgctgtcatttctctccgctggccccagccgcggggccaccgccagacagacagaccggggatcctgcctggcggcgtgaccttgggttagtcctagagccgcttctagcccggtttcctccgccccaggttaggaccagggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaatgattgccccgtcagacttttaaatccaaacatagcaaaaatgaaagaagatattctctatcatttcaatctcaccactagcagacacaatttcccagccttgtttggagatgtgaagtttgtgtgtgttggtggaagcccctcccggatgaaagccttcatcaggtgcgttggtgcagagctgggccttgactgcccaggtagagactatcccaacatctgtgcgggaactgaccgctatgccatgtataaagtaggaccggtgctgtctgtcagtcatggtatgggcattccttctatctcaatcatgttgcatgagctcataaagctgctgtactatgcccggtgctccaacgtcactatcatccgcattggcacttctggtgggataggtcctggagcccggcctggggtccttaaccgagccggcgtggtacctgctcaggcgagtttggaggcgattgcccggggaccggcccccggaagggcttacagaagtg

SEQ ID NO: 313384 - DNA, 1543 bp, Homo sapiens
atagctagtacgaggccgcgcttaatcggacgagggagtcacttcccctcctcgggcgagctcctggctttgccccagcaagcgggaactcccaggatcaggaaggtcccagagaaactccccaggggggaagccgaggccgtccagagagatccagggtacacacagtgacagtgccagctccacattcccgaccaccgggccagggctggttccacgctgtcatttctctccgctggccccagccgcggggccaccgccagacagacagaccggggatcctgcctggcggcgtgaccttgggttagtcctagagccgcttctagcccggtttcctccgccccaggttaggaccaggcgcacagacccgcgccccgccgtccgcgagcctcccgagagccgtcccttcgtccggccctggagcattgcgtttgtcgccggtgtcgcagtgcgaggatggcgccgcgggtgtagcggctctctgcgcaggccgagtgggcccagagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaatttgtgtgtgttggtggaagcccctcccggatgaaagccttcatcaggtgtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtccaaacccaaagggggcgtttaagtttctcgagggcgaagttacggtaccggttttggtcaagggcccataggggggatttagaaggcggggggtttaaagggatgggaagggatggattgggaggacccttgggtggtatggacaccccagagtagtaggtataattggattgtgagattttgggaatttgtttataaagc

SEQ ID NO: 313385 - DNA, 2339 bp, Homo sapiens
ggcttgaactgagacgctccgctgggcgcgcagcagccgccgatcggacctcggggtcctggatgcaggactgtctgttacgtacagcccttgtgaccgtcacgggcggacaccggccaacgccgggttggggtgaggccgccgccgcggtccctccatcaccctcctggcccggcagaggaacccactgctccgggcggccggggacagaggtggctcaacagcgccgcctcgaagccagagccctccgcaggctagaggattgcggtttcccttcatctccgcggctcttattcctcccccgcgaggccgcccaccggggtacgctctcccgcgcctgcgccaattccgccccgccccgcccccatctaccgaccggatgttagcagatttcccatagtgcctcgctagtggcgggcatgataacacacgccggagggtcgcacgcgggttccagttgtgattgctggagttgtgtattgccaggaggctctccgagattggggtcgggtcactgcctcatccaccggagcgatggcgtttctccgaagcatgtggggcgtgctgagtgccctgggaaggtctggagcagagctgtgcaccggctgtggaagtcgactgcgctcccccttcagttttgtgtatttaccgaggtggttttcatctgtcttggcaagttgtccaaagaaacctgtaagttcttaccttcgattttctaaagaacaactacccatatttaaagctcagaacccagatgcaaaaactacagaactaattagaagaattgcccagcgttggagggaacttcctgattcaaagaaaaaaatatatcaagatgcttatagggcggagtggcaggtatataaagaagagataagcagatttaaagaacagctaactccaagtcagattatgtctttggaaaaagaaatcatggacaaacatttaaaaaggaaagctatgacaaaaaaaaaagagttaacactgcttggaaaaccaaaaagacctcgttcagcttataacgtttatgtagctgaaagattccaagaagctaagggtgattcaccgcaggaaaagctgaagactgtaaaggaaaactggaaaaatctgtctgactctgaaaaggaattatatattcagcatgctaaagaggacgaaactcgttatcataatgaaatgaagtcttgggaagaacaaatgattgaagttggacgaaaggatcttctacgtcgcacaataaagaaacaacgaaaatatggtgctgaggagtgttaaaagtagaagattgagatgtgttcacaatggataggcacaggaaaccagttaggtctcaatacctgaagctatcgtaaaattaagaaaggataaagttggtaaaccttttatatttagtatctttttattcagctcatggacttctgccagcataatacttgctttggaaaacccagataaaggttcatgcaaactttattttgtgtttaggaactactgaggatcagagtaatccaagcaaatgtgaatcattttacctttgacaaaggtaaatcagactatgaagttttttttatacaggatgatgactatggaaagagtactcttgtttccttatattatggaggcaggagtttcgttttcaaaattgttacaaattgtagaagccacggtgttctgtgatataagtgtgtgtttttcataaagcaggcagaactcatctaggtaaattacagttcctaggtataattcacattgtattcagagttgatggttgtacatataagtgattgctggttttagttgcaactttgtataaaagggactgagaaatttataaacttttttcttactgtcttttttctaaagtaaaaacaaagaaattatgtgccagatttatgcatattattttatgttgcatagaataaaatttttaatctttaattttacatttcctaaatatattttaagacgaaacatttgttctatagcttttccctttttttaagtaaggaattttatttttttctgaattattttctctcgtgagtatattgatccagaaagaaaacttgtattatgtgtgttttaaaatgagaaatctaaaaaacgaaaagtctccaaagtctctggaatttgaaacactttgcataacgtataaaagcctgtttaagagacagccaactatggcctgtggatcaaatccagcctgctgcctgctttttatggcctgtgagctaggaattgtgtttataattttaaatgtttttttttaaagacttttatgatacttgaaaattaacatgaatatttagtgttcataaataaagtttgttgaaacacaa

SEQ ID NO: 313386 - DNA, 407 bp, Homo sapiens
ataaaacttcagtggaaaaaagaccaagtgagagacttaaaagtcacgactaaagaattgtctcactctgatggaagccagctgctatgctgtgtgttgctctatggagagactcaggtagaaggaattgaaggaggctttcggccaacagtcagcaaggtactgaggctttcagtccaagagcctataaggaactgaatcctaccagcaaccaagcaagtggcttgaaaatggaccctctctcagctgagtctttgaataagatcacagctcttattcaatatgacaccttgattgtagtcttgttagagatcttgagccagtggcacccagctaagctgtacctgtattcctgacccataaaaccccacagataataaatgtttgtcattttaaactgtgaaaaa

SEQ ID NO: 313387 - DNA, 339 bp, Homo sapiens
atccttaatctctctatccttaatctctctatccttaatctctctatccttaatctctcttccttaatctctgtattcttaatctcagaacccagctcctcctttttctggctcagggaattgttaataaagttgcaacttctgtggaagcatccataaactatgcaaaaactacagaactaattagaagaattgcccagcgttggagggaacttcctgattcaaagaaaaaaatatatcaagatgcttaaagctgctatcatttcatcattaattataaacagatggaactttaccacgccttgccatttttttgctttttacttggcaagtgtttta

SEQ ID NO: 313388 - DNA, 2747 bp, Homo sapiens
ggcttgaactgagacgctccgctgggcgcgcagcagccgccgatcggacctcggggtcctggatgcaggactgtctgttacgtacagcccttgtgaccgtcacgggcggacaccggccaacgccgggttggggtgaggccgccgccgcggtccctccatcaccctcctggcccggcagaggaacccactgctccgggcggccggggacagaggtggctcaacagcgccgcctcgaagccagagccctccgcaggctagaggattgcggtttcccttcatctccgcggctcttattcctcccccgcgaggccgcccaccggggtacgctctcccgcgcctgcgccaattccgccccgccccgcccccatctaccgaccggatgttagcagatttcccatagtgcctcgctagtggcgggcatgataacacacgccggagggtcgcacgcgggttccagttgtgattgctggagttgtgtattgccaggaggctctccgagattggggtcgggtcactgcctcatccaccggagcgatggcgtttctccgaagcatgtggggcgtgctgagtgccctgggaaggtctggagcagagctgtgcaccggctgtggaagtcgactgcgctcccccttcagttttgtgtatttaccgaggtggttttcatctgtcttggcaagttgtccaaagaaacctgtaagttcttaccttcgattttctaaagaacaactacccatatttaaagctcagaacccagatgcaaaaactacagaactaattagaagaattgcccagcgttggagggaacttcctgattcaaagaaaaaaatatatcaagatgcttatagggcggagtggcaggtatataaagaagagataagcagatttaaagaacagctaactccaagtcagattatgtctttggaaaaagaaatcatggacaaacatttaaaaaggaaagctatgacaaaaaaaaaagagttaacactgcttggaaaaccaaaaagacctcgttcagcttataacgtttatgtagctgaaagattccaagaagctaagggtgattcaccgcaggaaaagctgaagactgtaaaggaaaactggaaaaatctgtctgactctgaaaaggaattatatattcagcatgctaaagaggacgaaactcgttatcataatgaaatgaagtcttgggaagaacaaatgattgaagttggacgaaaggatcttctacgtcgcacaataaagaaacaacgaaaatatggtgctgaggagtgttaaaagtagaagattgagatgtgttcacaatggataggcacaggaaaccagttaggtctcaatacctgaagctatcgtaaaattaagaaaggataaagttggtaaaccttttatatttagtatctttttattcagctcatggacttctgccagcataatacttgctttggaaaacccagataaaggttcatgcaaactttattttgtgtttaggaactactgaggatcagagtaatccaagcaaatgtgaatcattttacctttgacaaaggtaaatcagactatgaagttttttttatacaggatgatgactatggaaagagtactcttgtttccttatattatggaggcaggagtttcgttttcaaaattgttacaaattgtagaagccacggtgttctgtgatataagtgtgtgtttttcataaagcaggcagaactcatctaggtaaattacagttcctaggtataattcacattgtattcagagttgatggttgtacatataagtgattgctggttttagttgcaactttgtataaaagggactgagaaatttataaacttttttcttactgtcttttttctaaagtaaaaacaaagaaattatgtgccagatttatgcatattattttatgttgcatagaataaaatttttaatctttaattttacatttcctaaatatattttaagacgaaacatttgttctatagcttttccctttttttaagtaaggaattttatttttttctgaattattttctctcgtgagtatattgatccagaaagaaaacttgtattatgtgtgttttaaaatgagaaatctaaaaaacgaaaagtctccaaagtctctggaatttgaaacactttgcataacgtataaaagcctgtttaagagacagccaactatggcctgtggatcaaatccagcctgctgcctgctttttatggcctgtgagctaggaattgtgtttataattttaaatgtttttttttaaagacttttatgatacttgaaaattaacatgaatatttagtgttcataaataaagtttgttgaaacacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaggggggggggggacaaaacaacaacaaataccgggagaaaagaacaagaagagaacaccacaaaagtagaataaaagagaaaaaagcagacacaagaggacaacacaaacaatagaagaaagagcagtacaaggaaagaaacaaaaacccaagaaaagaaagcaaacaagaaccacgaagacaaaaaaaaaaacagctgtgagaacaaaaacaaacaaacacccagaacaagaaaaaagaagaggaaaacaaacaaaaagaaaaaagagaa

SEQ ID NO: 313389 - DNA, 2406 bp, Homo sapiens
ggcttgaactgagacgctccgctgggcgcgcagcagccgccgatcggacctcggggtcctggatgcaggactgtctgttacgtacagcccttgtgaccgtcacgggcggacaccggccaacgccgggttggggtgaggccgccgccgcggtccctccatcaccctcctggcccggcagaggaacccactgctccgggcggccggggacagaggtggctcaacagcgccgcctcgaagccagagccctccgcaggctagaggattgcggtttcccttcatctccgcggctcttattcctcccccgcgaggccgcccaccggggtacgctctcccgcgcctgcgccaattccgccccgccccgcccccatctaccgaccggatgttagcagatttcccatagtgcctcgctagtggcgggcatgataacacacgccggagggtcgcacgcgggttccagttgtgattgctggagttgtgtattgccaggaggctctccgagattggggtcgggtcactgcctcatccaccggagcgatggcgtttctccgaagcatgtggggcgtgctgagtgccctgggaaggtctggagcagagctgtgcaccggctgtggaagtcgactgcgctcccccttcagttttgtgtatttaccgaggtggttttcatctgtcttggcaagttgtccaaagaaacctgtaagttcttaccttcgattttctaaagaacaactacccatatttaaagctcagaacccagctcctcctttttctggctcagggaattgttaataaagttgcaacttctgtggaagcatccataaactatgcaaaaactacagaactaattagaagaattgcccagcgttggagggaacttcctgattcaaagaaaaaaatatatcaagatgcttatagggcggagtggcaggtatataaagaagagataagcagatttaaagaacagctaactccaagtcagattatgtctttggaaaaagaaatcatggacaaacatttaaaaaggaaagctatgacaaaaaaaaaagagttaacactgcttggaaaaccaaaaagacctcgttcagcttataacgtttatgtagctgaaagattccaagaagctaagggtgattcaccgcaggaaaagctgaagactgtaaaggaaaactggaaaaatctgtctgactctgaaaaggaattatatattcagcatgctaaagaggacgaaactcgttatcataatgaaatgaagtcttgggaagaacaaatgattgaagttggacgaaaggatcttctacgtcgcacaataaagaaacaacgaaaatatggtgctgaggagtgttaaaagtagaagattgagatgtgttcacaatggataggcacaggaaaccagttaggtctcaatacctgaagctatcgtaaaattaagaaaggataaagttggtaaaccttttatatttagtatctttttattcagctcatggacttctgccagcataatacttgctttggaaaacccagataaaggttcatgcaaactttattttgtgtttaggaactactgaggatcagagtaatccaagcaaatgtgaatcattttacctttgacaaaggtaaatcagactatgaagttttttttatacaggatgatgactatggaaagagtactcttgtttccttatattatggaggcaggagtttcgttttcaaaattgttacaaattgtagaagccacggtgttctgtgatataagtgtgtgtttttcataaagcaggcagaactcatctaggtaaattacagttcctaggtataattcacattgtattcagagttgatggttgtacatataagtgattgctggttttagttgcaactttgtataaaagggactgagaaatttataaacttttttcttactgtcttttttctaaagtaaaaacaaagaaattatgtgccagatttatgcatattattttatgttgcatagaataaaatttttaatctttaattttacatttcctaaatatattttaagacgaaacatttgttctatagcttttccctttttttaagtaaggaattttatttttttctgaattattttctctcgtgagtatattgatccagaaagaaaacttgtattatgtgtgttttaaaatgagaaatctaaaaaacgaaaagtctccaaagtctctggaatttgaaacactttgcataacgtataaaagcctgtttaagagacagccaactatggcctgtggatcaaatccagcctgctgcctgctttttatggcctgtgagctaggaattgtgtttataattttaaatgtttttttttaaagacttttatgatacttgaaaattaacatgaatatttagtgttcataaataaagtttgttgaaacacaa

SEQ ID NO: 313390 - DNA, 1383 bp, Homo sapiens
ggcttgaactgagacgctccgctgggcgcgcagcagccgccgatcggacctcggggtcctggatgcaggactgtctgttacgtacagcccttgtgaccgtcacgggcggacaccggccaacgccgggttggggtgaggccgccgccgcggtccctccatcaccctcctggcccggcagaggaacccactgctccgggcggccggggacagaggtggctcaacagcgccgcctcgaagccagagccctccgcaggctagaggattgcggtttcccttcatctccgcggctcttattcctcccccgcgaggccgcccaccggggtacgctctcccgcgcctgcgccaattccgccccgccccgcccccatctaccgaccggatgttagcagatttcccatagtgcctcgctagtggcgggcatgataacacacgccggagggtcgcacgcgggttccagttgtgattgctggagttgtgtattgccaggaggctctccgagattggggtcgggtcactgcctcatccaccggagcgatggcgtttctccgaagcatgtggggcgtgctgagtgccctgggaaggtctggagcagagctgtgcaccggctgtggaagtcgactgcgctcccccttcagttttgtgtatttaccgaggtggttttcatctgtcttggcaagttgtccaaagaaacctgtaagttcttaccttcgattttctaaagaacaactacccatatttaaagctcagaacccagatgcaaaaactacagaactaattagaagaattgcccagcgttggagggaacttcctgattcaaagaaaaaaatatatcaagatgcttatagggcggagtggcaggtatataaagaagagataagcagatttaaagaacagctaactccaagtcagattatgtctttggaaaaagaaatcatggacaaacatttaaaaaggaaagctatgacaaaaaaaaaagagttaacactgcttggaaaaccaaaaagacctcgttcagcttataacgtttatgtagctgaaagattccaagaagctaagggtgattcaccgcaggaaaagctgaagactgtaaaggaaaactggaaaaatctgtctgactctgaaaaggaattatatattcagcatgctaaagaggacgaaactcgttatcataatgaaatgaagtcttgggaagaacaaatgattgaagttggacgaaaggatcttctacgtcgcacaataaagaaacaacgaaaatatggtgctgaggagtgttaaaagtagaagattgagatgtgttcacaatggataggcacaggaaaccagttaggtctcaatacctgaagctatcgtaaaattaagaaaggataaagttggtaaaccttt

SEQ ID NO: 313391 - DNA, 1668 bp, Homo sapiens
ggcttgaactgagacgctccgctgggcgcgcagcagccgccgatcggacctcggggtcctggatgcaggactgtctgttacgtacagcccttgtgaccgtcacgggcggacaccggccaacgccgggttggggtgaggccgccgccgcggtccctccatcaccctcctggcccggcagaggaacccactgctccgggcggccggggacagaggtggctcaacagcgccgcctcgaagccagagccctccgcaggctagaggattgcggtttcccttcatctccgcggctcttattcctcccccgcgaggccgcccaccggggtacgctctcccgcgcctgcgccaattccgccccgccccgcccccatctaccgaccggatgttagcagatttcccatagtgcctcgctagtggcgggcatgataacacacgccggagggtcgcacgcgggttccagttgtgattgctggagttgtgtattgccaggaggctctccgagattggggtcgggtcactgcctcatccaccggagcgatggcgtttctccgaagcatgtggggcgtgctgagtgccctgggaaggtctggagcagagctgtgcaccggctgtggaagtcgactgcgctcccccttcagttttgtgtatttaccgaggtggttttcatctgtcttggcaagttgtccaaagaaacctgtaagttcttaccttcgattttctaaagaacaactacccatatttaaagctcagaacccagatgcaaaaactacagaactaattagaagaattgcccagcgttggagggaacttcctgattcaaagaaaaaaatatatcaagatgcttatagggcggagtggcaggtatataaagaagagataagcagatttaaagaacagctaactccaagtcagattatgtctttggaaaaagaaatcatggacaaacatttaaaaaggaaagctatgacaaaaaaaaaagagttaacactgcttggaaaaccaaaaagacctcgttcagcttataacgtttatgtagctgaaagattccaagaagctaagggtgattcaccgcaggaaaagctgaagactgtaaaggaaaactggaaaaatctgtctgactctgaaaaggaattatatattcagcatgctaaagaggacgaaactcgttatcataatgaaatgaagtcttgggaagaacaaatgattgaagttggacgaaaggatcttctacgtcgcacaataaagaaacaacgaaaatatggtgctgaggagtgttaaaagtagaagattgagatgtgttcacaatggataggcacaggaaaccactcactctgatggaagccagctgctatgctgtgtgttgctctatggagagactcaggtagaaggaattgaaggaggctttcggccaacagtcagcaaggtactgaggctttcagtccaagagcctataaggaactgaatcctaccagcaaccaagcaagtggcttgaaaatggaccctctctcagctgagtctttgaataagatcacagctcttattcaatatgacaccttgattgtagtcttgttagagatcttgagccagtggcacccagctaagctgtacctgtattcctgacccataaaaccccacagataataaatgtttgtcattttaaactgtgaaaaa

SEQ ID NO: 313392 - DNA, 447 bp, Homo sapiens
cagggagtcaagagatgatgactgatgactcagcctcctcagctcggcttcccagagctccactcaccacatcagtgagcctggcatgcagggggagacataaacacaaccatggtgttgatatcaatcctagcagagatgtcacaagccaaggtctgggaagaggaagaatgaatcaggataaaacttcagtggaaaaaagaccaagtgagagacttaaaagtcacgactaaagaattgtgtaagtaacagtggcaaatgacaacaaaaggcctctacagctaaaataatcagtggtacctgtttcagatccccaggcttctctgtttttgggaggtcttaggatgcagggctttgccaattgtgtggcctgggatgacagccaattgatggaagctggaattcagggctttcttctcaacagaagttaaagaaggcaaaaaaaaa

SEQ ID NO: 313393 - DNA, 2243 bp, Homo sapiens
ggcttgaactgagacgctccgctgggcgcgcagcagccgccgatcggacctcggggtcctggatgcaggactgtctgttacgtacagcccttgtgaccgtcacgggcggacaccggccaacgccgggttggggtgaggccgccgccgcggtccctccatcaccctcctggcccggcagaggaacccactgctccgggcggccggggacagaggtggctcaacagcgccgcctcgaagccagagccctccgcaggctagaggattgcggtttcccttcatctccgcggctcttattcctcccccgcgaggccgcccaccggggtacgctctcccgcgcctgcgccaattccgccccgccccgcccccatctaccgaccggatgttagcagatttcccatagtgcctcgctagtggcgggcatgataacacacgccggagggtcgcacgcgggttccagttgtgattgctggagttgtgtattgccaggaggctctccgagattggggtcgggtcactgcctcatccaccggagcgatggcgtttctccgaagcatgtggggcgtgctgagtgccctgggaaggtctggagcagagctgtgcaccggctgtggaagtcgactgcgctcccccttcagttttgtgtatttaccgaggtggttttcatctgtcttggcaagttgtccaaagaaacctgtaagttcttaccttcgattttctaaagaacaactacccatatttaaagctcagaacccagatgcaaaaactacagaactaattagaagaattgcccagcgttggagggaacttcctgattcaaagaaaaaaatatatcaagatgcttatagggcggagtggcaggtatataaagaagagataagcagatttaaagaacagctaactccaagtcagattatgtctttggaaaaagaaatcatggacaaacatttaaaaaggaaagctatgacaaaaaaaaaagaaaagctgaagactgtaaaggaaaactggaaaaatctgtctgactctgaaaaggaattatatattcagcatgctaaagaggacgaaactcgttatcataatgaaatgaagtcttgggaagaacaaatgattgaagttggacgaaaggatcttctacgtcgcacaataaagaaacaacgaaaatatggtgctgaggagtgttaaaagtagaagattgagatgtgttcacaatggataggcacaggaaaccagttaggtctcaatacctgaagctatcgtaaaattaagaaaggataaagttggtaaaccttttatatttagtatctttttattcagctcatggacttctgccagcataatacttgctttggaaaacccagataaaggttcatgcaaactttattttgtgtttaggaactactgaggatcagagtaatccaagcaaatgtgaatcattttacctttgacaaaggtaaatcagactatgaagttttttttatacaggatgatgactatggaaagagtactcttgtttccttatattatggaggcaggagtttcgttttcaaaattgttacaaattgtagaagccacggtgttctgtgatataagtgtgtgtttttcataaagcaggcagaactcatctaggtaaattacagttcctaggtataattcacattgtattcagagttgatggttgtacatataagtgattgctggttttagttgcaactttgtataaaagggactgagaaatttataaacttttttcttactgtcttttttctaaagtaaaaacaaagaaattatgtgccagatttatgcatattattttatgttgcatagaataaaatttttaatctttaattttacatttcctaaatatattttaagacgaaacatttgttctatagcttttccctttttttaagtaaggaattttatttttttctgaattattttctctcgtgagtatattgatccagaaagaaaacttgtattatgtgtgttttaaaatgagaaatctaaaaaacgaaaagtctccaaagtctctggaatttgaaacactttgcataacgtataaaagcctgtttaagagacagccaactatggcctgtggatcaaatccagcctgctgcctgctttttatggcctgtgagctaggaattgtgtttataattttaaatgtttttttttaaagacttttatgatacttgaaaattaacatgaatatttagtgttcataaataaagtttgttgaaacacaa

SEQ ID NO: 313394 - DNA, 1653 bp, Homo sapiens
aaggggaaactatgaccatataaaaaagagttaacactgcttggtaatcccaaaagacctcgttcagcttataacgtttatgtagctgaaagattccaagaagctaagggtgattcaccgcaggaaaagctgaagactgtaaaggaaaactggaatagcttgttaatttgaggtatataaagaagagataagcagatttaaagaacagctaactccaagtcagattatgtctttggaaaaagaaatcatggacaaacatttaaaaaggaaagctatgacaaaaaaaaaagagttaacactgcttggaaaaccaaaaagacctcgttcagcttataacgtttatgtagctgaaagattccaagaagctaagggtgattcaccgcaggaaaagctgaagactgtaaaggaaaactggaaaaatctgtctgactctgaaaaggaattatatattcagcatgctaaagaggacgaaactcgttatcataatgaaatgaagtcttgggaagaacaaatgattgaagttggacgaaaggatcttctacgtcgcacaataaagaaacaacgaaaatatggtgctgaggagtgttaaaagtagaagattgagatgtgttcacaatggataggcacaggaaaccagttaggtctcaatacctgaagctatcgtaaaattaagaaaggataaagttggtaaaccttttatatttagtatctttttattcagctcatggacttctgccagcataatacttgctttggaaaacccagataaaggttcatgcaaactttattttgtgtttaggaactactgaggatcagagtaatccaagcaaatgtgaatcattttacctttgacaaaggtaaatcagactatgaagttttttttatacaggatgatgactatggaaagagtactcttgtttccttatattatggaggcaggagtttcgttttcaaaattgttacaaattgtagaagccacggtgttctgtgatataagtgtgtgtttttcataaagcaggcagaactcatctaggtaaattacagttcctaggtataattcacattgtattcagagttgatggttgtacatataagtgattgctggttttagttgcaactttgtataaaagggactgagaaatttataaacttttttcttactgtcttttttctaaagtaaaaacaaagaaattatgtgccagatttatgcatattattttatgttgcatagaataaaatttttaatctttaattttacatttcctaaatatattttaagacgaaacatttgttctatagcttttccctttttttaagtaaggaattttatttttttctgaattattttctctcgtgagtatattgatccagaaagaaaacttgtattatgtgtgttttaaaatgagaaatctaaaaaacgaaaagtctccaaagtctctggaatttgaaacactttgcataacgtataaaagcctgtttaagagacagccaactatggcctgtggatcaaatccagcctgctgcctgctttttatggcctgtgagctaggaattgtgtttataattttaaatgtttttttttaaagacttttatgatacttgaaaattaacatgaatatttagtgttcataaataaagtttgttgaaacacaa

SEQ ID NO: 313395 - DNA, 1257 bp, Homo sapiens
ggcttgaactgagacgctccgctgggcgcgcagcagccgccgatcggacctcggggtcctggatgcaggactgtctgttacgtacagcccttgtgaccgtcacgggcggacaccggccaacgccgggttggggtgaggccgccgccgcggtccctccatcaccctcctggcccggcagaggaacccactgctccgggcggccggggacagaggtggctcaacagcgccgcctcgaagccagagccctccgcaggctagaggattgcggtttcccttcatctccgcggctcttattcctcccccgcgaggccgcccaccggggtacgctctcccgcgcctgcgccaattccgccccgccccgcccccatctaccgaccggatgttagcagatttcccatagtgcctcgctagtggcgggcatgataacacacgccggagggtcgcacgcgggttccagttgtgattgctggagttgtgtattgccaggaggctctccgagattggggtcgggtcactgcctcatccaccggagcgatggcgtttctccgaagcatgtggggcgtgctgagtgccctgggaaggtctggagcagagctgtgcaccggctgtggaagtcgactgcgctcccccttcagttttgtgtatttaccgaggtggttttcatctgtcttggcaagttgtccaaagaaacctgtaagttcttaccttcgattttctaaagaacaactacccatatttaaagctcagaacccagatgcaaaaactacagaactaattagaagaattgcccagcgttggagggaacttcctgattcaaagaaaaaaatatatcaagatgcttatagggcggagtggcaggtatataaagaagagataagcagatttaaagaacagctaactccaagtcagattatgtctttggaaaaagaaatcatggacaaacatttaaaaaggaaagctatgacaaaaaaaaaagagttaacactgcttggaaaaccaaaaagacctcgttcagcttataacgtttatgtagctgaaagattccaagaagctaagggtgattcaccgcaggaaaagctgaagactgtaaaggaaaactggaaaaatctgtctgactctgaaaaggaagtgagtattacggttgttagtctcaagtgtctacttaggatatctgtgagagaatgtattagggcaaggcttgattcatgtgaagacaaccttgtattactaataatacaagtattctaaaattatttt

SEQ ID NO: 313396 - DNA, 664 bp, Homo sapiens
  misc_feature (77)..(77): n is a, c, g, or t
atgtttgaaaaaaacaaaacatagatggtttgagaaagctgtgtggatggggacagactgtgctcatttggccgagntggggaggacactgctcttcctcagtgagtcctttgggtccccctcgaggggtcatcctgaggtcaggaaggggtactagggtgaccttctctgacacagtcctcacagggcagggatggactgcacccctgagccccagcttttcccagtggccgccaaggttttcttctcccacgatttctccacaccctgctgctccagtttgaacctctgggaagagcaaggtcacttctttggggggtgtgggtcagtcagtcatggcttagcactttgtctgcctccttcagtccaggggagttgcttgtcctagcgaccaagatatggggtttgtggccacattcagtcattttcagcctccacctttccccacagaaggatttccatgtctgagggtggcgttaccaagtatacagtttagtgattccagtatatttacagagctgtgcagccatcactacagccagacatcggacaccacagagctaccaggtgtccctcacctcggggaccctcaggacatctgcgtgtgttcgcacaggcagcgtctacagacatggttggcaatgagatgtattctctttaccta

SEQ ID NO: 313397 - DNA, 504 bp, Homo sapiens
ggcggcgctagcgcgagcctggccccgggcagcgctagggccgggctcctctcggcggcggcgcaccgtcgtcctgtcgtccgcggggcggggacgcggcggcggcggcggcggtggcggctgtgtgtcgccggagccgaagcgcgcaggcccgtcccggtggccggggagcgggcgggtgggggcgccatgtggttcatgtacctgctgagctggctgtcgctcttcatccaggtggccttcatcacgctggctgtcggtgagactgcacgaccccggcccgcgcgggctcccgccccggcatcggtgctcgttgggggtcgcatcgcgggggtttcggagccactcgggggaccactgcccggcgctcccggccttcgccgccccaaccccttcccgcctgatcctgcccctcctgtcgagcctggcagcccggcctgaccgtggctccttccaggtgtcacagagtccgctccggcactgcccgagaaagggtgactcgag

SEQ ID NO: 313398 - DNA, 3438 bp, Homo sapiens
ggcggcgctagcgcgagcctggccccgggcagcgctagggccgggctcctctcggcggcggcgcaccgtcgtcctgtcgtccgcggggcggggacgcggcggcggcggcggcggtggcggctgtgtgtcgccggagccgaagcgcgcaggcccgtcccggtggccggggagcgggcgggtgggggcgccatgtggttcatgtacctgctgagctggctgtcgctcttcatccaggtggccttcatcacgctggctgtcgcggctggactctattacctggcagaactgatagaagaatacacagtggccaccagcaggatcataaaatacatgatctggttctccaccgctgtactgattggcctctacgtctttgagcgcttccccaccagcatgattggagtgggcctattcaccaacctcgtctactttggcctcctccagaccttccccttcatcatgctgacctcgcctaacttcatcctgtcgtgtggactagtggtggtgaatcattacctagcatttcagttttttgcagaagaatattatcccttctcagaggtcctggcctatttcactttctgcctgtggataattccgtttgcgttttttgtgtcactttcggccggggagaacgtcctgccctctaccatgcagccaggagatgatgtcgtctccaattatttcaccaaaggcaagcggggcaaacgcttagggatcctggttgtcttctccttcatcaaagaggccattctacccagtcgtcagaagatatactgacccccatgcaggcaggatgtggggggcaagatcaggagagtcaggcccctgggcctctatgccaggtggggaccagaagtcgggaaggcacctaccacctgccctggctttcttcccctcaactctggagccccatccccaccctccttggggggctcagcttggctcagatctgatgcttcaagaggctgtaacctcagagggcaccaaggagggtggcagagcctgcttagccaggaggccgaggtccctcagtcctcccctgtcccttccaaggtgggtcaggaggttctggccccgctggggcaggcagggcagggtctgtgaagcttaagagcagatggtgacaagttctctgggcaggtggccatggggaggggccatggcttggcatgtccaacagaaatagtttttgctgttgaacggtgatttctgtccaagtgcagatttccgtttgaataaagcttcgcttctaggtggcactgtttgccttaataccctgacagttcatcttcctttcttcctgctaaccttctgctctggactggactcacttttctgctccagggactccttttctgggtttgggtcttgcccttcccaagggactgttcttgtggcccttaatgggaagggggcaggggtgaggagctgagcctgctcaaggagtgggaagtggggctataggcagcctctctgatgcactctcttccatctctttccccaaggctccgtgactgtcaaactgggagtaggagaggggacaatttaggactgggctagattttcagaagaacatctacaatatcctatttataaatcttcctctgggaaaaggagtggtttctggctgaatactatcttaggctcaaggagaaacaaaataaaaattagcttccaggcagcctgtttttaaagaaatgggactaatgggagaagctgtttgtcactctaagagcatccaagccctggcccgtctgtgcactcttggctcctggggagatatatctgccttctaagaaggcaggccaggtcttgggcacagacctgcatttgttgaccttgcactccaactatagtgccttgcaagtgctcaacagtacatattggaatgaagtccctatgagagccatttctggccatgttctatacctcaaagtgaggctggcaggtacagagatgaactgtacacatgtgatacatttaagccactggaaaaacccctgtgcttgaaaatatttcctctatatcatgcctggagttccatcatagcccttcatttccttggctttagcatttaccttctcttaagaataccagctttcccctttccctgagaggaagagcacatgttggtctcctcttagtgtgaacgagattgccaggcccttttctcctatgcacaccaggatagacaaggcaggggatactggcagcctgcatcatcctcccattgggctgacagctggccctactttcctccctctgctgcttggtccctcaccttgatgatgtggcttcgccccctccactctactgccagtgttctcccaggggttgctaaatccagcagacccctttcctgtcttactagatctgggcagcatttgacatggctgatcaccccttgcttcttggatggcacttccctggcacctctgtggctagttgtcctacctccctggctgttcctttcaggcttccgtgcaggcttctccacttgcccatgcacagtagggtctttcagggttctgctgtgggctccctagggaagcccatccatctggatggtttcaaggatggtgaggaatttagagttgacctccagccccaacatccttcctgatcacctgaaccacagttttgctgccctctaggtgcacagacaattcaggtccatggcccagatggtacttgctgtcttctgcaaacctgccccttctgggtacttcccttgaccccgagatcactcaggagccagacaggaaacttattctattcctgttttctctttctgcccaccacatccaatctctcaaaacggtcaggtctaccttaacatctcttgatttgagccactcccactgtcatcagctttcacctggattatcgtgacagcctcctactgcttctctatcatgtggccagagctatcttcctaaaatgcattgcatagttgatcaagtcactctctggcctaaaaccttccttggctccctgctgccctcaggataaagtctggacccctcagcatggcttgtgagactcatggtgtccttgtccctgctcacctctctggtctcatcacttgccttcttgcattctgggtcccagcctcctgtatccagagatgcagtggctctccattgccactctgattcctcctttcttttggtcacagagaaagggtactttctctgtcaaatctcaacttagacttgacttcctccaaggagctttggctatactctctcctcccgacccccaccctggcatactacacagatcactctgggctcacttgcctgcctaatggtcatctccccagtagactgtaagctccttgagggcaaggattgtgttggaatttttgtattaacagtgcctggcttggtgcctggcacctagaaagcactcaataaatgtttgtttaatgaa

SEQ ID NO: 313399 - DNA, 3492 bp, Homo sapiens
  misc_feature (77)..(77): n is a, c, g, or t
atgtttgaaaaaaacaaaacatagatggtttgagaaagctgtgtggatggggacagactgtgctcatttggccgagntggggaggacactgctcttcctcagtgagtcctttgggtccccctcgaggggtcatcctgaggtcaggaaggggtactagggtgaccttctctgacacagtcctcacagggcagggatggactgcacccctgagccccagcttttcccagtggccgccaaggttttcttctcccacgatttctccacaccctgctgctccagtttgaacctctgggaagagcaaggtcacttctttggggggtgtgggtcagtcagtcatggcttagcactttgtctgcctccttcagtccaggggagttgcttgtcctagcgaccaagatatggggtttgtggccacattcagtcattttcagcctccacctttccccacagaaggatttccatgtctgagggtggcgttccctgcttcccaggcctgggccccctttggagatcaggtgtggccccctgtgcactcttgaccaacacgcagtcaccacacccagcccactcttggcacctccggggcaccctcttctcagtctctcttgttgccaggtcctggcctatttcactttctgcctgtggataattccgtttgcgttttttgtgtcactttcggccggggagaacgtcctgccctctaccatgcagccaggagatgatgtcgtctccaattatttcaccaaaggcaagcggggcaaacgcttagggatcctggttgtcttctccttcatcaaagaggccattctacccagtcgtcagaagatatactgacccccatgcaggcaggatgtggggggcaagatcaggagagtcaggcccctgggcctctatgccaggtggggaccagaagtcgggaaggcacctaccacctgccctggctttcttcccctcaactctggagccccatccccaccctccttggggggctcagcttggctcagatctgatgcttcaagaggctgtaacctcagagggcaccaaggagggtggcagagcctgcttagccaggaggccgaggtccctcagtcctcccctgtcccttccaaggtgggtcaggaggttctggccccgctggggcaggcagggcagggtctgtgaagcttaagagcagatggtgacaagttctctgggcaggtggccatggggaggggccatggcttggcatgtccaacagaaatagtttttgctgttgaacggtgatttctgtccaagtgcagatttccgtttgaataaagcttcgcttctaggtggcactgtttgccttaataccctgacagttcatcttcctttcttcctgctaaccttctgctctggactggactcacttttctgctccagggactccttttctgggtttgggtcttgcccttcccaagggactgttcttgtggcccttaatgggaagggggcaggggtgaggagctgagcctgctcaaggagtgggaagtggggctataggcagcctctctgatgcactctcttccatctctttccccaaggctccgtgactgtcaaactgggagtaggagaggggacaatttaggactgggctagattttcagaagaacatctacaatatcctatttataaatcttcctctgggaaaaggagtggtttctggctgaatactatcttaggctcaaggagaaacaaaataaaaattagcttccaggcagcctgtttttaaagaaatgggactaatgggagaagctgtttgtcactctaagagcatccaagccctggcccgtctgtgcactcttggctcctggggagatatatctgccttctaagaaggcaggccaggtcttgggcacagacctgcatttgttgaccttgcactccaactatagtgccttgcaagtgctcaacagtacatattggaatgaagtccctatgagagccatttctggccatgttctatacctcaaagtgaggctggcaggtacagagatgaactgtacacatgtgatacatttaagccactggaaaaacccctgtgcttgaaaatatttcctctatatcatgcctggagttccatcatagcccttcatttccttggctttagcatttaccttctcttaagaataccagctttcccctttccctgagaggaagagcacatgttggtctcctcttagtgtgaacgagattgccaggcccttttctcctatgcacaccaggatagacaaggcaggggatactggcagcctgcatcatcctcccattgggctgacagctggccctactttcctccctctgctgcttggtccctcaccttgatgatgtggcttcgccccctccactctactgccagtgttctcccaggggttgctaaatccagcagacccctttcctgtcttactagatctgggcagcatttgacatggctgatcaccccttgcttcttggatggcacttccctggcacctctgtggctagttgtcctacctccctggctgttcctttcaggcttccgtgcaggcttctccacttgcccatgcacagtagggtctttcagggttctgctgtgggctccctagggaagcccatccatctggatggtttcaaggatggtgaggaatttagagttgacctccagccccaacatccttcctgatcacctgaaccacagttttgctgccctctaggtgcacagacaattcaggtccatggcccagatggtacttgctgtcttctgcaaacctgccccttctgggtacttcccttgaccccgagatcactcaggagccagacaggaaacttattctattcctgttttctctttctgcccaccacatccaatctctcaaaacggtcaggtctaccttaacatctcttgatttgagccactcccactgtcatcagctttcacctggattatcgtgacagcctcctactgcttctctatcatgtggccagagctatcttcctaaaatgcattgcatagttgatcaagtcactctctggcctaaaaccttccttggctccctgctgccctcaggataaagtctggacccctcagcatggcttgtgagactcatggtgtccttgtccctgctcacctctctggtctcatcacttgccttcttgcattctgggtcccagcctcctgtatccagagatgcagtggctctccattgccactctgattcctcctttcttttggtcacagagaaagggtactttctctgtcaaatctcaacttagacttgacttcctccaaggagctttggctatactctctcctcccgacccccaccctggcatactacacagatcactctgggctcacttgcctgcctaatggtcatctccccagtagactgtaagctccttgagggcaaggattgtgttggaatttttgtattaacagtgcctggcttggtgcctggcacctagaaagcactcaataaatgtttgtttaatgaa

SEQ ID NO: 313400 - DNA, 3284 bp, Homo sapiens
ggcggcgctagcgcgagcctggccccgggcagcgctagggccgggctcctctcggcggcggcgcaccgtcgtcctgtcgtccgcggggcggggacgcggcggcggcggcggcggtggcggctgtgtgtcgccggagccgaagcgcgcaggcccgtcccggtggccggggagcgggcgggtgggggcgccatgtggttcatgtacctgctgagctggctgtcgctcttcatccaggtggccttcatcacgctggctgtcgcggctggactctattacctggcagaactgatagaagaatacacagtggccaccagcaggatcataaaatacatgatctgggactagtggtggtgaatcattacctagcatttcagttttttgcagaagaatattatcccttctcagaggtcctggcctatttcactttctgcctgtggataattccgtttgcgttttttgtgtcactttcggccggggagaacgtcctgccctctaccatgcagccaggagatgatgtcgtctccaattatttcaccaaaggcaagcggggcaaacgcttagggatcctggttgtcttctccttcatcaaagaggccattctacccagtcgtcagaagatatactgacccccatgcaggcaggatgtggggggcaagatcaggagagtcaggcccctgggcctctatgccaggtggggaccagaagtcgggaaggcacctaccacctgccctggctttcttcccctcaactctggagccccatccccaccctccttggggggctcagcttggctcagatctgatgcttcaagaggctgtaacctcagagggcaccaaggagggtggcagagcctgcttagccaggaggccgaggtccctcagtcctcccctgtcccttccaaggtgggtcaggaggttctggccccgctggggcaggcagggcagggtctgtgaagcttaagagcagatggtgacaagttctctgggcaggtggccatggggaggggccatggcttggcatgtccaacagaaatagtttttgctgttgaacggtgatttctgtccaagtgcagatttccgtttgaataaagcttcgcttctaggtggcactgtttgccttaataccctgacagttcatcttcctttcttcctgctaaccttctgctctggactggactcacttttctgctccagggactccttttctgggtttgggtcttgcccttcccaagggactgttcttgtggcccttaatgggaagggggcaggggtgaggagctgagcctgctcaaggagtgggaagtggggctataggcagcctctctgatgcactctcttccatctctttccccaaggctccgtgactgtcaaactgggagtaggagaggggacaatttaggactgggctagattttcagaagaacatctacaatatcctatttataaatcttcctctgggaaaaggagtggtttctggctgaatactatcttaggctcaaggagaaacaaaataaaaattagcttccaggcagcctgtttttaaagaaatgggactaatgggagaagctgtttgtcactctaagagcatccaagccctggcccgtctgtgcactcttggctcctggggagatatatctgccttctaagaaggcaggccaggtcttgggcacagacctgcatttgttgaccttgcactccaactatagtgccttgcaagtgctcaacagtacatattggaatgaagtccctatgagagccatttctggccatgttctatacctcaaagtgaggctggcaggtacagagatgaactgtacacatgtgatacatttaagccactggaaaaacccctgtgcttgaaaatatttcctctatatcatgcctggagttccatcatagcccttcatttccttggctttagcatttaccttctcttaagaataccagctttcccctttccctgagaggaagagcacatgttggtctcctcttagtgtgaacgagattgccaggcccttttctcctatgcacaccaggatagacaaggcaggggatactggcagcctgcatcatcctcccattgggctgacagctggccctactttcctccctctgctgcttggtccctcaccttgatgatgtggcttcgccccctccactctactgccagtgttctcccaggggttgctaaatccagcagacccctttcctgtcttactagatctgggcagcatttgacatggctgatcaccccttgcttcttggatggcacttccctggcacctctgtggctagttgtcctacctccctggctgttcctttcaggcttccgtgcaggcttctccacttgcccatgcacagtagggtctttcagggttctgctgtgggctccctagggaagcccatccatctggatggtttcaaggatggtgaggaatttagagttgacctccagccccaacatccttcctgatcacctgaaccacagttttgctgccctctaggtgcacagacaattcaggtccatggcccagatggtacttgctgtcttctgcaaacctgccccttctgggtacttcccttgaccccgagatcactcaggagccagacaggaaacttattctattcctgttttctctttctgcccaccacatccaatctctcaaaacggtcaggtctaccttaacatctcttgatttgagccactcccactgtcatcagctttcacctggattatcgtgacagcctcctactgcttctctatcatgtggccagagctatcttcctaaaatgcattgcatagttgatcaagtcactctctggcctaaaaccttccttggctccctgctgccctcaggataaagtctggacccctcagcatggcttgtgagactcatggtgtccttgtccctgctcacctctctggtctcatcacttgccttcttgcattctgggtcccagcctcctgtatccagagatgcagtggctctccattgccactctgattcctcctttcttttggtcacagagaaagggtactttctctgtcaaatctcaacttagacttgacttcctccaaggagctttggctatactctctcctcccgacccccaccctggcatactacacagatcactctgggctcacttgcctgcctaatggtcatctccccagtagactgtaagctccttgagggcaaggattgtgttggaatttttgtattaacagtgcctggcttggtgcctggcacctagaaagcactcaataaatgtttgtttaatgaa

SEQ ID NO: 313401 - DNA, 3614 bp, Homo sapiens
ggcggcgctagcgcgagcctggccccgggcagcgctagggccgggctcctctcggcggcggcgcaccgtcgtcctgtcgtccgcggggcggggacgcggcggcggcggcggcggtggcggctgtgtgtcgccggagccgaagcgcgcaggcccgtcccggtggccggggagcgggcgggtgggggcgccatgtggttcatgtacctgctgagctggctgtcgctcttcatccaggtggccttcatcacgctggctgtcgcggctggactctattacctggcagaactgatagaagaatacacagtggccaccagcaggatcataaaatacatgatctggttctccaccgctgtactgattggcctctacgtctttgagcgcttccccaccagcatgattggagtgggcctattcaccaacctcgtctactttggcctcctccagaccttccccttcatcatgctgacctcgcctaacttcatcctgtcgtgtggactagtggtggtgaatcattacctagcatttcagttttttgcagaagaatattatcccttctcagaggtcctggcctatttcactttctgcctgtggataattccgtttgcgttttttgtgtcactttcggccggggagaacgtcctgccctctaccatgcagccaggagatgatgtcgtctccaattatttcaccaaaggcaagcggggcaaacgcttagggatcctggttgtcttctccttcatcaaagaggccattctacccagtcgtcagaagatatactgacccccatgcaggcaggatgtggggggcaagatcaggagagtcaggcccctgggcctctatgccaggtggggaccagaagtcgggaaggcacctaccacctgccctggctttcttcccctcaactctggagccccatccccaccctccttggggggctcagcttggctcagatctgatgcttcaagaggctgtaacctcagagggcaccaaggagggtggcagagcctgcttagccaggaggccgaggtccctcagtcctcccctgtcccttccaaggtgggtcaggaggttctggccccgctggggcaggcagggcagggtctgtgaagcttaagagcagatggtgacaagttctctgggcaggtggccatggggaggggccatggcttggcatgtccaacagaaatagtttttgctgttgaacggtgatttctgtccaagtgcagatttccgtttgaataaagcttcgcttctaggtggcactgtttgccttaataccctgacagttcatcttcctttcttcctgctaaccttctgctctggactggactcacttttctgctccagggactccttttctgggtttgggtcttgcccttcccaagggactgttcttgtggcccttaatgggaagggggcaggggtgaggagctgagcctgctcaaggagtgggaagtggggctataggcagcctctctgatgcactctcttccatctctttccccaaggctccgtgactgtcaaactgggagtaggagaggggacaatttaggactgggctagattttcagaagaacatctacaatatcctatttataaatcttcctctgggaaaaggagtggtttctggctgaatactatcttaggctcaaggagaaacaaaataaaaattagcttccaggcagcctgtttttaaagaaatgggactaatgggagaagctgtttgtcactctaagagcatccaagccctggcccgtctgtgcactcttggctcctggggagatatatctgccttctaagaaggcaggccaggtcttgggcacagacctgcatttgttgaccttgcactccaactatagtgccttgcaagtgctcaacagtacatattggaatgaagtccctatgagagccatttctggccatgttctatacctcaaagtgaggctggcaggtacagagatgaactgtacacatgtgatacatttaagccactggaaaaacccctgtgcttgaaaatatttcctctatatcatgcctggagttccatcatagcccttcatttccttggctttagcatttaccttctcttaagaataccagctttcccctttccctgagaggaagagcacatgttggtctcctcttagtgtgaacgagattgccaggcccttttctcctatgcacaccaggatagacaaggcaggggatactggcagcctgcatcatcctcccattgggctgacagctggccctactttcctccctctgctgcttggtccctcaccttgatgatgtggcttcgccccctccactctactgccagtgttctcccaggggttgctaaatccagcagacccctttcctgtcttactagatctgggcagcatttgacatggctgatcaccccttgcttcttggatggcacttccctggcacctctgtggctagttgtcctacctccctggctgttcctttcaggcttccgtgcaggcttctccacttgcccatgcacagtagggtctttcagggttctgctgtgggctccctagggaagcccatccatctggatggtttcaaggatggtgaggaatttagagttgacctccagccccaacatccttcctgatcacctgaaccacagttttgctgccctctaggtgcacagacaattcaggtccatggcccagatggtacttgctgtcttctgcaaacctgccccttctgggtacttcccttgaccccgagatcactcaggagccagacaggaaacttattctattcctgttttctctttctgcccaccacatccaatctctcaaaacggtcaggtctaccttaacatctcttgatttgagccactcccactgtcatcagctttcacctggattatcgtgacagcctcctactgcttctctatcatgtggccagagctatcttcctaaaatgcattgcatagttgatcaagtcactctctggcctaaaaccttccttggctccctgctgccctcaggataaagtctggacccctcagcatggcttgtgagactcatggtgtccttgtccctgctcacctctctggtctcatcacttgccttcttgcattctgggtcccagcctcctgtatccagagatgcagtggctctccattgccactctgattcctcctttcttttggtcacagagaaagggtactttctctgtcaaatctcaacttagacttgacttcctccaaggagctttggctatactctctcctcccgacccccaccctggcatactacacagatcactctgggctcacttgcctgcctaatggtcatctccccagtagactgtaagctccttgagggcaaggattgtgttggaatttttgtattaacagtgcctggcttggtgcctggcacctagaaagcactcaataaatgtttgtttaatgaaaaaaaaaaaggggggggtctaaagttccttgagggcaagttagcgttccagtttgtcaaagggccctaggggcgataaaaagagggggggggtaaagcggtggaaggtcggttggagggccttggggcttggccacagaaggcggaaaatgttgaagttgggaggtgtgtaaaggg

SEQ ID NO: 313402 - DNA, 3580 bp, Homo sapiens
ggcggcgctagcgcgagcctggccccgggcagcgctagggccgggctcctctcggcggcggcgcaccgtcgtcctgtcgtccgcggggcggggacgcggcggcggcggcggcggtggcggctgtgtgtcgccggagccgaagcgcgcaggcccgtcccggtggccggggagcgggcgggtgggggcgccatgtggttcatgtacctgctgagctggctgtcgctcttcatccaggtggccttcatcacgctggctgtcgcggctggactctattacctggcagaactgatagaagaatacacagtggccaccagcaggatcataaaatacatgatctggttctccaccgctgtactgattggcctctacgtctttgagcgcttccccaccagcatgattggagtgggcctattcaccaacctcgtctactttggcctcctccagaccttccccttcatcatgctgacctcgcctaacttcatcctgtcgtgtggactagtggtggtgaatcattacctagcatttcagttttttgcagaagaatattatcccttctcagaggtcctggcctatttcactttctgcctgtggataattccgtttgcgttttttgtgtcactttcggccggggagaacgtcctgccctctaccatgcagccaggagatgatgtcgtctccaattatttcaccaaaggcaagcggggcaaacgcttagggatcctggttgtcttctccttcatcaaagaggccattctacccagtcgtcagaagatatactgacccccatgcaggcaggatgtggggggcaagatcaggagagtcaggcccctgggcctctatgccaggtggggaccagaagtcgggaaggcacctaccacctgccctggctttcttcccctcaactctggagccccatccccaccctccttggggggctcagcttggctcagatctgatgcttcaagaggctgtaacctcagagggcaccaaggagggtggcagagcctgcttagccaggaggccgaggtccctcagtcctcccctgtcccttccaaggtgggtcaggaggttctggccccgctggggcaggcagggcagggtctgtgaagcttaagagcagatggtgacaagttctctgggcaggtggccatggggaggggccatggcttggcatgtccaacagaaatagtttttgctgttgaacggtgatttctgtccaagtgcagatttccgtttgaataaagcttcgcttctaggtggcactgtttgccttaataccctgacagttcatcttcctttcttcctgctaaccttctgctctggactggactcacttttctgctccagggactccttttctgggtttgggtcttgcccttcccaagggactgttcttgtggcccttaatgggaagggggcaggggtgaggagctgagcctgctcaaggagtgggaagtggggctataggcagcctctctgatgcactctcttccatctctttccccaaggctccgtgactgtcaaactgggagtaggagaggggacaatttaggactgggctagattttcagaagaacatctacaatatcctatttataaatcttcctctgggaaaaggagtggtttctggctgaatactatcttaggctcaaggagaaacaaaataaaaattagcttccaggcagcctgtttttaaagaaatgggactaatgggagaagctgtttgtcactctaagagcatccaagccctggcccgtctgtgcactcttggctcctggggagatatatctgccttctaagaaggcaggccaggtcttgggcacagacctgcatttgttgaccttgcactccaactatagtgccttgcaagtgctcaacagtacatattggaatgaagtccctatgagagccatttctggccatgttctatacctcaaagtgaggctggcaggtacagagatgaactgtacacatgtgatacatttaagccactggaaaaacccctgtgcttgaaaatatttcctctatatcatgcctggagttccatcatagcccttcatttccttggctttagcatttaccttctcttaagaataccagctttcccctttccctgagaggaagagcacatgttggtctcctcttagtgtgaacgagattgccaggcccttttctcctatgcacaccaggatagacaaggcaggggatactggcagcctgcatcatcctcccattgggctgacagctggccctactttcctccctctgctgcttggtccctcaccttgatgatgtggcttcgccccctccactctactgccagtgttctcccaggggttgctaaatccagcagacccctttcctgtcttactagatctgggcagcatttgacatggctgatcaccccttgcttcttggatggcacttccctggcacctctgtggctagttgtcctacctccctggctgttcctttcaggcttccgtgcaggcttctccacttgcccatgcacagtagggtctttcagggttctgctgtgggctccctagggaagcccatccatctggatggtttcaaggatggtgaggaatttagagttgacctccagccccaacatccttcctgatcacctgaaccacagttttgctgccctctaggtgcacagacaattcaggtccatggcccagatggtacttgctgtcttctgcaaacctgccccttctgggtacttcccttgaccccgagatcactcaggagccagacaggaaacttattctattcctgttttctctttctgcccaccacatccaatctctcaaaacggtcaggtctaccttaacatctcttgatttgagccactcccactgtcatcagctttcacctggattatcgtgacagcctcctactgcttctctatcatgtggccagagctatcttcctaaaatgcattgcatagttgatcaagtcactctctggcctaaaaccttccttggctccctgctgccctcaggataaagtctggacccctcagcatggcttgtgagactcatggtgtccttgtccctgctcacctctctggtctcatcacttgccttcttgcattctgggtcccagcctcctgtatccagagatgcagtggctctccattgccactctgattcctcctttcttttggtcacagagaaagggtactttctctgtcaaatctcaacttagacttgacttcctccaaggagctttggctatactctctcctcccgacccccaccctggcatactacacagatcactctgggctcacttgcctgcctaatggtcatctccccagtagactgtaagctccttgagggcaaggattgtgttggaatttttgtattaacagtgcctggcttggtgcctggcacctagaaagcactcaataaatgtttgtttaatgaaaaaaaaaaaaaaaaaaaaaaaaactcgaggggggccccggtcccaaattgcccttatagggggccttataacaatccatgtggccgcgtttaaaacttcgagactgggaaacccgtggtgtccccaattaaatcgcttggag

SEQ ID NO: 313403 - DNA, 3574 bp, Homo sapiens
  misc_feature (3558)..(3558): n is a, c, g, or t
  misc_feature (3566)..(3566): n is a, c, g, or t
ggcggcgctagcgcgagcctggccccgggcagcgctagggccgggctcctctcggcggcggcgcaccgtcgtcctgtcgtccgcggggcggggacgcggcggcggcggcggcggtggcggctgtgtgtcgccggagccgaagcgcgcaggcccgtcccggtggccggggagcgggcgggtgggggcgccatgtggttcatgtacctgctgagctggctgtcgctcttcatccaggtggccttcatcacgctggctgtcgcggctggactctattacctggcagaactgatagaagaatacacagtggccaccagcaggatcataaaatacatgatctggttctccaccgctgtactgattggcctctacgtctttgagcgcttccccaccagcatgattggagtgggcctattcaccaacctcgtctactttggcctcctccagaccttccccttcatcatgctgacctcgcctaacttcatcctgtcgtgtggactagtggtggtgaatcattacctagcatttcagttttttgcagaagaatattatcccttctcagaggtcctggcctatttcactttctgcctgtggataattccgtttgcgttttttgtgtcactttcggccggggagaacgtcctgccctctaccatgcagccaggagatgatgtcgtctccaattatttcaccaaaggcaagcggggcaaacgcttagggatcctggttgtcttctccttcatcaaagaggccattctacccagtcgtcagaagatatactgacccccatgcaggcaggatgtggggggcaagatcaggagagtcaggcccctgggcctctatgccaggtggggaccagaagtcgggaaggcacctaccacctgccctggctttcttcccctcaactctggagccccatccccaccctccttggggggctcagcttggctcagatctgatgcttcaagaggctgtaacctcagagggcaccaaggagggtggcagagcctgcttagccaggaggccgaggtccctcagtcctcccctgtcccttccaaggtgggtcaggaggttctggccccgctggggcaggcagggcagggtctgtgaagcttaagagcagatggtgacaagttctctgggcaggtggccatggggaggggccatggcttggcatgtccaacagaaatagtttttgctgttgaacggtgatttctgtccaagtgcagatttccgtttgaataaagcttcgcttctaggtggcactgtttgccttaataccctgacagttcatcttcctttcttcctgctaaccttctgctctggactggactcacttttctgctccagggactccttttctgggtttgggtcttgcccttcccaagggactgttcttgtggcccttaatgggaagggggcaggggtgaggagctgagcctgctcaaggagtgggaagtggggctataggcagcctctctgatgcactctcttccatctctttccccaaggctccgtgactgtcaaactgggagtaggagaggggacaatttaggactgggctagattttcagaagaacatctacaatatcctatttataaatcttcctctgggaaaaggagtggtttctggctgaatactatcttaggctcaaggagaaacaaaataaaaattagcttccaggcagcctgtttttaaagaaatgggactaatgggagaagctgtttgtcactctaagagcatccaagccctggcccgtctgtgcactcttggctcctggggagatatatctgccttctaagaaggcaggccaggtcttgggcacagacctgcatttgttgaccttgcactccaactatagtgccttgcaagtgctcaacagtacatattggaatgaagtccctatgagagccatttctggccatgttctatacctcaaagtgaggctggcaggtacagagatgaactgtacacatgtgatacatttaagccactggaaaaacccctgtgcttgaaaatatttcctctatatcatgcctggagttccatcatagcccttcatttccttggctttagcatttaccttctcttaagaataccagctttcccctttccctgagaggaagagcacatgttggtctcctcttagtgtgaacgagattgccaggcccttttctcctatgcacaccaggatagacaaggcaggggatactggcagcctgcatcatcctcccattgggctgacagctggccctactttcctccctctgctgcttggtccctcaccttgatgatgtggcttcgccccctccactctactgccagtgttctcccaggggttgctaaatccagcagacccctttcctgtcttactagatctgggcagcatttgacatggctgatcaccccttgcttcttggatggcacttccctggcacctctgtggctagttgtcctacctccctggctgttcctttcaggcttccgtgcaggcttctccacttgcccatgcacagtagggtctttcagggttctgctgtgggctccctagggaagcccatccatctggatggtttcaaggatggtgaggaatttagagttgacctccagccccaacatccttcctgatcacctgaaccacagttttgctgccctctaggtgcacagacaattcaggtccatggcccagatggtacttgctgtcttctgcaaacctgccccttctgggtacttcccttgaccccgagatcactcaggagccagacaggaaacttattctattcctgttttctctttctgcccaccacatccaatctctcaaaacggtcaggtctaccttaacatctcttgatttgagccactcccactgtcatcagctttcacctggattatcgtgacagcctcctactgcttctctatcatgtggccagagctatcttcctaaaatgcattgcatagttgatcaagtcactctctggcctaaaaccttccttggctccctgctgccctcaggataaagtctggacccctcagcatggcttgtgagactcatggtgtccttgtccctgctcacctctctggtctcatcacttgccttcttgcattctgggtcccagcctcctgtatccagagatgcagtggctctccattgccactctgattcctcctttcttttggtcacagagaaagggtactttctctgtcaaatctcaacttagacttgacttcctccaaggagctttggctatactctctcctcccgacccccaccctggcatactacacagatcactctgggctcacttgcctgcctaatggtcatctccccagtagactgtaagctccttgagggcaaggattgtgttggaatttttgtattaacagtgcctggcttggtgcctggcacctagaaagcactcaataaatgtttgtttaatgaaaaaaaaaaaaaaacaaaaaaaaaccaaaaaaaaaaaaaaaaaaaaaaaaaaaaaaaaaaacaaaaaaaaaaaaaaaaacaaaaaaaaaaaaaaaaaaaaaaaaaaaaaaaaaaaaaaaangggggggngcgaacaa

SEQ ID NO: 313404 - DNA, 2090 bp, Homo sapiens
agatatgtatacgagatgaactgtacacatgtgatacatttaagccactggaaaaaccctgtgcttgaaatatttcctctatatcatgcctggagttccatcacagcccatcatttccttggctttagcatttaccttctcttccatctctttccccaaggctccgtgactgtcaaactgggagtaggagaggggacaatttaggactgggctagattttcagaagaacatctacaatatcctatttataaatcttcctctgggaaaaggagtggtttctggctgaatactatcttaggctcaaggagaaacaaaataaaaattagcttccaggcagcctgtttttaaagaaatgggactaatgggagaagctgtttgtcactctaagagcatccaagccctggcccgtctgtgcactcttggctcctggggagatatatctgccttctaagaaggcaggccaggtcttgggcacagacctgcatttgttgaccttgcactccaactatagtgccttgcaagtgctcaacagtacatattggaatgaagtccctatgagagccatttctggccatgttctatacctcaaagtgaggctggcaggtacagagatgaactgtacacatgtgatacatttaagccactggaaaaacccctgtgcttgaaaatatttcctctatatcatgcctggagttccatcatagcccttcatttccttggctttagcatttaccttctcttaagaataccagctttcccctttccctgagaggaagagcacatgttggtctcctcttagtgtgaacgagattgccaggcccttttctcctatgcacaccaggatagacaaggcaggggatactggcagcctgcatcatcctcccattgggctgacagctggccctactttcctccctctgctgcttggtccctcaccttgatgatgtggcttcgccccctccactctactgccagtgttctcccaggggttgctaaatccagcagacccctttcctgtcttactagatctgggcagcatttgacatggctgatcaccccttgcttcttggatggcacttccctggcacctctgtggctagttgtcctacctccctggctgttcctttcaggcttccgtgcaggcttctccacttgcccatgcacagtagggtctttcagggttctgctgtgggctccctagggaagcccatccatctggatggtttcaaggatggtgaggaatttagagttgacctccagccccaacatccttcctgatcacctgaaccacagttttgctgccctctaggtgcacagacaattcaggtccatggcccagatggtacttgctgtcttctgcaaacctgccccttctgggtacttcccttgaccccgagatcactcaggagccagacaggaaacttattctattcctgttttctctttctgcccaccacatccaatctctcaaaacggtcaggtctaccttaacatctcttgatttgagccactcccactgtcatcagctttcacctggattatcgtgacagcctcctactgcttctctatcatgtggccagagctatcttcctaaaatgcattgcatagttgatcaagtcactctctggcctaaaaccttccttggctccctgctgccctcaggataaagtctggacccctcagcatggcttgtgagactcatggtgtccttgtccctgctcacctctctggtctcatcacttgccttcttgcattctgggtcccagcctcctgtatccagagatgcagtggctctccattgccactctgattcctcctttcttttggtcacagagaaagggtactttctctgtcaaatctcaacttagacttgacttcctccaaggagctttggctatactctctcctcccgacccccaccctggcatactacacagatcactctgggctcacttgcctgcctaatggtcatctccccagtagactgtaagctccttgagggcaaggattgtgttggaatttttgtattaacagtgcctggcttggtgcctggcacctagaaagcactcaataaatgtttgtttaatgaa

SEQ ID NO: 313405 - DNA, 3312 bp, Homo sapiens
ggcggcgctagcgcgagcctggccccgggcagcgctagggccgggctcctctcggcggcggcgcaccgtcgtcctgtcgtccgcggggcggggacgcggcggcggcggcggcggtggcggctgtgtgtcgccggagccgaagcgcgcaggcccgtcccggtggccggggagcgggcgggtgggggcgccatgtggttcatgtacctgctgagctggctgtcgctcttcatccaggtggccttcatcacgctggctgtcgcggctggactctattacctggcagaactgatagaagaatacacagtggccaccagcaggatcataaaatacatgatctggttctccaccgctgtactgattggcctctacgtctttgagcgcttccccaccagcatgattggagtgggcctattcaccaacctcgtctactttggcctcctccagaccttccccttcatcatgctgacctcgcctaacttcatcctgtcgtgtggactagtggtggtgaatcattacctagcatttcagttttttgcagaagaatattatcccttctcagaggtcctggcctatttcactttctgcctgtggataattccgtttgcgttttttgtgtcactttcggccggggagaacgtcctgccctctaccatgcagccaggagatgatgtcgtctccaattatttcaccaaaggcaagcggggcaaacgcttagggatcctggttgtcttctccttcatcaaagaggccattctacccagtcgtcagaagatatactgacccccatgcaggcaggatgtggggggcaagatcaggagagtcaggcccctgggcctctatgccaggtggggaccagaagtcgggaaggcacctaccacctgccctggctttcttcccctcaactctggagccccatccccaccctccttggggggctcagcttggctcagatctgatgcttcaagaggctgtaacctcagagggcaccaaggagggtggcagagcctgcttagccaggaggccgaggtccctcagtcctcccctgtcccttccaaggtgggtcaggaggttctggccccgctggggcaggcagggcagggtctgtgaagcttaagagcagatggtgacaagttctctgggcaggtggccatggggaggggccatggcttggcatgtccaacagaaatagtttttgctgttgaacggtgatttctgtccaagtgcagatttccgtttgaataaagcttcgcttctaggtggcactgtttgccttaataccctgacagttcatcttcctttcttcctgctaaccttctgctctggactggactcacttttctgctccagggactccttttctgggtttgggtcttgcccttcccaagggactgttcttgtggcccttaatgggaagggggcaggggtgaggagctgagcctgctcaaggagtgggaagtggggctataggcagcctctctgatgcactctcttccatctctttccccaaggctccgtgactgtcaaactgggagtaggagaggggacaatttaggactgggctagattttcagaagaacatctacaatatcctatttataaatcttcctctgggaaaaggagtggtttctggctgaatactatcttaggctcaaggagaaacaaaataaaaattagcttccaggcagcctgtttttaaagaaatgggactaatgggagaagctgtttgtcactctaagagcatccaagccctggcccgtctgtgcactcttggctcctggggagatatatctgccttctaagaaggcaggccaggtcttgggcacagacctgcatttgttgaccttgcactccaactatagtgccttgcaagtgctcaacagtacatattggaatgaagtccctatgagagccatttctggccatgttctatacctcaaagtgaggctggcaggtacagagatgaactgtacacatgtgatacatttaagccactggaaaaacccctgtgcttgaaaatatttcctctatatcatgcctggagttccatcatagcccttcatttccttggctttagcatttaccttctcttaagaataccagctttcccctttccctgagaggaagagcacatgttggtctcctcttagtgtgaacgagattgccaggcccttttctcctatgcacaccaggatagacaaggcaggggatactggcagcctgcatcatcctcccattgggctgacagctggccctactttcctccctctgctgcttggtccctcaccttgatgatgtggcttcgccccctccactctactgccagtgttctcccaggggttgctaaatccagcagacccctttcctgtcttactagatctgggcagcatttgacatggctgatcaccccttgcttcttggatggcacttccctggcacctctgtggctagttgtcctacctccctggctgttcctttcaggcttccgtgcaggcttctccacttgcccatgcacagtagggtctttcagggttctgctgtgggctccctagggaagcccatccatctggatggtttcaaggatggtgaggaatttagagttgacctccagccccaacatccttcctgatcacctgaaccacagttttgctgccctctaggtgcacagacaattcaggtccatggcccagatggtacttgctgtcttctgcaaacctgccccttctgggtacttcccttgaccccgagatcactcaggagccagacaggaaacttattctattcctgttttctctttctgcccaccacatccaatctctcaaaacggtcaggtctaccttaacatctcttgatttgagccactcccactgtcatcagctttcacctggattatcgtgacagcctcctactgcttctctatcatgtggccagagctatcttcctaaaatgcattgcatagttgatcaagtcactctctggcctaaaaccttccttggctccctgctgccctcaggataaagtctggacccctcagcatggcttgtgagactcatggtgtccttgtccctgctcacctctctggtctcatcacttgccttcttgcattctgggtcccagcctcctgtatccagagatgcagtggctctccattgccactctgattcctcctttcttttggtcacagagaaagggtactttctctgtcaaatctcaacttagacttgaggcaaggattgtgttggaatttttgtattaacagtgcctggcttggtgcctggcacctagaaagcactcaataaatgtttgtttaatgaa

SEQ ID NO: 313406 - DNA, 3514 bp, Homo sapiens
ggcggcgctagcgcgagcctggccccgggcagcgctagggccgggctcctctcggcggcggcgcaccgtcgtcctgtcgtccgcggggcggggacgcggcggcggcggcggcggtggcggctgtgtgtcgccggagccgaagcgcgcaggcccgtcccggtggccggggagcgggcgggtgggggcgccatgtggttcatgtacctgctgagctggctgtcgctcttcatccaggtggccttcatcacgctggctgtcgcggctggactctattacctggcagaactgatagaagaatacacagtggccaccagcaggatcataaaatacatgatctggttctccaccgctgtactgattggcctctacgtctttgagcgcttccccaccagcatgattggagtgggcctattcaccaacctcgtctactttggcctcctccagaccttccccttcatcatgctgacctcgcctaacttcatcctgtcgtgtggactagtggtggtgaatcattacctagcatttcagttttttgcagaagaatattatcccttctcagaggtcctggcctatttcactttctgcctgtggataattccgtttgcgttttttgtgtcactttcggccggggagaacgtcctgccctctaccatgcagccaggagatgatgtcgtctccaattatttcaccaaaggcaagcggggcaaacgcttagggatcctggttgtcttctccttcatcaaagaggccattctacccagtcgtcagaagatatactgacccccatgcaggcaggatgtggggggcaagatcaggagagtcaggcccctgggcctctatgccaggtggggaccagaagtcgggaaggcacctaccacctgccctggctttcttcccctcaactctggagccccatccccaccctccttggggggctcagcttggctcagatctgatgcttcaagaggctgtaacctcagagggcaccaaggagggtggcagagcctgcttagccaggaggccgaggtccctcagtcctcccctgtcccttccaaggtgggtcaggaggttctggccccgctggggcaggcagggcagggtctgtgaagcttaagagcagatggtgacaagttctctgggcaggtggccatggggaggggccatggcttggcatgtccaacagaaatagtttttgctgttgaacggtgatttctgtccaagtgcagatttccgtttgaataaagcttcgcttctaggtggcactgtttgccttaataccctgacagttcatcttcctttcttcctgctaaccttctgctctggactggactcacttttctgctccagggactccttttctgggtttgggtcttgcccttcccaagggactgttcttgtggcccttaatgggaagggggcaggggtgaggagctgagcctgctcaaggagtgggaagtggggctataggcagcctctctgatgcactctcttccatctctttccccaaggctccgtgactgtcaaactgggagtaggagaggggacaatttaggactgggctagattttcagaagaacatctacaatatcctatttataaatcttcctctgggaaaaggagtggtttctggctgaatactatcttaggctcaaggagaaacaaaataaaaattagcttccaggcagcctgtttttaaagaaatgggactaatgggagaagctgtttgtcactctaagagcatccaagccctggcccgtctgtgcactcttggctcctggggagatatatctgccttctaagaaggcaggccaggtcttgggcacagacctgcatttgttgaccttgcactccaactatagtgccttgcaagtgctcaacagtacatattggaatgaagtccctatgagagccatttctggccatgttctatacctcaaagtgaggctggcaggtacagagatgaactgtacacatgtgatacatttaagccactggaaaaacccctgtgcttgaaaatatttcctctatatcatgcctggagttccatcatagcccttcatttccttggctttagcatttaccttctcttaagaataccagctttcccctttccctgagaggaagagcacatgttggtctcctcttagtgtgaacgagattgccaggcccttttctcctatgcacaccaggatagacaaggcaggggatactggcagcctgcatcatcctcccattgggctgacagctggccctactttcctccctctgctgcttggtccctcaccttgatgatgtggcttcgccccctccactctactgccagtgttctcccaggggttgctaaatccagcagacccctttcctgtcttactagatctgggcagcatttgacatggctgatcaccccttgcttcttggatggcacttccctggcacctctgtggctagttgtcctacctccctggctgttcctttcaggcttccgtgcaggcttctccacttgcccatgcacagtagggtctttcagggttctgctgtgggctccctagggaagcccatccatctggatggtttcaaggatggtgaggaatttagagttgacctccagccccaacatccttcctgatcacctgaaccacagttttgctgccctctaggtgcacagacaattcaggtccatggcccagatggtacttgctgtcttctgcaaacctgccccttctgggtacttcccttgaccccgagatcactcaggagccagacaggaaacttattctattcctgttttctctttctgcccaccacatccaatctctcaaaacggtcaggtctaccttaacatctcttgatttgagccactcccactgtcatcagctttcacctggattatcgtgacagcctcctactgcttctctatcatgtggccagagctatcttcctaaaatgcattgcatagttgatcaagtcactctctggcctaaaaccttccttggctccctgctgccctctctggtctcatcacttgccttcttgcattctgggtcccagcctcctgtatccagagatgcagtggctctccattgccactctgattcctcctttcttttggtcacagagaaagggtactttctctgtcaaatctcaacttagacttgacttcctccaaggagctttggctatactctctcctcccgacccccaccctggcatactacacagatcactctgggctcacttgcctgcctaatggtcatctccccagtagactgtaagctccttgagggcaaggattgtgttggaatttttgtattaacagtgcctggcttggtgcctggcacctagaaagcactcaataaatgtttgtttaatgaaaaaaaaaaaaaaaaaaaaaaaaactcgaggggggccccggtcccaaattgcccttatagggggccttataacaatccatgtggccgcgtttaaaacttcgagactgggaaacccgtggtgtccccaattaaatcgcttggag

SEQ ID NO: 313407 - DNA, 1980 bp, Homo sapiens
tatttgactgaagtgggagaaggctacgagttttttgtgtcattttgtgtaagggcgcagactgctgcgaacagagtggtgatagcgcctaagcatagtgttagagtttggattagtgggctattttctgctagggggtggaagcggatgagtaagaagattcctgctacaactatagtgcttaagcggatcagcgctgatccgcttaagcctgaccccgtacacagctctccctgggatgctggaggctgctgtgcacgccccaggtaactcagatgtcaccaggacatgatgtgccactcaggtcccaaagcccttggtgtcctatggtcaggtattcgaattccactaagcccagggataagccaagagctgcttcctgaatgaagagttacctgcaggaggaggcgtggtctttctctagaacctccagttctgcacagtgaatcttttggagcttgtgaaaacctgcataaaataatacactgcatttggaacatagatgctcttacattcgttgatttcttatttttttttttccccttaagcggatcagcatatttcctctatatcatgcctggagttccatcatagcccttcatttccttggctttagcatttaccttctcttaagaataccagctttcccctttccctgagaggaagagcacatgttggtctcctcttagtgtgaacgagattgccaggcccttttctcctatgcacaccaggatagacaaggcaggggatactggcagcctgcatcatcctcccattgggctgacagctggccctactttcctccctctgctgcttggtccctcaccttgatgatgtggcttcgccccctccactctactgccagtgttctcccaggggttgctaaatccagcagacccctttcctgtcttactagatctgggcagcatttgacatggctgatcaccccttgcttcttggatggcacttccctggcacctctgtggctagttgtcctacctccctggctgttcctttcaggcttccgtgcaggcttctccacttgcccatgcacagtagggtctttcagggttctgctgtgggctccctagggaagcccatccatctggatggtttcaaggatggtgaggaatttagagttgacctccagccccaacatccttcctgatcacctgaaccacagttttgctgccctctaggtgcacagacaattcaggtccatggcccagatggtacttgctgtcttctgcaaacctgccccttctgggtacttcccttgaccccgagatcactcaggagccagacaggaaacttattctattcctgttttctctttctgcccaccacatccaatctctcaaaacggtcaggtctaccttaacatctcttgatttgagccactcccactgtcatcagctttcacctggattatcgtgacagcctcctactgcttctctatcatgtggccagagctatcttcctaaaatgcattgcatagttgatcaagtcactctctggcctaaaaccttccttggctccctgctgccctcaggataaagtctggacccctcagcatggcttgtgagactcatggtgtccttgtccctgctcacctctctggtctcatcacttgccttcttgcattctgggtcccagcctcctgtatccagagatgcagtggctctccattgccactctgattcctcctttcttttggtcacagagaaagggtactttctctgtcaaatctcaacttagacttgacttcctccaaggagctttggctatactctctcctcccgacccccaccctggcatactacacagatcactctgggctcacttgcctgcctaatggtcatctccccagtagactgtaagctccttgagggcaaggattgtgttggaatttttgtattaacagtgcctggcttggtgcctggcacctagaaagcactcaataaatgtttgtttaatgaa

SEQ ID NO: 313408 - DNA, 1865 bp, Homo sapiens
  misc_feature (1288)..(1288): n is a, c, g, or t
ggcggcgctagcgcgagcctggccccgggcagcgctagggccgggctcctctcggcggcggcgcaccgtcgtcctgtcgtccgcggggcggggacgcggcggcggcggcggcggtggcggctgtgtgtcgccggagccgaagcgcgcaggcccgtcccggtggccggggagcgggcgggtgggggcgccatgtggttcatgtacctgctgagctggctgtcgctcttcatccaggtggccttcatcacgctggctgtcgcggctggactctattacctggcagaactgatagaagaatacacagtggccaccagcaggatcataaaatacatgatctggttctccaccgctgtactgattggcctctacgtctttgagcgcttccccaccagcatgattggagtgggcctattcaccaacctcgtctactttggcctcctccagaccttccccttcatcatgctgacctcgcctaacttcatcctgtcgtgtggactagtggtggtgaatcattacctagcatttcagttttttgcagaagaatattatcccttctcagaggtcctggcctatttcactttctgcctgtggataattccgtttgcgttttttgtgtcactttcggccggggagaacgtcctgccctctaccatgcagccaggagatgatgtcgtctccaattatttcaccaaaggcaagcggggcaaacgcttagggatcctggttgtcttctccttcatcaaagaggccattctacccagtcgtcagaagatatactgacccccatgcaggcaggatgtggggggcaagatcaggagagtcaggcccctgggcctctatgccaggtggggaccagaagtcgggaaggcacctaccacctgccctggctttcttcccctcaactctggagccccatccccaccctccttggggggctcagcttggctcagatctgatgcttcaagaggctgtaacctcagagggcaccaaggagggtggcagagcctgcttagccaggaggccgaggtccctcagtcctcccctgtcccttccaaggtgggtcaggaggttctggccccgctggggcaggcagggcagggtctgtgaagcttaagagcagatggtgacaagttctctgggcaggtggccatggggaggggccatggcttggcatgtccaacagaaatagtttttgctgttgaacggtgatttctgtccaagtgcagatttccgtttgaataaagcttcgcttctaggtgggccacaaaaaaaaaatcatttatacgcngcccgcattcggggtcacttggcacattggcctatagggagtcgtatacaattcaatggccgcgggttacaacgcggggccgggaaaccctgcggtaccaacttaatgcctttgagacattcccttttccagttgcggaatacgaaaggccccgaccgttggccttccaacgttgccaacctgaggggaaggaaatgtagcgtaatattggtaaattcgcgtaattctgtaacccgcatttttacccaagccgcaatggaaaaccttttatcaacgaaatcccgcttaggctttaaggtgttcattggcgggcactttcgcgttcaccgcgaagggcgatacgcgcttctgggctggccctcgggactacctcttaacattcttcgtgcagggctccaggcctaattggccctcggggctctttctaactttcgttatattccttcacgccacgttcgctctacgacagactctccgctatcgagactgcctctctgcctcactctcttcttcgcttctctcactagcctagctgtttcttctcttctgcgcgctatctctcgctctattatccccg

SEQ ID NO: 313409 - DNA, 391 bp, Homo sapiens
agcccatgacccctaaccggggccctctcagccctcctaatgacctcccagccattctgggtcccagcctcctgtatccagagatgcagtggctctccattgccactctgattcctcctttcttttggtcacagagaaagggtactttctctgtcaaatctcaacttagacttgacttcctccaaggagctttggctatactctctcctcccgacccccaccctggcatactacacagatcactctgggctcacttgcctgcctaatggtcatctccccagtagactgtaagctccttgagggcaaggattgtgttggaatttttgtattaacagtgcctggcttggtgcctggcacctagaaagcactcaataaatgtttgtttaatgaa

SEQ ID NO: 313410 - DNA, 496 bp, Homo sapiens
tgccgcccccgcgtctgcggaccgctaaccgctgcggctcccactcttcgcgggcctgccgcgcggaacttttccccaacgcctaccgccgcctttgcgcctctggcccttcatgctccctgctctctccacctttgacacttctcctctggctggttcccattcggcctcagttgagatgtcatcttttccgggaagtccacaggggttgatggtccagcagtgccctgtcctttccctaaagtagcatttctcacactaaactcgtctgtctctccctactgttccccttccctttcccaagctgggtcagggaaggacccttgtctgtctttttcagctgtattctcagcccagggacctggctcatgccaagtgcccagcaggtgtttattgaatacgtgaaattccgttttctgagccagaggttatcattgtactgtggcatcaaatgcagactttcgttgatttttatgagatttgtccttagttgccc

SEQ ID NO: 313411 - DNA, 3278 bp, Homo sapiens
ttgcgcctctggcccttcatgctccctgctctctccacctttgacacttctcctctggctggttcccattcggcctcagttgagatgtcatcttttccgcggctggactctattacctggcagaactgatagaagaatacacagtggccaccagcaggatcataaaatacatgatctggttctccaccgctgtactgattggcctctacgtctttgagcgcttccccaccagcatgattggagtgggcctattcaccaacctcgtctactttggcctcctccagaccttccccttcatcatgctgacctcgcctaacttcatcctgtcgtgtggactagtggtggtgaatcattacctagcatttcagttttttgcagaagaatattatcccttctcagaggtcctggcctatttcactttctgcctgtggataattccgtttgcgttttttgtgtcactttcggccggggagaacgtcctgccctctaccatgcagccaggagatgatgtcgtctccaattatttcaccaaaggcaagcggggcaaacgcttagggatcctggttgtcttctccttcatcaaagaggccattctacccagtcgtcagaagatatactgacccccatgcaggcaggatgtggggggcaagatcaggagagtcaggcccctgggcctctatgccaggtggggaccagaagtcgggaaggcacctaccacctgccctggctttcttcccctcaactctggagccccatccccaccctccttggggggctcagcttggctcagatctgatgcttcaagaggctgtaacctcagagggcaccaaggagggtggcagagcctgcttagccaggaggccgaggtccctcagtcctcccctgtcccttccaaggtgggtcaggaggttctggccccgctggggcaggcagggcagggtctgtgaagcttaagagcagatggtgacaagttctctgggcaggtggccatggggaggggccatggcttggcatgtccaacagaaatagtttttgctgttgaacggtgatttctgtccaagtgcagatttccgtttgaataaagcttcgcttctaggtggcactgtttgccttaataccctgacagttcatcttcctttcttcctgctaaccttctgctctggactggactcacttttctgctccagggactccttttctgggtttgggtcttgcccttcccaagggactgttcttgtggcccttaatgggaagggggcaggggtgaggagctgagcctgctcaaggagtgggaagtggggctataggcagcctctctgatgcactctcttccatctctttccccaaggctccgtgactgtcaaactgggagtaggagaggggacaatttaggactgggctagattttcagaagaacatctacaatatcctatttataaatcttcctctgggaaaaggagtggtttctggctgaatactatcttaggctcaaggagaaacaaaataaaaattagcttccaggcagcctgtttttaaagaaatgggactaatgggagaagctgtttgtcactctaagagcatccaagccctggcccgtctgtgcactcttggctcctggggagatatatctgccttctaagaaggcaggccaggtcttgggcacagacctgcatttgttgaccttgcactccaactatagtgccttgcaagtgctcaacagtacatattggaatgaagtccctatgagagccatttctggccatgttctatacctcaaagtgaggctggcaggtacagagatgaactgtacacatgtgatacatttaagccactggaaaaacccctgtgcttgaaaatatttcctctatatcatgcctggagttccatcatagcccttcatttccttggctttagcatttaccttctcttaagaataccagctttcccctttccctgagaggaagagcacatgttggtctcctcttagtgtgaacgagattgccaggcccttttctcctatgcacaccaggatagacaaggcaggggatactggcagcctgcatcatcctcccattgggctgacagctggccctactttcctccctctgctgcttggtccctcaccttgatgatgtggcttcgccccctccactctactgccagtgttctcccaggggttgctaaatccagcagacccctttcctgtcttactagatctgggcagcatttgacatggctgatcaccccttgcttcttggatggcacttccctggcacctctgtggctagttgtcctacctccctggctgttcctttcaggcttccgtgcaggcttctccacttgcccatgcacagtagggtctttcagggttctgctgtgggctccctagggaagcccatccatctggatggtttcaaggatggtgaggaatttagagttgacctccagccccaacatccttcctgatcacctgaaccacagttttgctgccctctaggtgcacagacaattcaggtccatggcccagatggtacttgctgtcttctgcaaacctgccccttctgggtacttcccttgaccccgagatcactcaggagccagacaggaaacttattctattcctgttttctctttctgcccaccacatccaatctctcaaaacggtcaggtctaccttaacatctcttgatttgagccactcccactgtcatcagctttcacctggattatcgtgacagcctcctactgcttctctatcatgtggccagagctatcttcctaaaatgcattgcatagttgatcaagtcactctctggcctaaaaccttccttggctccctgctgccctcaggataaagtctggacccctcagcatggcttgtgagactcatggtgtccttgtccctgctcacctctctggtctcatcacttgccttcttgcattctgggtcccagcctcctgtatccagagatgcagtggctctccattgccactctgattcctcctttcttttggtcacagagaaagggtactttctctgtcaaatctcaacttagacttgacttcctccaaggagctttggctatactctctcctcccgacccccaccctggcatactacacagatcactctgggctcacttgcctgcctaatggtcatctccccagtagactgtaagctccttgagggcaaggattgtgttggaatttttgtattaacagtgcctggcttggtgcctggcacctagaaagcactcaataaatgtttgtttaatgaa

SEQ ID NO: 313412 - DNA, 3311 bp, Homo sapiens
ggcggcgctagcgcgagcctggccccgggcagcgctagggccgggctcctctcggcggcggcgcaccgtcgtcctgtcgtccgcggggcggggacgcggcggcggcggcggcggtggcggctgtgtgtcgccggagccgaagcgcgcaggcccgtcccggtggccggggagcgggcgggtgggggcgccatgtggttcatgtacctgctgagctggctgtcgctcttcatccaggtggccttcatcacgctggctgtcgcggctggactctattacctggcagaactgatagaagaatacacagtggccaccagcaggatcataaaatacatgatctggttctccaccgctgtactgattggcctctacgtctttgagcgcttccccaccagcatgattggagtgggcctattcaccaacctcgtctactttggcctcctccagaccttccccttcatcatgctgacctcgcctaacttcatcctgtcgtgtggactagtggtggtgaatcattacctagcatttcagttttttgcagaagaatattatcccttctcagaggtcctggcctatttcactttctgcctgtggataattccgtttgcgttttttgtgtcactttcggccggggagaacgtcctgccctctaccatgcagccaggagatgatgtcgtctccaattatttcaccaaaggcaagcggggcaaacgcttagggatcctggttgtcttctccttcatcaaagaggccattctacccagtcgtcagaagatatactgacccccatgcaggcaggatgtggggggcaagatcaggagagtcaggcccctgggcctctatgccaggtggggaccagaagtcgggaaggcacctaccacctgcttagccaggaggccgaggtccctcagtcctcccctgtcccttccaaggtgggtcaggaggttctggccccgctggggcaggcagggcagggtctgtgaagcttaagagcagatggtgacaagttctctgggcaggtggccatggggaggggccatggcttggcatgtccaacagaaatagtttttgctgttgaacggtgatttctgtccaagtgcagatttccgtttgaataaagcttcgcttctaggtggcactgtttgccttaataccctgacagttcatcttcctttcttcctgctaaccttctgctctggactggactcacttttctgctccagggactccttttctgggtttgggtcttgcccttcccaagggactgttcttgtggcccttaatgggaagggggcaggggtgaggagctgagcctgctcaaggagtgggaagtggggctataggcagcctctctgatgcactctcttccatctctttccccaaggctccgtgactgtcaaactgggagtaggagaggggacaatttaggactgggctagattttcagaagaacatctacaatatcctatttataaatcttcctctgggaaaaggagtggtttctggctgaatactatcttaggctcaaggagaaacaaaataaaaattagcttccaggcagcctgtttttaaagaaatgggactaatgggagaagctgtttgtcactctaagagcatccaagccctggcccgtctgtgcactcttggctcctggggagatatatctgccttctaagaaggcaggccaggtcttgggcacagacctgcatttgttgaccttgcactccaactatagtgccttgcaagtgctcaacagtacatattggaatgaagtccctatgagagccatttctggccatgttctatacctcaaagtgaggctggcaggtacagagatgaactgtacacatgtgatacatttaagccactggaaaaacccctgtgcttgaaaatatttcctctatatcatgcctggagttccatcatagcccttcatttccttggctttagcatttaccttctcttaagaataccagctttcccctttccctgagaggaagagcacatgttggtctcctcttagtgtgaacgagattgccaggcccttttctcctatgcacaccaggatagacaaggcaggggatactggcagcctgcatcatcctcccattgggctgacagctggccctactttcctccctctgctgcttggtccctcaccttgatgatgtggcttcgccccctccactctactgccagtgttctcccaggggttgctaaatccagcagacccctttcctgtcttactagatctgggcagcatttgacatggctgatcaccccttgcttcttggatggcacttccctggcacctctgtggctagttgtcctacctccctggctgttcctttcaggcttccgtgcaggcttctccacttgcccatgcacagtagggtctttcagggttctgctgtgggctccctagggaagcccatccatctggatggtttcaaggatggtgaggaatttagagttgacctccagccccaacatccttcctgatcacctgaaccacagttttgctgccctctaggtgcacagacaattcaggtccatggcccagatggtacttgctgtcttctgcaaacctgccccttctgggtacttcccttgaccccgagatcactcaggagccagacaggaaacttattctattcctgttttctctttctgcccaccacatccaatctctcaaaacggtcaggtctaccttaacatctcttgatttgagccactcccactgtcatcagctttcacctggattatcgtgacagcctcctactgcttctctatcatgtggccagagctatcttcctaaaatgcattgcatagttgatcaagtcactctctggcctaaaaccttccttggctccctgctgccctcaggataaagtctggacccctcagcatggcttgtgagactcatggtgtccttgtccctgctcacctctctggtctcatcacttgccttcttgcattctgggtcccagcctcctgtatccagagatgcagtggctctccattgccactctgattcctcctttcttttggtcacagagaaagggtactttctctgtcaaatctcaacttagacttgacttcctccaaggagctttggctatactctctcctcccgacccccaccctggcatactacacagatcactctgggctcacttgcctgcctaatggtcatctccccagtagactgtaagctccttgagggcaaggattgtgttggaatttttgtattaacagtgcctggcttggtgcctggcacctagaaagcactcaataaatgtttgtttaatgaa

SEQ ID NO: 313413 - DNA, 3515 bp, Homo sapiens
  misc_feature (3499)..(3499): n is a, c, g, or t
  misc_feature (3507)..(3507): n is a, c, g, or t
ggcggcgctagcgcgagcctggccccgggcagcgctagggccgggctcctctcggcggcggcgcaccgtcgtcctgtcgtccgcggggcggggacgcggcggcggcggcggcggtggcggctgtgtgtcgccggagccgaagcgcgcaggcccgtcccggtggccggggagcgggcgggtgggggcgccatgtggttcatgtacctgctgagctggctgtcgctcttcatccaggtggccttcatcacgctggctgtcgcggctggactctattacctggcagaactgatagaagaatacacagtggccaccagcaggatcataaaatacatgatctggttctccaccgctgtactgattggcctctacgtctttgagcgcttccccaccagcatgattggagtgggcctattcaccaacctcgtctactttggcctcctccagaccttccccttcatcatgctgacctcgcctaacttcatcctgtcgtgtggactagtggtggtgaatcattacctagcatttcagttttttgcagaagaatattatcccttctcagaggtcctggcctatttcactttctgcctgtggataattccgtttgcgttttttgtgtcactttcggccggggagaacgtcctgccctctaccatgcagccaggagatgatgtcgtctccaattatttcaccaaaggcaagcggggcaaacgcttagggatcctggttgtcttctccttcatcaaagaggccattctacccagtcgtcagaagatatactgacccccatgcaggcaggatgtggggggcaagatcaggagagtcaggcccctgggcctctatgccaggtggggaccagaagtcgggaaggcacctaccacctgccctggctttcttcccctcaactctggagccccatccccaccctccttggggggctcagcttggctcagatctgatgcttcaagaggctgtaacctcagagggcaccaaggagggtggcagagcctgcttagccaggaggccgaggtccctcagtcctcccctgtcccttccaaggtgggtcaggaggttctggccccgctggggcaggcagggcagggtctgtgaagcttaagagcagatggtgacaagttctctgggcaggtggccatggggaggggccatggcttggcatgtccaacagaaatagtttttgctgttgaacggtgatttctgtccaagtgcagatttccgtttgaataaagcttcgcttctaggtggcactgtttgccttaataccctgacagttcatcttcctttcttcctgctaaccttctgctctggactggactcacttttctgctccagggactccttttctgggtttgggtcttgcccttcccaagggactgttcttgtggcccttaatgggaagggggcaggggtgaggagctgagcctgctcaaggagtgggaagtggggctataggcagcctctctgatgcactctcttccatctctttccccaaggctccgtgactgtcaaactgggagtaggagaggggacaatttaggactgggctagattttcagaagaacatctacaatatcctatttataaatcttcctctgggaaaaggagtggtttctggctgaatactatcttaggctcaaggagaaacaaaataaaaattagcttccaggcagcctgtttttaaagaaatgggactaatgggagaagctgtttgtcactctaagagcatccaagccctggcccgtctgtgcactcttggctcctggggagatatatctgccttctaagaaggcaggccaggtcttgggcacagacctgcatttgttgaccttgcactccaactatagtgccttgcaagtgctcaacagtacatattggaatgaagtccctatgagagccatttctggccatgttctatacctcaaagtgaggctggcaggtacagagatgaactgtacacatgtgatacatttaagccactggaaaaacccctgtgcttgaaaatatttcctctatatcatgcctggagttccatcatagcccttcatttccttggctttagcatttaccttctcttaagaataccagctttcccctttccctgagaggaagagcacatgttggtctcctcttagtgtgaacgagattgccaggcccttttctcctatgcacaccaggatagacaaggcaggggatactggcagcctgcatcatcctcccattgggctgacagctggccctactttcctccctctgctgcttggtccctcaccttgatgatgtggcttcgccccctccactctactgccagtgttctcccaggggttgctaaatccagcagacccctttcctgtcttactagatctgggcagcatttgacatggctgatcaccccttgcttcttggatggcacttccctggcacctctgtggctagttgtcctacctccctggctgttcctttcaggcttccgtgcaggcttctccacttgcccatgcacagtagggtctttcagggttctgctgtgggctccctagggaagcccatccatctggatggtttcaaggatggtgaggaatttagagttgacctccagccccaacatccttcctgatcacctgaaccacagttttgctgccctctaggtgcacagacaattcaggtccatggcccagatggtacttgctgtcttctgcaaacctgccccttctgggtacttcccttgaccccgagatcactcaggagccagacaggaaacttattctattcctgttttctctttctgcccaccacatccaatctctcaaaacggtcaggtctaccttaacatctcttgatttgagccactcccactgtcatcagctttcacctggattatcgtgacagcctcctactgcttctctatcatgtggccagagctatcttcctaaaatgcattgcatagttgatcaagtcactctctggcctaaaaccttccttggctccctgctgccctcaggataaagtctggacccctcagcatggcttgtgagactcatggtgtccttgtccctgctcacctctctggtctcatcacttgccttcttgcattctgggtcccagcctcctgtatccagagatgcagtggctctccattgccactctgattcctcctttcttttggtcacagagaaagggtactttctctgtcaaatctcaacttagacttgacttcctccaaggagctttggctatactctctcctcccgacccccaccctggcatactacacagatcactctgggctcacttgcctgcctaatggtcatctccccagtagactgtaagctccttgagggcaaggattgtgttggaatttttgtattaacagtgcctggcttggtgcctggcacctagaaagcactcaataaatgtttgtttaatgaaaaaaaaaaaaaaaaaaaaaaaaaaaaaaaaaaaaaaaaaaaaaaaaaaaaaaaaaaaaaangggggggngcgaacaa

SEQ ID NO: 313414 - DNA, 3298 bp, Homo sapiens
ggcggcgctagcgcgagcctggccccgggcagcgctagggccgggctcctctcggcggcggcgcaccgtcgtcctgtcgtccgcggggcggggacgcggcggcggcggcggcggtggcggctgtgtgtcgccggagccgaagcgcgcaggcccgtcccggtggccggggagcgggcgggtgggggcgccatgtggttcatgtacctgctgagctggctgtcgctcttcatccaggtggccttcatcacgctggctgtcgcggctggactctattacctggcagaactgatagaagaatacacagtggccaccagcaggatcataaaatacatgatctggttctccaccgctgtactgattggcctctacgtctttgagcgcttccccaccagcatgattggagtgggcctattcaccaacctcgtctactttggcctcctccagaccttccccttcatcatgctgacctcgcctaacttcatcctgtcgtgtggactagtggtggtgaatcattacctagcatttcagttttttgcagaagaatattatcccttctcagaggtcctggcctatttcactttctgcctgtggataattccgtttgcgttttttgtgtcactttcggccggggagaacgtcctgccctctaccatgcagccaggagatgatgtcgtctccaattatttcaccaaaggcaagcggggcaaacgcttagggatcctggttgtcttctccttcatcaaagaggccattctacccagtcgtcagaagatatactgacccccatgcaggcaggatgtggggggcaagatcaggagagtcaggcccctgggcctctatgccaggtggggaccagaagtcgggaaggcacctaccacctgccctggctttcttcccctcaactctggagccccatccccaccctccttggggggctcagcttggctcagatctgatgcttcaagaggctgtaacctcagagggcaccaaggagggtggcagagcctgcttagccaggaggccgaggtccctcagtcctcccctgtcccttccaaggtgggtcaggaggttctggccccgctggggcaggcagggcagggtctgtgaagcttaagagcagatggtgacaagttctctgggcaggtggccatggggaggggccatggcttggcatgtccaacagaaatagtttttgctgttgaacggtgatttctgtccaagtgcagatttccgtttgaataaagcttcgcttctaggtggcactgtttgccttaataccctgacagttcatcttcctttcttcctgctaaccttctgctctggactggactcacttttctgctccagggactccttttctgggtttgggtcttgcccttcccaagggactgttcttgtggcccttaatgggaagggggcaggggtgaggagctgagcctgctcaaggagtgggaagtggggctataggcagcctctctgatgcactctcttccatctctttccccaaggctccgtgactgtcaaactgggagtaggagaggggacaatttaggactgggctagattttcagaagaacatctacaatatcctatttataaatcttcctctgggaaaaggagtggtttctggctgaatactatcttaggctcaaggagaaacaaaataaaaattagcttccagacagacctgcatttgttgaccttgcactccaactatagtgccttgcaagtgctcaacagtacatattggaatgaagtccctatgagagccatttctggccatgttctatacctcaaagtgaggctggcaggtacagagatgaactgtacacatgtgatacatttaagccactggaaaaacccctgtgcttgaaaatatttcctctatatcatgcctggagttccatcatagcccttcatttccttggctttagcatttaccttctcttaagaataccagctttcccctttccctgagaggaagagcacatgttggtctcctcttagtgtgaacgagattgccaggcccttttctcctatgcacaccaggatagacaaggcaggggatactggcagcctgcatcatcctcccattgggctgacagctggccctactttcctccctctgctgcttggtccctcaccttgatgatgtggcttcgccccctccactctactgccagtgttctcccaggggttgctaaatccagcagacccctttcctgtcttactagatctgggcagcatttgacatggctgatcaccccttgcttcttggatggcacttccctggcacctctgtggctagttgtcctacctccctggctgttcctttcaggcttccgtgcaggcttctccacttgcccatgcacagtagggtctttcagggttctgctgtgggctccctagggaagcccatccatctggatggtttcaaggatggtgaggaatttagagttgacctccagccccaacatccttcctgatcacctgaaccacagttttgctgccctctaggtgcacagacaattcaggtccatggcccagatggtacttgctgtcttctgcaaacctgccccttctgggtacttcccttgaccccgagatcactcaggagccagacaggaaacttattctattcctgttttctctttctgcccaccacatccaatctctcaaaacggtcaggtctaccttaacatctcttgatttgagccactcccactgtcatcagctttcacctggattatcgtgacagcctcctactgcttctctatcatgtggccagagctatcttcctaaaatgcattgcatagttgatcaagtcactctctggcctaaaaccttccttggctccctgctgccctcaggataaagtctggacccctcagcatggcttgtgagactcatggtgtccttgtccctgctcacctctctggtctcatcacttgccttcttgcattctgggtcccagcctcctgtatccagagatgcagtggctctccattgccactctgattcctcctttcttttggtcacagagaaagggtactttctctgtcaaatctcaacttagacttgacttcctccaaggagctttggctatactctctcctcccgacccccaccctggcatactacacagatcactctgggctcacttgcctgcctaatggtcatctccccagtagactgtaagctccttgagggcaaggattgtgttggaatttttgtattaacagtgcctggcttggtgcctggcacctagaaagcactcaataaatgtttgtttaatgaa

SEQ ID NO: 313415 - DNA, 3372 bp, Homo sapiens
ggcggcgctagcgcgagcctggccccgggcagcgctagggccgggctcctctcggcggcggcgcaccgtcgtcctgtcgtccgcggggcggggacgcggcggcggcggcggcggtggcggctgtgtgtcgccggagccgaagcgcgcaggcccgtcccggtggccggggagcgggcgggtgggggcgccatgtggttcatgtacctgctgagctggctgtcgctcttcatccaggtggccttcatcacgctggctgtcgcggctggactctattacctggcagaactgatagaagaatacacagtggccaccagcaggatcataaaatacatgatctggttctccaccgctgtactgattggcctctacgtctttgagcgcttccccaccagcatgattggagtgggcctattcaccaacctcgtctactttggcctcctccagaccttccccttcatcatgctgacctcgcctaacttcatcctgtcgtgtggactagtggtggtgaatcattacctagcatttcagttttttgcagaagaatattatcccttctcagaggtcctggcctatttcactttctgcctgtggataattccgtttgcgttttttgtgtcactttcggccggggagaacgtcctgccctctaccatgcagccaggagatgatgtcgtctccaattatttcaccaaaggcaagcggggcaaacgcttagggatcctggttgtcttctccttcatcaaagaggccattctacccagtcgtcagaagatatactgacccccatgcaggcaggatgtggggggcaagatcaggagagtcaggcccctgggcctctatgccaggtggggaccagaagtcgggaaggcacctaccacctgccctggctttcttcccctcaactctggagccccatccccaccctccttggggggctcagcttggctcagatctgatgcttcaagaggctgtaacctcagagggcaccaaggagggtggcagagcctgcttagccaggaggccgaggtccctcagtcctcccctgtcccttccaaggtgggtcaggaggttctggccccgctggggcaggcagggcagggtctgtgaagcttaagagcagatggtgacaagttctctgggcaggtggccatggggaggggccatggcttggcatgtccaacagaaatagtttttgctgttgaacggtgatttctgtccaagtgcagatttccgtttgaataaagcttcgcttctaggtggcactgtttgccttaataccctgacagttcatcttcctttcttcctgctaaccttctgctctggactggactcacttttctgctccagggactccttttctgggtttgggtcttgcccttcccaagggactgttcttgtggcccttaatgggaagggggcaggggtgaggagctgagcctgctcaaggagtgggaagtggggctataggcagcctctctgatgcactctcttccatctctttccccaaggctccgtgactgtcaaactgggagtaggagaggggacaatttaggactgggctagattttcagaagaacatctacaatatcctatttataaatcttcctctgggaaaaggagtggtttctggctgaatactatcttaggctcaaggagaaacaaaataaaaattagcttccaggcagcctgtttttaaagaaatgggactaatgggagaagctgtttgtcactctaagagcatccaagccctggcccgtctgtgcactcttggctcctggggagatatatctgccttctaagaaggcaggccaggtcttgggcacagacctgcatttgttgaccttgcactccaactatagtgccttgcaagtgctcaacagtacatattggaatgaagtccctatgagagccatttctggccatgttctatacctcaaagtgaggctggcaggtacagagatgaactgtacacatgtgatacatttaagccactggaaaaacccctgtgcttgaaaatatttcctctatatcatgcctggagttccatcatagcccttcatttccttggctttagcatttaccttctcttaagaataccagctttcccctttccctgagaggaagagcacatgttggtctcctcttagtgtgaacgagattgccaggcccttttctcctatgcacaccaggatagacaaggcaggggatactggcagcctgcatcatcctcccattgggctgacagctggccctactttcctccctctgctgcttggtccctcaccttgatgatgtggcttcgccccctccactctactgccagtgttctcccaggggttgctaaatccagcagacccctttcctgtcttactagatctgggcagcatttgacatggctgatcaccccttgcttcttggatggcacttccctggcacctctgtggctagttgtcctacctccctggctgttcctttcaggcttccgtgcaggcttctccacttgcccatgcacagtagggtctttcagggttctgctgtgggctccctagggaagcccatccatctggatggtttcaaggatggtgaggaatttagagttgacctccagccccaacatccttcctgatcacctgaaccacagttttgctgccctctaggtgcacagacaattcaggtccatggcccagatggtacttgctgtcttctgcaaacctgccccttctgggtacttcccttgaccccgagatcactcaggagccagacaggaaacttattctattcctgttttctctttctgcccaccacatccaatctctcaaaacggtcaggtctaccttaacatctcttgatttgagccactcccactgtcatcagctttcacctggattatcgtgacagcctcctactgcttctctatcatgtggccagagctatcttcctaaaatgcattgcatagttgatcaagtcactctctggcctaaaaccttccttggctccctgctgccctctctggtctcatcacttgccttcttgcattctgggtcccagcctcctgtatccagagatgcagtggctctccattgccactctgattcctcctttcttttggtcacagagaaagggtactttctctgtcaaatctcaacttagacttgacttcctccaaggagctttggctatactctctcctcccgacccccaccctggcatactacacagatcactctgggctcacttgcctgcctaatggtcatctccccagtagactgtaagctccttgagggcaaggattgtgttggaatttttgtattaacagtgcctggcttggtgcctggcacctagaaagcactcaataaatgtttgtttaatgaa

SEQ ID NO: 313416 - DNA, 1523 bp, Homo sapiens
ggcggcgctagcgcgagcctggccccgggcagcgctagggccgggctcctctcggcggcggcgcaccgtcgtcctgtcgtccgcggggcggggacgcggcggcggcggcggcggtggcggctgtgtgtcgccggagccgaagcgcgcaggcccgtcccggtggccggggagcgggcgggtgggggcgccatgtggttcatgtacctgctgagctggctgtcgctcttcatccaggtggccttcatcacgctggctgtcgcggctggactctattacctggcagaactgatagaagaatacacagtggccaccagcaggatcataaaatacatgatctggttctccaccgctgtactgattggcctctacgtctttgagcgcttccccaccagcatgattggagtgggcctattcaccaacctcgtctactttggcctcctccagaccttccccttcatcatgctgacctcgcctaacttcatcctgtcgtgtggactagtggtggtgaatcattacctagcatttcagttttttgcagaagaatattatcccttctcagaggtcctggcctatttcactttctgcctgtggataattccgtttgcgttttttgtgtcactttcggccggggagaacgtcctgccctctaccatgcagccaggagatgatgtcgtctccaattatttcaccaaaggcaagcggggcaaacgcttagggatcctggttgtcttctccttcatcaaagaggccattctacccagtcgtcagaagatatactgacccccatgcaggcaggatgtggggggcaagatcaggagagtcaggcccctgggcctctatgccaggtggggaccagaagtcgggaaggcacctaccacctgccctggctttcttcccctcaactctggagccccatccccaccctccttggggggctcagcttggctcagatctgatgcttcaagaggctgtaacctcagagggcaccaaggagggtggcagagcctgcttagccaggaggccgaggtccctcagtcctcccctgtcccttccaaggtgggtcaggaggttctggccccgctggggcaggcagggcagggtctgtgaagcttaagagcagatggtgacaagttctctgggcaggtggccatggggaggggccatggcttggcatgtccaacagaaatagtttttgctgttgaacggtgatttctgtccaagtgcagatttccgtttgaataaagcttcgcttctaggtggcactgtttgccttaataccctgacagttcatcttcctttcttcctgctaaccttctgctctggactggactcacttttcccagaggaagatttataaataggatattgtagatgttcttctgaaaatctagcccagtcctaaattgtcccctctcctactcccagtttgacattcacggagccttggggaaagagatggaagagagtgcatcagagaggctgcctatagccccacttcccactccttgagcaggctcagctcc

SEQ ID NO: 313417 - DNA, 1336 bp, Homo sapiens
ggcggcgctagcgcgagcctggccccgggcagcgctagggccgggctcctctcggcggcggcgcaccgtcgtcctgtcgtccgcggggcggggacgcggcggcggcggcggcggtggcggctgtgtgtcgccggagccgaagcgcgcaggcccgtcccggtggccggggagcgggcgggtgggggcgccatgtggttcatgtacctgctgagctggctgtcgctcttcatccaggtggccttcatcacgctggctgtcgcggctggactctattacctggcagaactgatagaagaatacacagtggccaccagcaggatcataaaatacatgatctggttctccaccgctgtactgattggcctctacgtctttgagcgcttccccaccagcatgattggagtgggcctattcaccaacctcgtctactttggcctcctccagaccttccccttcatcatgctgacctcgcctaacttcatcctgtcgtgtggactagtggtggtgaatcattacctagcatttcagttttttgcagaagaatattatcccttctcagaggtcctggcctatttcactttctgcctgtggataattccgtttgcgttttttgtgtcactttcggccggggagaacgtcctgccctctaccatgcagccaggagatgatgtcgtctccaattatttcaccaaaggcaagcggggcaaacgcttagggatcctggttgtcttctccttcatcaaagaggccattctacccagtcgtcagaagatatactgacccccatgcaggcaggatgtggggggcaagatcaggagagtcaggcccctgggcctctatgccaggtggggaccagaagtcgggaaggcacctaccacctgccctggctttcttcccctcaactctggagccccatccccaccctccttggggggctcagcttggctcagatctgatgcttcaagaggctgtaacctcagagggcaccaaggagggtggcagagcctgcttagccaggaggccgaggtccctcagtcctcccctgtcccttccaaggtgggtcaggaggttctggccccgctggggcaggcagggcagggtctgtgaagcttaagagcagatggtgacaagttctctgggcaggtggccatggggaggggccatggcctggcatactacacagatcactctgggctcacttgcctgcctaatggtcatctccccagtagactgtaagctccttgagggcaaggattgtgttggaatttttgtattaacagtgcctggcttggtgcctggcacctagaaagcactcaataaatgtttgtttaatgaa

SEQ ID NO: 313418 - DNA, 702 bp, Homo sapiens
cgtctacttaaattttccagatatttagtgaatttctgctgtgagccatgatctctgctagcccactgggaagaggagtgctggttcatgacccgtcatctgcatggtggtgcaggaagctcttctttctcttcgtacatgagggtaatagacagcagtcttcagcctgagacccatcactagaaacagcataatcggtgtcgtgaagaaaagacaaaggatctctcagcaaggcaatctttactttctgcagaaagggtgcccctcgcagatcgaacaatcgtgacagcacacttgaacaaaggaaaagcagacatatttatcatttacgtatttgggtcagccttactgctcagtcctgcatccattggctggagctggaccccacagtcttcaactgataccaaatctgctaataacctaaaactttcctaaacagatgccggagaccccaactggggactcagacccgcaacctgctcctaaaaaaatgaaaacatctgagtcctcgaccatactagtggttcgctacaggaggaacgtgaaaagaacatctccagaggaactgctgaatgaccacgcccgagagaacagaatcaaccccgaccaaatggaggaggaggaattcatagaaataacgactgaaagacctaaaaagtagcaagaagctacatctctcaaccttgggcaatgaaaataaag

SEQ ID NO: 313419 - DNA, 313 bp, Homo sapiens
tttgtagagatggggtcttgccttgttgcctaggctggtgttgaactcctggcctcaagcaatcctcctgccttggcctcccaacccaaagctacttttcaacacttcactttcctgatcaaaaacgtctacttaaattttccagatatttagtgaatttctgctgtgagccatgatctctgctagcccactgggaagaggagtgctggttcatgacccgtcatctgcatggtggtgcaggaagctcttctttctcttcgtacatgaggtattcaactagctcctagttaataaacctcaaaaccccctttta

SEQ ID NO: 313420 - DNA, 456 bp, Homo sapiens
gtcaccaggagggtatgcatagggagggcaagagctctgggccactgcgaagattcaaaagctccaaaaacctactgtagacatcgaagaaccaatatatacaatgggccaacaatccagtgtccgcaggctgaagaggagcgtcccctgtgaatccaacgaggccaacgaggccaatgaggccaacaagacgatgccggagaccccaactggggactcagacccgcaacctgctcctaaaaaaatgaaaacatctgagtcctcgaccatactagtggttcgctacaggaggaacgtgaaaagaacatctccagaggaactgctgaatgaccacgcccgagagaacagaatcaaccccgaccaaatggaggaggaggaattcatagaaataacgactgaaagacctaaaaagtagcaagaagctacatctctcaaccttgggcaatgaaaataaag

SEQ ID NO: 313421 - DNA, 1362 bp, Homo sapiens
ataaaggtaatatgaaatgagggctaaacaatgtaatataactgccagttaaggtagacagtagttgtggtcttagttacatttgatatggagttgtgtaatattaagcagatcccagtggagttagtaaaaacataggtattgagttttaatggctaccaattgggatatatacttagcctgcaggctgaactttagtcagtgtttttctatcatgttgttttgtgaacaagtcaaaatttatacaaagctaccctaagtgctgcaattgcagaggaacttgcctcttcgtgatattagagggcagtccaactccgctcaaactgagtccaagatttgaattcatccagaaaaacaaatggaggagaaaagcctaatgcaccacatgtgtttggcatttcatggctgggacaatggagtagagggtaggaagacaagctgtagaacaaaagcaaagtgaggtagaaagtaacaggtcccagaagaggacagacttagagatgtgtaaccttggatcctctttttcacttagaatatgggtaaacttcttagcacaagactggattaagagaagttctttctgttaaactcacctagggtagtggctttgaaggcctcagaggattaatagattcccaaaattttcttccagacctgggagatggagagaaagaggttcttgctttaaagcggctcgaagacaatctttatgacttcagcaactcttcaacatagtagcaccaataaaggagagattatgttaacttcctagtggtgagaataccatgggatgggagaagggccagtgagtgggatgggaatgagcttcatcaggaacagatttcagactctgcagggtgcaccggttctagcctcaaataacaacattgcaaggaggtggactacagggtccacaccctctgtccttcggggcccatggtcaggccattccctctttgttttgctcctagaggatgagcatgtaagatgagatcaggagggaaattgggtgctctgcctcaggctgttaaaatgctgctacctgcattctaaaacgtgcaagtcatgccccacaagacacctccttagggcagcatccactgtggtgtgccagcctgacacccctgcagtcacggtgtttgaatggcagctgatgctggcccacccagagtatcggtgcatctctcctaaagccacagttcagcactgcatgttgaccaggcggatatcctataatatagatgctcgtttggatccaaaaggaaaaccattaaaaataaaagaaagatgaaaaactttaatgttttgggggggataaaagaaaagaataaataaaaccttgttgtaaagaaaacatcggcc

SEQ ID NO: 313422 - DNA, 828 bp, Homo sapiens
caggccggggcgaggccgcgctggccctcccttggcggcggcggcgcgtcgtgggagacggctgcacgtgggacggctggtggatgaccgctgtgtggtggagcccgcggccggggacctggacaacccccctaagaagttccgtgactgcctcttcaaggtgtgccccatgaaccgctactcggcccagaagcagtactggaaggccaagcagactaagcaggacaaggagaagatcgctgatgtggtgttgctgcagaagctgcagcatgcggcgcagatggagcagaagcaaaatgacacggagaacaagaaggtgcatggggatgtcgtgaagtatggcagtgtgatccagctcctgcacatgaagagcaacaagtacctgacagtgaacaagcggcttccggccttgctggagaagaacgccatgcgggtgactctggatgccacaggcaacgagggttcctggctcttcatccagcccttctggaagctgcggagcaacggggacaacgtggtcgtgggggacaaggtgatcctgaatcctgtcaatgccgggcagcctctgcatgccagcaattacgagctcagcgacaacgccggctgcaaggaggtcaattctgtgaactgcaacaccagctggaagatcaacctgtttatgcagtttcgggaccacctggaggaggtgttgaaaggggtaaggactgggaacccctgccctgcccagctggccacctagccctccccaccagggccctcttcctgccttctccacccgccaggcctcaggcccttaccctctccccagctttgcaccccccagcctcc

SEQ ID NO: 313423 - DNA, 606 bp, Homo sapiens
gggttgtatgtgtatgttttttaagtgctaaacagtgactcattctgactggtccccccacacaggaaacagccccatctccaatcatgccctgaacagagcttcctcatagccagcctccgcactggcctccactaacctccagggatccccacccaggaacactcccagtcccaccagagtgcagcctagcccccagatatcacacccaggccccaggccccaaaaaaaaaaaaaaaaacaaacacaaaaaaaacaaaaaaaaaaaaaaaggtggggcttcagagaggactcctcggtgtcaggccaaccccttcatttgggtatgactcaaccctgacatcttatgctgacctgtccccaggcccaccctggctcctgactccaatcttagtctcatctccccttttgaccctcagccccttgccatgactgatcttgatctcagtatgtcccaggcctcaccttgacgctgaccgtgacacttcaccttgccccaactccagcctcatcttggccattgagctcccgcccctcacacatttccatcctgacctgggggccccactttccctttacgctggcctcttcacggtcccagtccca

SEQ ID NO: 313424 - DNA, 10094 bp, Homo sapiens
  misc_feature (4486)..(4486): n is a, c, g, or t
ttatttatttatttatttatttttttgtctatttgttgtgtaggggctatttcttgggctaatgcaagggcagggaccgaacccgcaacctcatggttcctagtcggattcgttaaccactgcgccacgacaggaactcccctgtgtctgacagttttaaagaaagcttttaagtggtgactcgacatcccgaggtgttgcggtcctattatcgcaatgggcactctatcttaggcgttcaaataaaggactaggaagcaaacacccaagcaccggggaacagaacagaaagaaagacggaaggagccaagagttttggagccaactcctggagagggagcggctgaactgattcggaagttggatctctttgtacacaggaatgcggagagaaaaaaaacaaaacccaccccattgcttcatttcccctccaagcctgagcactttctattgtgcaatgaaaaggcttttcacgttgagaaaaatgaatcccgaatttgctctgcaaagggatgagcgcgcctctgggcgccagcctgctctcagctgggcgcggagaccgcgcggtggccgcagggcggccgcggccagggcgctccagggcgcgccctccgcgagcggctccggggtgacgcccgccggagagctggactcccccttccgcgggcgcctgcactggctcttagccagccgagggcccgggtgcagatagtccgggaaccccgagggcggagagctccccactacgcctgggcctcccagggatggcagctccgagagccccctagacccggtgccttgcaggacgcctctggagatcaggagggctggcggcgcattcggcgtccgggaggccgggccccggacgcgcgaggagcgcggggcgcgggaaggcaggcgggtgcacatgggtgccggcgggcgagctgcggggggagggggggcggggtgtggcctccccgcctcccgggcgggatttgcatgtgtgtggtggccccagacttcctgctccttctacgctgcaggtacgcgcgggccgggcggggcgggcgggcggcgggcgcgccaagacgtgggcacctcctcacccggaccccgggccccgccgagccgcctcctggctcccgtggccgccagcccgccccggccgcaccgagcgtcgggatccgaggtgggagcgtacccctccccgctccccggacgcctcagtcctccgcactgagcttggccacgcgcccctaggcgccccccacgccctgggccccggagggccgcagccatgagtgaaatgtccagctttcttcacatcggggacatcgtctccctgtacgccgagggctccgtcaatggcttcatcagcactttggggctggtggatgaccgctgtgtggtggagcccgcggccggggacctggacaacccccctaagaagttccgtgactgcctcttcaaggtgtgccccatgaaccgctactcggcccagaagcagtactggaaggccaagcagactaagcaggacaaggagaagatcgctgatgtggtgttgctgcagaagctgcagcatgcggcgcagatggagcagaagcaaaatgacacggagaacaagaaggtgcatggggatgtcgtgaagtatggcagtgtgatccagctcctgcacatgaagagcaacaagtacctgacagtgaacaagcggcttccggccttgctggagaagaacgccatgcgggtgactctggatgccacaggcaacgagggttcctggctcttcatccagcccttctggaagctgcggagcaacggggacaacgtggtcgtgggggacaaggtgatcctgaatcctgtcaatgccgggcagcctctgcatgccagcaattacgagctcagcgacaacgccggctgcaaggaggtcaattctgtgaactgcaacaccagctggaagatcaacctgtttatgcagtttcgggaccacctggaggaggtgttgaaagggggagacgtggtgcggctgttccatgcggagcaggagaagttcctgacgtgtgacgagtacaagggcaagctgcaggtgttcctgcgaactacactgcgccagtctgccacctcggccaccagctccaatgctctctgggaggtggaggtggtccaccacgacccctgccgtggaggagctgggcactggaatggcttgtaccgcttcaagcacctggctacaggcaactacctggctgctgaggagaaccccagttacaaaggtgatgcctcagatcccaaggcagcaggaatgggggcacagggccgcacaggccgcaggaatgctggggagaagatcaagtactgcctggtggctgtgcctcatggcaatgacatcgcctctctctttgagctggaccccaccaccttgcagaaaaccgactctttcgtgccccggaactcgtacgtccggctgcggcacctctgcaccaacacgtggattcagagcaccaatgtgcccattgacatcgaggaggagcggcccatccggctcatgctgggcacctgccccaccaaggaggacaaggaggcctttgccatcgtgtcagtgcccgtgtctgagatccgagacctggactttgccaatgacgccagctccatgctggccagtgccgtggagaaactcaacgagggcttcatcagccagaatgaccgcaggtttgtcatccagctgctggaagacctggtgttctttgtcagcgatgtccccaacaatgggcagaatgtcctggacatcatggtcactaagcccaaccgggaacggcagaagctgatgagggagcagaacatcctcaaacaggtctttggcattctgaaggccccgttccgtgagaaggggggtgaaggtcccctggtgcggctggaggagctgtcagaccagaagaacgccccctaccagcacatgttccgcctgtgctaccgcgtgttgcggcattcccaggaggactaccgcaagaaccaggagcacattgccaagcagtttgggatgatgcagtcccagattggctacgacatcctggccgaggacaccatcactgccctgctgcacaacaaccgcaagctcctggaaaagcacatcaccaagaccgaggtggagaccttcgtcagccttgtgcgcaagaaccgggagcccaggttcctggactacctctctgacctgtgtgtgtccaaccacatcgccatccccgtcacccaagagctcatctgcaagtgtgtgctggaccccaagaacagtgacattctcatccggaccgagcttcggcccgtgaaggagatggcccaatcccacgagtacctgagcatcgagtactcagaagaggaagtgtggctcacgtggactgacaagaataacgagcatcatgagaagagtgtgaggcagctggcccaggaggcgcgggccggcaacgcccacgacgagaatgtgctcagctactacaggtaccagctgaagctctttgcccgcatgtgcttggaccgccagtacttggccatcgacgagatctcccagcagctgggcgtggacctgattttcctgtgcatggcagacgagatgctgccctttgacctgcgcgcctccttctgccacctgatgctgcacgtgcacgtggaccgtgacccccaggagctggtcacgccggtcaagtttgcccgtctctggactgagatccccacagccatcaccatcaaggactatgattccaacctcaacgcgtcccgagatgacaagaagaacaagtttgccaacaccatggagttcgtggaggactacctcaacaatgtagtcagcgaggccgtgccctttgccaacgaggagaagaacaagctcacttttgaggtggtcagcctggcgcacaatctcatctacttcggcttctacagcttcagcgagctgctgcggctcactcgcacactgctgggcatcatcgactgtgtgcaggggcccccggccatgctgcaggcctatgaggaccccggtggcaagaatgtgcggcggtccatccagggcgtggggcacatgatgtccaccatggtgctgagccgcaagcagtccgtcttcagtgcccccagcctgtctgctggggccagtgctgctgagccgctggacagaagcaagtttgaggagaatgaggacattgtggtgatggagaccaagctgaagatcctggaaatccttcagttcatcctcaacgtccgcctggattaccgcatatcctacctgctgtctgtcttcaagaaggagtttgtggaggtgtttcccatgcaggacagtggggctgatggcacagcccctgccttcgactctaccactgccaacatgaacctggatcgcatcggggagcaggcggaggccatgtttggagtggggaagacaagcagcatgctggaggtggatgacgagggcggccgcatgttcctgcgcgtgctcatccacctcaccatgcacgactatgcgccnctggtctcgggtgccctgcagctgctcttcaagcacttcagccagcgccaggaggccatgcacaccttcaagcaggttcagctgctgatctcagcgcaggacgtggagaactacaaggtgatcaagtcggagctggaccggctgcggaccatggtggagaagtcagagctgtgggtggacaagaagggcagtggcaagggtgaggaggtggaggcaggcgccgccaaggacaagaaagagcgtcccacggacgaggagggctttctgcacccaccaggggagaaaagcagtgagaactaccagatcgtcaagggcatcctggaaaggctgaacaagatgtgcggggttggggagcaaatgaggaagaagcagcaacggctgctgaagaacatggatgcccacaaggtcatgctggacctgctgcagatcccctatgacaagggtgatgccaagatgatggagatcctgcgctacacgcaccagttcctgcagaagttctgtgcagggaaccccggcaaccaggccctgctgcacaaacacctgcacctcttcctcacgccagggctcctggaggcagagaccatgcagcacatcttcctgaacaactatcagctctgctccgagatcagcgagcctgtgttgcagcacttcgtgcacctgctggccacgcacgggcgccatgtgcagtacctggacttcctgcacaccgtcattaaggccgagggcaagtacgtcaagaagtgccaggacatgatcatgactgagctgaccaatgcaggtgacgatgtggtcgtgttctacaatgataaggcatcgctggcccacctgctggacatgatgaaggccgcccgcgacggcgtggaggaccacagccccctcatgtaccacatttccctggtggacctgctggccgcctgtgccgagggcaaaaacgtctacactgagatcaagtgcacctccctgctgccgctggaggacgtggtgtctgtggtgacgcatgaggactgcatcactgaggtgaaaatggcctatgtgaacttcgtgaaccactgctacgtggacacggaggtggagatgaaggagatctacaccagcaaccacatctggacgctctttgagaacttcaccctggacatggctcgggtctgcagcaagcgtgagaagcgcgtggctgaccccaccttggagaagtacgtgctgagcgttgtgctggacaccatcaacgccttcttcagctccccattctctgagaacagcacttccctgcagacacaccagacgattgtggtgcagctgctgcagtctaccacacgcctcctcgagtgtccgtggctacagcagcagcacaagggctccgtggaggcctgcatccggaccctcgccatggtggccaagggccgggccatcttgctgcccatggacctggatgcccacatcagctcgatgctcagcagtggagccagctgtgcagctgccgcccagcggaacgcctccagctacaaggcaaccacgcgggccttcccccgcgtcacccccaccgccaaccagtgggactacaagaacatcattgagaagctgcaggacatcatcacagccctggaggagcggctgaagcccctggtacaggctgagctgtccgtgctggtggatgtcctgcactggcctgagctgctcttcctggagggcagtgaggcctaccagcgctgcgagagtgggggcttcctgtccaagctgatccagcacaccaaggacctcatggagtcggaggagaagctgtgcatcaaggtgctgcggaccctgcagcagatgctgctcaagaagaccaagtacggggaccggggcaaccagctgcgcaagatgctgctgcaaaactacctccagaaccggaagtccacctcgcggggggaccttcccgaccccataggcactggcctggacccagactggtcggcaatcgcagccacccagtgccggctggacaaggagggggccaccaagttggtatgcgacctcatcaccagcaccaagaacgagaagatcttccaggagagcatcggcctggccatccacctgctggatggtggcaacacagagatccagaaatccttccacaacctgatgatgagtgacaagaagtcagagcgcttcttcaaggtgctgcacgaccgcatgaagcgggcccagcaggagaccaagtccacggtggcagtcaacatgaatgacctgggcagccagccacatgaggaccgcgagccagtcgaccccaccaccaaaggccgcgtggcctccttctcgatacctggctcctcatcccgctactcgctgggccccagcctgcgccgggggcacgaggtgagcgaacgtgtgcagagcagtgagatgggcacatccgtgctcatcatgcagcccatcctgcgctttctgcagctgctgtgtgagaaccacaaccgggacctgcagaacttcctgcgctgtcagaacaacaaaaccaactacaacttggtatgcgagacgctgcagttcctggacatcatgtgcggcagcaccacgggcggcctggggctgctggggctctacatcaatgaggacaacgtgggcctcgtcatccagaccttggagaccctcactgagtactgccagggcccctgccatgagaaccagacttgcattgtgactcacgagtccaatggcatagacatcatcaccgcactgatcctcaatgacatcagccccctgtgcaagtaccgcatggatctggtgctgcagctcaaggacaatgcctccaagctgctcctggctctgatggagagccggcatgacagtgaaaatgctgagcgaatcctcatcagcctgcggccccaggagctggtggacgtcatcaagaaggcctacctgcaggaggaagagcgtgagaactcggaggtgagcccacgtgaagtgggccataacatctatatcctggcgctgcagctctccaggcacaataaacagctgcagcacctgctgaagccggtgaagcgcattcaagaggaggaggccgagggtatctcttccatgctcagcctcaacaacaagcagctgtcacagatgctcaagtcctcagcgccagcacaggaggaggaggaagaccccctggcctactatgagaaccacacgtcccagatcgagattgtgcggcaggaccgcagcatggagcagatcgtgttcccagtgcccggcatctgccagttcctgacggaggaaaccaagcaccggctcttcaccactactgagcaggacgagcagggcagcaaagtgagcgacttcttcgaccagtcctccttcctgcacaacgagatggagtggcagcgcaagctccgcagcatgccgctgatctactggttctcccgccgcatgaccctgtggggcagcatctccttcaacctggccgtgtttatcaacatcatcattgccttcttctacccttacatggagggcgcgtccacaggcgtgctggactcccctctcatctcattgctcttctggatcctcatctgcttctccatcgcggccctgttcaccaagcgctacagcatccgccccctcatcgtggcgctcatcctgcgctccatctactatctgggcatcgggcccacactcaacatcctgggtgccctcaatctgaccaacaagatcgtgtttgtggtgagcttcgtgggcaaccgtggcaccttcatccggggctataaggccatggtcatggacatggaattcctctaccacgtgggctacatcctgaccagtgtcctgggcctctttgctcatgagctgttctacagcatcctgctctttgacctcatctaccgcgaggagacgctgttcaacgtcatcaagagtgtgacccgcaatggccgctccatcctgctgacagccctgctggccctcatcctggtctacctcttctccatcgtcggcttcctcttcctcaaggatgacttcattctcgaggtcgaccggctgcccaacaaccactccacagccagccccctggggatgccacatggagctgctgcatttgtggacacctgcagtggggacaagatggactgtgtctcagggctctcggtgcctgaggtcctggaagaggacagggagctggacagcacagagcgggcctgtgacactctgttgatgtgcatcgtcactgtcatgaaccatgggctacgcaacggtggtggcgtgggcgacattctccgcaagccctccaaagatgagtctctcttcccagcccgagtggtctatgacctcctgttcttcttcatcgtcatcatcattgtgctgaacctcatctttggggtaatcatcgacaccttcgctgacctgcgtagtgagaagcagaagaaggaggagattcttaagacgacatgcttcatctgtggtctggagagggacaagtttgataacaagacagtgtcatttgaggaacacatcaagctggagcacaacatgtggaactacttgtacttcattgtgctggtccgcgtgaagaacaagaccgactacacgggccctgagagctacgtggcccagatgatcaagaacaagaacctggactggttcccccggatgcgggccatgtcccttgtcagcaatgagggcgagggggagcagaatgagattcggattctccaggacaagctcaactccaccatgaagctggtgtcccacctcactgcccagctcaacgagctcaaggagcagatgacggagcagcggaaacgcaggcaacgcctaggctttgtggatgtccagaactgcattagccgctgaggagagccaccgaaggccccaacaggggatgctcatcactggagactgcgactgggaagaacactgccccctccctcgggttgggtggcccagccagctggccagcctccactcccactctgccagacaccctgacacccacccaggctttgaagagcatggagggggagcctcagagctgacagtcctgcttagagcccttaaaaagacttgaaagttcactgggactcagtttaccttaatgccttagcagaagataaatcctacctagagacctttgttccttaaagcaataactgacaactctttgtagtcctccttgtgggtagttaagagtggggtcacccctttaactccaagcactacattttggcggctgccggcctctgggggaggtggcagttatgctgttactagtgattttagggctttgttatttaacttatttcaagggtgctgtgctcagccctgcccatggctgtgcagctccctccgtgcctcagatctgctgtagccagtgcagacctcactgtcgtgtccatgccacccccggcatggctccaggtggcctggtgactccatgatggacgatcttgctcccaggacctgcctcttcccaggcttcctggggaagagttgtacgcccaggcaacaagggctgagctgcgcttgcgtggctgtttcatgaccgcttgtttttctccttttggtgtaatgttttacaaatcctttggcctgagaactaatatgttaattgccttaaataaattaatagaaatctagtccgttaaaaaaaaaa

SEQ ID NO: 313425 - DNA, 10112 bp, Homo sapiens
  misc_feature (4504)..(4504): n is a, c, g, or t
ttatttatttatttatttatttttttgtctatttgttgtgtaggggctatttcttgggctaatgcaagggcagggaccgaacccgcaacctcatggttcctagtcggattcgttaaccactgcgccacgacaggaactcccctgtgtctgacagttttaaagaaagcttttaagtggtgactcgacatcccgaggtgttgcggtcctattatcgcaatgggcactctatcttaggcgttcaaataaaggactaggaagcaaacacccaagcaccggggaacagaacagaaagaaagacggaaggagccaagagttttggagccaactcctggagagggagcggctgaactgattcggaagttggatctctttgtacacaggaatgcggagagaaaaaaaacaaaacccaccccattgcttcatttcccctccaagcctgagcactttctattgtgcaatgaaaaggcttttcacgttgagaaaaatgaatcccgaatttgctctgcaaagggatgagcgcgcctctgggcgccagcctgctctcagctgggcgcggagaccgcgcggtggccgcagggcggccgcggccagggcgctccagggcgcgccctccgcgagcggctccggggtgacgcccgccggagagctggactcccccttccgcgggcgcctgcactggctcttagccagccgagggcccgggtgcagatagtccgggaaccccgagggcggagagctccccactacgcctgggcctcccagggatggcagctccgagagccccctagacccggtgccttgcaggacgcctctggagatcaggagggctggcggcgcattcggcgtccgggaggccgggccccggacgcgcgaggagcgcggggcgcgggaaggcaggcgggtgcacatgggtgccggcgggcgagctgcggggggagggggggcggggtgtggcctccccgcctcccgggcgggatttgcatgtgtgtggtggccccagacttcctgctccttctacgctgcaggtacgcgcgggccgggcggggcgggcgggcggcgggcgcgccaagacgtgggcacctcctcacccggaccccgggccccgccgagccgcctcctggctcccgtggccgccagcccgccccggccgcaccgagcgtcgggatccgaggtgggagcgtacccctccccgctccccggacgcctcagtcctccgcactgagcttggccacgcgcccctaggcgccccccacgccctgggccccggagggccgcagccatgagtgaaatgtccagctttcttcacatcggggacatcgtctccctgtacgccgagggctccgtcaatggcttcatcagcactttggggctggtggatgaccgctgtgtggtggagcccgcggccggggacctggacaacccccctaagaagttccgtgactgcctcttcaaggtgtgccccatgaaccgctactcggcccagaagcagtactggaaggccaagcagactaagcaggacaaggagaagatcgctgatgtggtgttgctgcagaagctgcagcatgcggcgcagatggagcagaagcaaaatgacacggagaacaagaaggtgcatggggatgtcgtgaagtatggcagtgtgatccagctcctgcacatgaagagcaacaagtacctgacagtgaacaagcggcttccggccttgctggagaagaacgccatgcgggtgactctggatgccacaggcaacgagggttcctggctcttcatccagcccttctggaagctgcggagcaacggggacaacgtggtcgtgggggacaaggtgatcctgaatcctgtcaatgccgggcagcctctgcatgccagcaattacgagctcagcgacaacgccggctgcaaggaggtcaattctgtgaactgcaacaccagctggaagatcaacctgtttatgcagtttcgggaccacctggaggaggtgttgaaagggggagacgtggtgcggctgttccatgcggagcaggagaagttcctgacgtgtgacgagtacaagggcaagctgcaggtgttcctgcgaactacactgcgccagtctgccacctcggccaccagctccaatgctctctgggaggtggaggtggtccaccacgacccctgccgtggaggagctgggcactggaatggcttgtaccgcttcaagcacctggctacaggcaactacctggctgctgaggagaaccccagttacaaaggtgatgcctcagatcccaaggcagcaggaatgggggcacagggccgcacaggccgcaggaatgctggggagaagatcaagtactgcctggtggctgtgcctcatggcaatgacatcgcctctctctttgagctggaccccaccaccttgcagaaaaccgactctttcgtgccccggaactcgtacgtccggctgcggcacctctgcaccaacacgtggattcagagcaccaatgtgcccattgacatcgaggaggagcggcccatccggctcatgctgggcacctgccccaccaaggaggacaaggaggcctttgccatcgtgtcagtgcccgtgtctgagatccgagacctggactttgccaatgacgccagctccatgctggccagtgccgtggagaaactcaacgagggcttcatcagccagaatgaccgcaggtttgtcatccagctgctggaagacctggtgttctttgtcagcgatgtccccaacaatgggcagaatgtcctggacatcatggtcactaagcccaaccgggaacggcagaagctgatgagggagcagaacatcctcaaacaggtctttggcattctgaaggccccgttccgtgagaaggggggtgaaggtcccctggtgcggctggaggagctgtcagaccagaagaacgccccctaccagcacatgttccgcctgtgctaccgcgtgttgcggcattcccaggaggactaccgcaagaaccaggagcacattgccaagcagtttgggatgatgcagtcccagattggctacgacatcctggccgaggacaccatcactgccctgctgcacaacaaccgcaagctcctggaaaagcacatcaccaagaccgaggtggagaccttcgtcagccttgtgcgcaagaaccgggagcccaggttcctggactacctctctgacctgtgtgtgtccaaccacatcgccatccccgtcacccaagagctcatctgcaagtgtgtgctggaccccaagaacagtgacattctcatccggaccgagttgctggtggtctgcaggcttcggcccgtgaaggagatggcccaatcccacgagtacctgagcatcgagtactcagaagaggaagtgtggctcacgtggactgacaagaataacgagcatcatgagaagagtgtgaggcagctggcccaggaggcgcgggccggcaacgcccacgacgagaatgtgctcagctactacaggtaccagctgaagctctttgcccgcatgtgcttggaccgccagtacttggccatcgacgagatctcccagcagctgggcgtggacctgattttcctgtgcatggcagacgagatgctgccctttgacctgcgcgcctccttctgccacctgatgctgcacgtgcacgtggaccgtgacccccaggagctggtcacgccggtcaagtttgcccgtctctggactgagatccccacagccatcaccatcaaggactatgattccaacctcaacgcgtcccgagatgacaagaagaacaagtttgccaacaccatggagttcgtggaggactacctcaacaatgtagtcagcgaggccgtgccctttgccaacgaggagaagaacaagctcacttttgaggtggtcagcctggcgcacaatctcatctacttcggcttctacagcttcagcgagctgctgcggctcactcgcacactgctgggcatcatcgactgtgtgcaggggcccccggccatgctgcaggcctatgaggaccccggtggcaagaatgtgcggcggtccatccagggcgtggggcacatgatgtccaccatggtgctgagccgcaagcagtccgtcttcagtgcccccagcctgtctgctggggccagtgctgctgagccgctggacagaagcaagtttgaggagaatgaggacattgtggtgatggagaccaagctgaagatcctggaaatccttcagttcatcctcaacgtccgcctggattaccgcatatcctacctgctgtctgtcttcaagaaggagtttgtggaggtgtttcccatgcaggacagtggggctgatggcacagcccctgccttcgactctaccactgccaacatgaacctggatcgcatcggggagcaggcggaggccatgtttggagtggggaagacaagcagcatgctggaggtggatgacgagggcggccgcatgttcctgcgcgtgctcatccacctcaccatgcacgactatgcgccnctggtctcgggtgccctgcagctgctcttcaagcacttcagccagcgccaggaggccatgcacaccttcaagcaggttcagctgctgatctcagcgcaggacgtggagaactacaaggtgatcaagtcggagctggaccggctgcggaccatggtggagaagtcagagctgtgggtggacaagaagggcagtggcaagggtgaggaggtggaggcaggcgccgccaaggacaagaaagagcgtcccacggacgaggagggctttctgcacccaccaggggagaaaagcagtgagaactaccagatcgtcaagggcatcctggaaaggctgaacaagatgtgcggggttggggagcaaatgaggaagaagcagcaacggctgctgaagaacatggatgcccacaaggtcatgctggacctgctgcagatcccctatgacaagggtgatgccaagatgatggagatcctgcgctacacgcaccagttcctgcagaagttctgtgcagggaaccccggcaaccaggccctgctgcacaaacacctgcacctcttcctcacgccagggctcctggaggcagagaccatgcagcacatcttcctgaacaactatcagctctgctccgagatcagcgagcctgtgttgcagcacttcgtgcacctgctggccacgcacgggcgccatgtgcagtacctggacttcctgcacaccgtcattaaggccgagggcaagtacgtcaagaagtgccaggacatgatcatgactgagctgaccaatgcaggtgacgatgtggtcgtgttctacaatgataaggcatcgctggcccacctgctggacatgatgaaggccgcccgcgacggcgtggaggaccacagccccctcatgtaccacatttccctggtggacctgctggccgcctgtgccgagggcaaaaacgtctacactgagatcaagtgcacctccctgctgccgctggaggacgtggtgtctgtggtgacgcatgaggactgcatcactgaggtgaaaatggcctatgtgaacttcgtgaaccactgctacgtggacacggaggtggagatgaaggagatctacaccagcaaccacatctggacgctctttgagaacttcaccctggacatggctcgggtctgcagcaagcgtgagaagcgcgtggctgaccccaccttggagaagtacgtgctgagcgttgtgctggacaccatcaacgccttcttcagctccccattctctgagaacagcacttccctgcagacacaccagacgattgtggtgcagctgctgcagtctaccacacgcctcctcgagtgtccgtggctacagcagcagcacaagggctccgtggaggcctgcatccggaccctcgccatggtggccaagggccgggccatcttgctgcccatggacctggatgcccacatcagctcgatgctcagcagtggagccagctgtgcagctgccgcccagcggaacgcctccagctacaaggcaaccacgcgggccttcccccgcgtcacccccaccgccaaccagtgggactacaagaacatcattgagaagctgcaggacatcatcacagccctggaggagcggctgaagcccctggtacaggctgagctgtccgtgctggtggatgtcctgcactggcctgagctgctcttcctggagggcagtgaggcctaccagcgctgcgagagtgggggcttcctgtccaagctgatccagcacaccaaggacctcatggagtcggaggagaagctgtgcatcaaggtgctgcggaccctgcagcagatgctgctcaagaagaccaagtacggggaccggggcaaccagctgcgcaagatgctgctgcaaaactacctccagaaccggaagtccacctcgcggggggaccttcccgaccccataggcactggcctggacccagactggtcggcaatcgcagccacccagtgccggctggacaaggagggggccaccaagttggtatgcgacctcatcaccagcaccaagaacgagaagatcttccaggagagcatcggcctggccatccacctgctggatggtggcaacacagagatccagaaatccttccacaacctgatgatgagtgacaagaagtcagagcgcttcttcaaggtgctgcacgaccgcatgaagcgggcccagcaggagaccaagtccacggtggcagtcaacatgaatgacctgggcagccagccacatgaggaccgcgagccagtcgaccccaccaccaaaggccgcgtggcctccttctcgatacctggctcctcatcccgctactcgctgggccccagcctgcgccgggggcacgaggtgagcgaacgtgtgcagagcagtgagatgggcacatccgtgctcatcatgcagcccatcctgcgctttctgcagctgctgtgtgagaaccacaaccgggacctgcagaacttcctgcgctgtcagaacaacaaaaccaactacaacttggtatgcgagacgctgcagttcctggacatcatgtgcggcagcaccacgggcggcctggggctgctggggctctacatcaatgaggacaacgtgggcctcgtcatccagaccttggagaccctcactgagtactgccagggcccctgccatgagaaccagacttgcattgtgactcacgagtccaatggcatagacatcatcaccgcactgatcctcaatgacatcagccccctgtgcaagtaccgcatggatctggtgctgcagctcaaggacaatgcctccaagctgctcctggctctgatggagagccggcatgacagtgaaaatgctgagcgaatcctcatcagcctgcggccccaggagctggtggacgtcatcaagaaggcctacctgcaggaggaagagcgtgagaactcggaggtgagcccacgtgaagtgggccataacatctatatcctggcgctgcagctctccaggcacaataaacagctgcagcacctgctgaagccggtgaagcgcattcaagaggaggaggccgagggtatctcttccatgctcagcctcaacaacaagcagctgtcacagatgctcaagtcctcagcgccagcacaggaggaggaggaagaccccctggcctactatgagaaccacacgtcccagatcgagattgtgcggcaggaccgcagcatggagcagatcgtgttcccagtgcccggcatctgccagttcctgacggaggaaaccaagcaccggctcttcaccactactgagcaggacgagcagggcagcaaagtgagcgacttcttcgaccagtcctccttcctgcacaacgagatggagtggcagcgcaagctccgcagcatgccgctgatctactggttctcccgccgcatgaccctgtggggcagcatctccttcaacctggccgtgtttatcaacatcatcattgccttcttctacccttacatggagggcgcgtccacaggcgtgctggactcccctctcatctcattgctcttctggatcctcatctgcttctccatcgcggccctgttcaccaagcgctacagcatccgccccctcatcgtggcgctcatcctgcgctccatctactatctgggcatcgggcccacactcaacatcctgggtgccctcaatctgaccaacaagatcgtgtttgtggtgagcttcgtgggcaaccgtggcaccttcatccggggctataaggccatggtcatggacatggaattcctctaccacgtgggctacatcctgaccagtgtcctgggcctctttgctcatgagctgttctacagcatcctgctctttgacctcatctaccgcgaggagacgctgttcaacgtcatcaagagtgtgacccgcaatggccgctccatcctgctgacagccctgctggccctcatcctggtctacctcttctccatcgtcggcttcctcttcctcaaggatgacttcattctcgaggtcgaccggctgcccaacaaccactccacagccagccccctggggatgccacatggagctgctgcatttgtggacacctgcagtggggacaagatggactgtgtctcagggctctcggtgcctgaggtcctggaagaggacagggagctggacagcacagagcgggcctgtgacactctgttgatgtgcatcgtcactgtcatgaaccatgggctacgcaacggtggtggcgtgggcgacattctccgcaagccctccaaagatgagtctctcttcccagcccgagtggtctatgacctcctgttcttcttcatcgtcatcatcattgtgctgaacctcatctttggggtaatcatcgacaccttcgctgacctgcgtagtgagaagcagaagaaggaggagattcttaagacgacatgcttcatctgtggtctggagagggacaagtttgataacaagacagtgtcatttgaggaacacatcaagctggagcacaacatgtggaactacttgtacttcattgtgctggtccgcgtgaagaacaagaccgactacacgggccctgagagctacgtggcccagatgatcaagaacaagaacctggactggttcccccggatgcgggccatgtcccttgtcagcaatgagggcgagggggagcagaatgagattcggattctccaggacaagctcaactccaccatgaagctggtgtcccacctcactgcccagctcaacgagctcaaggagcagatgacggagcagcggaaacgcaggcaacgcctaggctttgtggatgtccagaactgcattagccgctgaggagagccaccgaaggccccaacaggggatgctcatcactggagactgcgactgggaagaacactgccccctccctcgggttgggtggcccagccagctggccagcctccactcccactctgccagacaccctgacacccacccaggctttgaagagcatggagggggagcctcagagctgacagtcctgcttagagcccttaaaaagacttgaaagttcactgggactcagtttaccttaatgccttagcagaagataaatcctacctagagacctttgttccttaaagcaataactgacaactctttgtagtcctccttgtgggtagttaagagtggggtcacccctttaactccaagcactacattttggcggctgccggcctctgggggaggtggcagttatgctgttactagtgattttagggctttgttatttaacttatttcaagggtgctgtgctcagccctgcccatggctgtgcagctccctccgtgcctcagatctgctgtagccagtgcagacctcactgtcgtgtccatgccacccccggcatggctccaggtggcctggtgactccatgatggacgatcttgctcccaggacctgcctcttcccaggcttcctggggaagagttgtacgcccaggcaacaagggctgagctgcgcttgcgtggctgtttcatgaccgcttgtttttctccttttggtgtaatgttttacaaatcctttggcctgagaactaatatgttaattgccttaaataaattaatagaaatctagtccgttaaaaaaaaaa

SEQ ID NO: 313426 - DNA, 7818 bp, Homo sapiens
  misc_feature (2210)..(2210): n is a, c, g, or t
tacgcataggagccagtatgaaatgatctgctgcgtgtctgagacctaggattcatcttctttaactcgtagtttaccacgcaaactctttgccgacttggagactggacccaccgaccttgactagaaaaccgactctttctgtgccccggaactcgtacgtccggctgcggcacctctgcaccaacacgtggattcagagcaccaatgtgcccattgacatcgaggaggagcggcccatccggctcatgctgggcacctgccccaccaaggaggacaaggaggcctttgccatcgtgtcagtgcccgtgtctgagatccgagacctggactttgccaatgacgccagctccatgctggccagtgccgtggagaaactcaacgagggcttcatcagccagaatgaccgcaggtttgtcatccagctgctggaagacctggtgttctttgtcagcgatgtccccaacaatgggcagaatgtcctggacatcatggtcactaagcccaaccgggaacggcagaagctgatgagggagcagaacatcctcaaacaggtctttggcattctgaaggccccgttccgtgagaaggggggtgaaggtcccctggtgcggctggaggagctgtcagaccagaagaacgccccctaccagcacatgttccgcctgtgctaccgcgtgttgcggcattcccaggaggactaccgcaagaaccaggagcacattgccaagcagtttgggatgatgcagtcccagattggctacgacatcctggccgaggacaccatcactgccctgctgcacaacaaccgcaagctcctggaaaagcacatcaccaagaccgaggtggagaccttcgtcagccttgtgcgcaagaaccgggagcccaggttcctggactacctctctgacctgtgtgtgtccaaccacatcgccatccccgtcacccaagagctcatctgcaagtgtgtgctggaccccaagaacagtgacattctcatccggaccgagcttcggcccgtgaaggagatggcccaatcccacgagtacctgagcatcgagtactcagaagaggaagtgtggctcacgtggactgacaagaataacgagcatcatgagaagagtgtgaggcagctggcccaggaggcgcgggccggcaacgcccacgacgagaatgtgctcagctactacaggtaccagctgaagctctttgcccgcatgtgcttggaccgccagtacttggccatcgacgagatctcccagcagctgggcgtggacctgattttcctgtgcatggcagacgagatgctgccctttgacctgcgcgcctccttctgccacctgatgctgcacgtgcacgtggaccgtgacccccaggagctggtcacgccggtcaagtttgcccgtctctggactgagatccccacagccatcaccatcaaggactatgattccaacctcaacgcgtcccgagatgacaagaagaacaagtttgccaacaccatggagttcgtggaggactacctcaacaatgtagtcagcgaggccgtgccctttgccaacgaggagaagaacaagctcacttttgaggtggtcagcctggcgcacaatctcatctacttcggcttctacagcttcagcgagctgctgcggctcactcgcacactgctgggcatcatcgactgtgtgcaggggcccccggccatgctgcaggcctatgaggaccccggtggcaagaatgtgcggcggtccatccagggcgtggggcacatgatgtccaccatggtgctgagccgcaagcagtccgtcttcagtgcccccagcctgtctgctggggccagtgctgctgagccgctggacagaagcaagtttgaggagaatgaggacattgtggtgatggagaccaagctgaagatcctggaaatccttcagttcatcctcaacgtccgcctggattaccgcatatcctacctgctgtctgtcttcaagaaggagtttgtggaggtgtttcccatgcaggacagtggggctgatggcacagcccctgccttcgactctaccactgccaacatgaacctggatcgcatcggggagcaggcggaggccatgtttggagtggggaagacaagcagcatgctggaggtggatgacgagggcggccgcatgttcctgcgcgtgctcatccacctcaccatgcacgactatgcgccnctggtctcgggtgccctgcagctgctcttcaagcacttcagccagcgccaggaggccatgcacaccttcaagcaggttcagctgctgatctcagcgcaggacgtggagaactacaaggtgatcaagtcggagctggaccggctgcggaccatggtggagaagtcagagctgtgggtggacaagaagggcagtggcaagggtgaggaggtggaggcaggcgccgccaaggacaagaaagagcgtcccacggacgaggagggctttctgcacccaccaggggagaaaagcagtgagaactaccagatcgtcaagggcatcctggaaaggctgaacaagatgtgcggggttggggagcaaatgaggaagaagcagcaacggctgctgaagaacatggatgcccacaaggtcatgctggacctgctgcagatcccctatgacaagggtgatgccaagatgatggagatcctgcgctacacgcaccagttcctgcagaagttctgtgcagggaaccccggcaaccaggccctgctgcacaaacacctgcacctcttcctcacgccagggctcctggaggcagagaccatgcagcacatcttcctgaacaactatcagctctgctccgagatcagcgagcctgtgttgcagcacttcgtgcacctgctggccacgcacgggcgccatgtgcagtacctggacttcctgcacaccgtcattaaggccgagggcaagtacgtcaagaagtgccaggacatgatcatgactgagctgaccaatgcaggtgacgatgtggtcgtgttctacaatgataaggcatcgctggcccacctgctggacatgatgaaggccgcccgcgacggcgtggaggaccacagccccctcatgtaccacatttccctggtggacctgctggccgcctgtgccgagggcaaaaacgtctacactgagatcaagtgcacctccctgctgccgctggaggacgtggtgtctgtggtgacgcatgaggactgcatcactgaggtgaaaatggcctatgtgaacttcgtgaaccactgctacgtggacacggaggtggagatgaaggagatctacaccagcaaccacatctggacgctctttgagaacttcaccctggacatggctcgggtctgcagcaagcgtgagaagcgcgtggctgaccccaccttggagaagtacgtgctgagcgttgtgctggacaccatcaacgccttcttcagctccccattctctgagaacagcacttccctgcagacacaccagacgattgtggtgcagctgctgcagtctaccacacgcctcctcgagtgtccgtggctacagcagcagcacaagggctccgtggaggcctgcatccggaccctcgccatggtggccaagggccgggccatcttgctgcccatggacctggatgcccacatcagctcgatgctcagcagtggagccagctgtgcagctgccgcccagcggaacgcctccagctacaaggcaaccacgcgggccttcccccgcgtcacccccaccgccaaccagtgggactacaagaacatcattgagaagctgcaggacatcatcacagccctggaggagcggctgaagcccctggtacaggctgagctgtccgtgctggtggatgtcctgcactggcctgagctgctcttcctggagggcagtgaggcctaccagcgctgcgagagtgggggcttcctgtccaagctgatccagcacaccaaggacctcatggagtcggaggagaagctgtgcatcaaggtgctgcggaccctgcagcagatgctgctcaagaagaccaagtacggggaccggggcaaccagctgcgcaagatgctgctgcaaaactacctccagaaccggaagtccacctcgcggggggaccttcccgaccccataggcactggcctggacccagactggtcggcaatcgcagccacccagtgccggctggacaaggagggggccaccaagttggtatgcgacctcatcaccagcaccaagaacgagaagatcttccaggagagcatcggcctggccatccacctgctggatggtggcaacacagagatccagaaatccttccacaacctgatgatgagtgacaagaagtcagagcgcttcttcaaggtgctgcacgaccgcatgaagcgggcccagcaggagaccaagtccacggtggcagtcaacatgaatgacctgggcagccagccacatgaggaccgcgagccagtcgaccccaccaccaaaggccgcgtggcctccttctcgatacctggctcctcatcccgctactcgctgggccccagcctgcgccgggggcacgaggtgagcgaacgtgtgcagagcagtgagatgggcacatccgtgctcatcatgcagcccatcctgcgctttctgcagctgctgtgtgagaaccacaaccgggacctgcagaacttcctgcgctgtcagaacaacaaaaccaactacaacttggtatgcgagacgctgcagttcctggacatcatgtgcggcagcaccacgggcggcctggggctgctggggctctacatcaatgaggacaacgtgggcctcgtcatccagaccttggagaccctcactgagtactgccagggcccctgccatgagaaccagacttgcattgtgactcacgagtccaatggcatagacatcatcaccgcactgatcctcaatgacatcagccccctgtgcaagtaccgcatggatctggtgctgcagctcaaggacaatgcctccaagctgctcctggctctgatggagagccggcatgacagtgaaaatgctgagcgaatcctcatcagcctgcggccccaggagctggtggacgtcatcaagaaggcctacctgcaggaggaagagcgtgagaactcggaggtgagcccacgtgaagtgggccataacatctatatcctggcgctgcagctctccaggcacaataaacagctgcagcacctgctgaagccggtgaagcgcattcaagaggaggaggccgagggtatctcttccatgctcagcctcaacaacaagcagctgtcacagatgctcaagtcctcagcgccagcacaggaggaggaggaagaccccctggcctactatgagaaccacacgtcccagatcgagattgtgcggcaggaccgcagcatggagcagatcgtgttcccagtgcccggcatctgccagttcctgacggaggaaaccaagcaccggctcttcaccactactgagcaggacgagcagggcagcaaagtgagcgacttcttcgaccagtcctccttcctgcacaacgagatggagtggcagcgcaagctccgcagcatgccgctgatctactggttctcccgccgcatgaccctgtggggcagcatctccttcaacctggccgtgtttatcaacatcatcattgccttcttctacccttacatggagggcgcgtccacaggcgtgctggactcccctctcatctcattgctcttctggatcctcatctgcttctccatcgcggccctgttcaccaagcgctacagcatccgccccctcatcgtggcgctcatcctgcgctccatctactatctgggcatcgggcccacactcaacatcctgggtgccctcaatctgaccaacaagatcgtgtttgtggtgagcttcgtgggcaaccgtggcaccttcatccggggctataaggccatggtcatggacatggaattcctctaccacgtgggctacatcctgaccagtgtcctgggcctctttgctcatgagctgttctacagcatcctgctctttgacctcatctaccgcgaggagacgctgttcaacgtcatcaagagtgtgacccgcaatggccgctccatcctgctgacagccctgctggccctcatcctggtctacctcttctccatcgtcggcttcctcttcctcaaggatgacttcattctcgaggtcgaccggctgcccaacaaccactccacagccagccccctggggatgccacatggagctgctgcatttgtggacacctgcagtggggacaagatggactgtgtctcagggctctcggtgcctgaggtcctggaagaggacagggagctggacagcacagagcgggcctgtgacactctgttgatgtgcatcgtcactgtcatgaaccatgggctacgcaacggtggtggcgtgggcgacattctccgcaagccctccaaagatgagtctctcttcccagcccgagtggtctatgacctcctgttcttcttcatcgtcatcatcattgtgctgaacctcatctttggggtaatcatcgacaccttcgctgacctgcgtagtgagaagcagaagaaggaggagattcttaagacgacatgcttcatctgtggtctggagagggacaagtttgataacaagacagtgtcatttgaggaacacatcaagctggagcacaacatgtggaactacttgtacttcattgtgctggtccgcgtgaagaacaagaccgactacacgggccctgagagctacgtggcccagatgatcaagaacaagaacctggactggttcccccggatgcgggccatgtcccttgtcagcaatgagggcgagggggagcagaatgagattcggattctccaggacaagctcaactccaccatgaagctggtgtcccacctcactgcccagctcaacgagctcaaggagcagatgacggagcagcggaaacgcaggcaacgcctaggctttgtggatgtccagaactgcattagccgctgaggagagccaccgaaggccccaacaggggatgctcatcactggagactgcgactgggaagaacactgccccctccctcgggttgggtggcccagccagctggccagcctccactcccactctgccagacaccctgacacccacccaggctttgaagagcatggagggggagcctcagagctgacagtcctgcttagagcccttaaaaagacttgaaagttcactgggactcagtttaccttaatgccttagcagaagataaatcctacctagagacctttgttccttaaagcaataactgacaactctttgtagtcctccttgtgggtagttaagagtggggtcacccctttaactccaagcactacattttggcggctgccggcctctgggggaggtggcagttatgctgttactagtgattttagggctttgttatttaacttatttcaagggtgctgtgctcagccctgcccatggctgtgcagctccctccgtgcctcagatctgctgtagccagtgcagacctcactgtcgtgtccatgccacccccggcatggctccaggtggcctggtgactccatgatggacgatcttgctcccaggacctgcctcttcccaggcttcctggggaagagttgtacgcccaggcaacaagggctgagctgcgcttgcgtggctgtttcatgaccgcttgtttttctccttttggtgtaatgttttacaaatcctttggcctgagaactaatatgttaattgccttaaataaattaatagaaatctagtccgttaaaaaaaaaa

SEQ ID NO: 313427 - DNA, 10165 bp, Homo sapiens
  misc_feature (4486)..(4486): n is a, c, g, or t
ttatttatttatttatttatttttttgtctatttgttgtgtaggggctatttcttgggctaatgcaagggcagggaccgaacccgcaacctcatggttcctagtcggattcgttaaccactgcgccacgacaggaactcccctgtgtctgacagttttaaagaaagcttttaagtggtgactcgacatcccgaggtgttgcggtcctattatcgcaatgggcactctatcttaggcgttcaaataaaggactaggaagcaaacacccaagcaccggggaacagaacagaaagaaagacggaaggagccaagagttttggagccaactcctggagagggagcggctgaactgattcggaagttggatctctttgtacacaggaatgcggagagaaaaaaaacaaaacccaccccattgcttcatttcccctccaagcctgagcactttctattgtgcaatgaaaaggcttttcacgttgagaaaaatgaatcccgaatttgctctgcaaagggatgagcgcgcctctgggcgccagcctgctctcagctgggcgcggagaccgcgcggtggccgcagggcggccgcggccagggcgctccagggcgcgccctccgcgagcggctccggggtgacgcccgccggagagctggactcccccttccgcgggcgcctgcactggctcttagccagccgagggcccgggtgcagatagtccgggaaccccgagggcggagagctccccactacgcctgggcctcccagggatggcagctccgagagccccctagacccggtgccttgcaggacgcctctggagatcaggagggctggcggcgcattcggcgtccgggaggccgggccccggacgcgcgaggagcgcggggcgcgggaaggcaggcgggtgcacatgggtgccggcgggcgagctgcggggggagggggggcggggtgtggcctccccgcctcccgggcgggatttgcatgtgtgtggtggccccagacttcctgctccttctacgctgcaggtacgcgcgggccgggcggggcgggcgggcggcgggcgcgccaagacgtgggcacctcctcacccggaccccgggccccgccgagccgcctcctggctcccgtggccgccagcccgccccggccgcaccgagcgtcgggatccgaggtgggagcgtacccctccccgctccccggacgcctcagtcctccgcactgagcttggccacgcgcccctaggcgccccccacgccctgggccccggagggccgcagccatgagtgaaatgtccagctttcttcacatcggggacatcgtctccctgtacgccgagggctccgtcaatggcttcatcagcactttggggctggtggatgaccgctgtgtggtggagcccgcggccggggacctggacaacccccctaagaagttccgtgactgcctcttcaaggtgtgccccatgaaccgctactcggcccagaagcagtactggaaggccaagcagactaagcaggacaaggagaagatcgctgatgtggtgttgctgcagaagctgcagcatgcggcgcagatggagcagaagcaaaatgacacggagaacaagaaggtgcatggggatgtcgtgaagtatggcagtgtgatccagctcctgcacatgaagagcaacaagtacctgacagtgaacaagcggcttccggccttgctggagaagaacgccatgcgggtgactctggatgccacaggcaacgagggttcctggctcttcatccagcccttctggaagctgcggagcaacggggacaacgtggtcgtgggggacaaggtgatcctgaatcctgtcaatgccgggcagcctctgcatgccagcaattacgagctcagcgacaacgccggctgcaaggaggtcaattctgtgaactgcaacaccagctggaagatcaacctgtttatgcagtttcgggaccacctggaggaggtgttgaaagggggagacgtggtgcggctgttccatgcggagcaggagaagttcctgacgtgtgacgagtacaagggcaagctgcaggtgttcctgcgaactacactgcgccagtctgccacctcggccaccagctccaatgctctctgggaggtggaggtggtccaccacgacccctgccgtggaggagctgggcactggaatggcttgtaccgcttcaagcacctggctacaggcaactacctggctgctgaggagaaccccagttacaaaggtgatgcctcagatcccaaggcagcaggaatgggggcacagggccgcacaggccgcaggaatgctggggagaagatcaagtactgcctggtggctgtgcctcatggcaatgacatcgcctctctctttgagctggaccccaccaccttgcagaaaaccgactctttcgtgccccggaactcgtacgtccggctgcggcacctctgcaccaacacgtggattcagagcaccaatgtgcccattgacatcgaggaggagcggcccatccggctcatgctgggcacctgccccaccaaggaggacaaggaggcctttgccatcgtgtcagtgcccgtgtctgagatccgagacctggactttgccaatgacgccagctccatgctggccagtgccgtggagaaactcaacgagggcttcatcagccagaatgaccgcaggtttgtcatccagctgctggaagacctggtgttctttgtcagcgatgtccccaacaatgggcagaatgtcctggacatcatggtcactaagcccaaccgggaacggcagaagctgatgagggagcagaacatcctcaaacaggtctttggcattctgaaggccccgttccgtgagaaggggggtgaaggtcccctggtgcggctggaggagctgtcagaccagaagaacgccccctaccagcacatgttccgcctgtgctaccgcgtgttgcggcattcccaggaggactaccgcaagaaccaggagcacattgccaagcagtttgggatgatgcagtcccagattggctacgacatcctggccgaggacaccatcactgccctgctgcacaacaaccgcaagctcctggaaaagcacatcaccaagaccgaggtggagaccttcgtcagccttgtgcgcaagaaccgggagcccaggttcctggactacctctctgacctgtgtgtgtccaaccacatcgccatccccgtcacccaagagctcatctgcaagtgtgtgctggaccccaagaacagtgacattctcatccggaccgagcttcggcccgtgaaggagatggcccaatcccacgagtacctgagcatcgagtactcagaagaggaagtgtggctcacgtggactgacaagaataacgagcatcatgagaagagtgtgaggcagctggcccaggaggcgcgggccggcaacgcccacgacgagaatgtgctcagctactacaggtaccagctgaagctctttgcccgcatgtgcttggaccgccagtacttggccatcgacgagatctcccagcagctgggcgtggacctgattttcctgtgcatggcagacgagatgctgccctttgacctgcgcgcctccttctgccacctgatgctgcacgtgcacgtggaccgtgacccccaggagctggtcacgccggtcaagtttgcccgtctctggactgagatccccacagccatcaccatcaaggactatgattccaacctcaacgcgtcccgagatgacaagaagaacaagtttgccaacaccatggagttcgtggaggactacctcaacaatgtagtcagcgaggccgtgccctttgccaacgaggagaagaacaagctcacttttgaggtggtcagcctggcgcacaatctcatctacttcggcttctacagcttcagcgagctgctgcggctcactcgcacactgctgggcatcatcgactgtgtgcaggggcccccggccatgctgcaggcctatgaggaccccggtggcaagaatgtgcggcggtccatccagggcgtggggcacatgatgtccaccatggtgctgagccgcaagcagtccgtcttcagtgcccccagcctgtctgctggggccagtgctgctgagccgctggacagaagcaagtttgaggagaatgaggacattgtggtgatggagaccaagctgaagatcctggaaatccttcagttcatcctcaacgtccgcctggattaccgcatatcctacctgctgtctgtcttcaagaaggagtttgtggaggtgtttcccatgcaggacagtggggctgatggcacagcccctgccttcgactctaccactgccaacatgaacctggatcgcatcggggagcaggcggaggccatgtttggagtggggaagacaagcagcatgctggaggtggatgacgagggcggccgcatgttcctgcgcgtgctcatccacctcaccatgcacgactatgcgccnctggtctcgggtgccctgcagctgctcttcaagcacttcagccagcgccaggaggccatgcacaccttcaagcaggttcagctgctgatctcagcgcaggacgtggagaactacaaggtgatcaagtcggagctggaccggctgcggaccatggtggagaagtcagagctgtgggtggacaagaagggcagtggcaagggtgaggaggtggaggcaggcgccgccaaggacaagaaagagcgtcccacggacgaggagggctttctgcacccaccaggggagaaaagcagtgagaactaccagatcgtcaagggcatcctggaaaggctgaacaagatgtgcggggttggggagcaaatgaggaagaagcagcaacggctgctgaagaacatggatgcccacaaggtcatgctggacctgctgcagatcccctatgacaagggtgatgccaagatgatggagatcctgcgctacacgcaccagttcctgcagaagttctgtgcagggaaccccggcaaccaggccctgctgcacaaacacctgcacctcttcctcacgccagggctcctggaggcagagaccatgcagcacatcttcctgaacaactatcagctctgctccgagatcagcgagcctgtgttgcagcacttcgtgcacctgctggccacgcacgggcgccatgtgcagtacctggacttcctgcacaccgtcattaaggccgagggcaagtacgtcaagaagtgccaggacatgatcatgactgagctgaccaatgcaggtgacgatgtggtcgtgttctacaatgataaggcatcgctggcccacctgctggacatgatgaaggccgcccgcgacggcgtggaggaccacagccccctcatgtaccacatttccctggtggacctgctggccgcctgtgccgagggcaaaaacgtctacactgagatcaagtgcacctccctgctgccgctggaggacgtggtgtctgtggtgacgcatgaggactgcatcactgaggtgaaaatggcctatgtgaacttcgtgaaccactgctacgtggacacggaggtggagatgaaggagatctacaccagcaaccacatctggacgctctttgagaacttcaccctggacatggctcgggtctgcagcaagcgtgagaagcgcgtggctgaccccaccttggagaagtacgtgctgagcgttgtgctggacaccatcaacgccttcttcagctccccattctctgagaacagcacttccctgcagacacaccagacgattgtggtgcagctgctgcagtctaccacacgcctcctcgagtgtccgtggctacagcagcagcacaagggctccgtggaggcctgcatccggaccctcgccatggtggccaagggccgggccatcttgctgcccatggacctggatgcccacatcagctcgatgctcagcagtggagccagctgtgcagctgccgcccagcggaacgcctccagctacaaggcaaccacgcgggccttcccccgcgtcacccccaccgccaaccagtgggactacaagaacatcattgagaagctgcaggacatcatcacagccctggaggagcggctgaagcccctggtacaggctgagctgtccgtgctggtggatgtcctgcactggcctgagctgctcttcctggagggcagtgaggcctaccagcgctgcgagagtgggggcttcctgtccaagctgatccagcacaccaaggacctcatggagtcggaggagaagctgtgcatcaaggtgctgcggaccctgcagcagatgctgctcaagaagaccaagtacggggaccggggcaaccagctgcgcaagatgctgctgcaaaactacctccagaaccggaagtccacctcgcggggggaccttcccgaccccataggcactggcctggacccagactggtcggcaatcgcagccacccagtgccggctggacaaggagggggccaccaagttggtatgcgacctcatcaccagcaccaagaacgagaagatcttccaggagagcatcggcctggccatccacctgctggatggtggcaacacagagatccagaaatccttccacaacctgatgatgagtgacaagaagtcagagcgcttcttcaaggtgctgcacgaccgcatgaagcgggcccagcaggagaccaagtccacggtggcagtcaacatgaatgacctgggcagccagccacatgaggaccgcgagccagtcgaccccaccaccaaaggccgcgtggcctccttctcgatacctggctcctcatcccgctactcgctgggccccagcctgcgccgggggcacgaggtgagcgaacgtgtgcagagcagtgagatgggcacatccgtgctcatcatgcagcccatcctgcgctttctgcagctgctgtgtgagaaccacaaccgggacctgcagaacttcctgcgctgtcagaacaacaaaaccaactacaacttggtatgcgagacgctgcagttcctggacatcatgtgcggcagcaccacgggcggcctggggctgctggggctctacatcaatgaggacaacgtgggcctcgtcatccagaccttggagaccctcactgagtactgccagggcccctgccatgagaaccagacttgcattgtgactcacgagtccaatggcatagacatcatcaccgcactgatcctcaatgacatcagccccctgtgcaagtaccgcatggatctggtgctgcagctcaaggacaatgcctccaagctgctcctggctctgatggagagccggcatgacagtgaaaatgctgagcgaatcctcatcagcctgcggccccaggagctggtggacgtcatcaagaaggcctacctgcaggaggaagagcgtgagaactcggaggtgagcccacgtgaagtgggccataacatctatatcctggcgctgcagctctccaggcacaataaacagctgcagcacctgctgaagccggtgaagcgcattcaagaggaggaggccgagggtatctcttccatgctcagcctcaacaacaagcagctgtcacagatgctcaagtcctcagcgccagcacaggaggaggaggaagaccccctggcctactatgagaaccacacgtcccagatcgaggtgggcctgtgggcagcaggggcgggcgtgggagcctgcgccgggcgtgaccatgtgctgtgtgtgctcagattgtgcggcaggaccgcagcatggagcagatcgtgttcccagtgcccggcatctgccagttcctgacggaggaaaccaagcaccggctcttcaccactactgagcaggacgagcagggcagcaaagtgagcgacttcttcgaccagtcctccttcctgcacaacgagatggagtggcagcgcaagctccgcagcatgccgctgatctactggttctcccgccgcatgaccctgtggggcagcatctccttcaacctggccgtgtttatcaacatcatcattgccttcttctacccttacatggagggcgcgtccacaggcgtgctggactcccctctcatctcattgctcttctggatcctcatctgcttctccatcgcggccctgttcaccaagcgctacagcatccgccccctcatcgtggcgctcatcctgcgctccatctactatctgggcatcgggcccacactcaacatcctgggtgccctcaatctgaccaacaagatcgtgtttgtggtgagcttcgtgggcaaccgtggcaccttcatccggggctataaggccatggtcatggacatggaattcctctaccacgtgggctacatcctgaccagtgtcctgggcctctttgctcatgagctgttctacagcatcctgctctttgacctcatctaccgcgaggagacgctgttcaacgtcatcaagagtgtgacccgcaatggccgctccatcctgctgacagccctgctggccctcatcctggtctacctcttctccatcgtcggcttcctcttcctcaaggatgacttcattctcgaggtcgaccggctgcccaacaaccactccacagccagccccctggggatgccacatggagctgctgcatttgtggacacctgcagtggggacaagatggactgtgtctcagggctctcggtgcctgaggtcctggaagaggacagggagctggacagcacagagcgggcctgtgacactctgttgatgtgcatcgtcactgtcatgaaccatgggctacgcaacggtggtggcgtgggcgacattctccgcaagccctccaaagatgagtctctcttcccagcccgagtggtctatgacctcctgttcttcttcatcgtcatcatcattgtgctgaacctcatctttggggtaatcatcgacaccttcgctgacctgcgtagtgagaagcagaagaaggaggagattcttaagacgacatgcttcatctgtggtctggagagggacaagtttgataacaagacagtgtcatttgaggaacacatcaagctggagcacaacatgtggaactacttgtacttcattgtgctggtccgcgtgaagaacaagaccgactacacgggccctgagagctacgtggcccagatgatcaagaacaagaacctggactggttcccccggatgcgggccatgtcccttgtcagcaatgagggcgagggggagcagaatgagattcggattctccaggacaagctcaactccaccatgaagctggtgtcccacctcactgcccagctcaacgagctcaaggagcagatgacggagcagcggaaacgcaggcaacgcctaggctttgtggatgtccagaactgcattagccgctgaggagagccaccgaaggccccaacaggggatgctcatcactggagactgcgactgggaagaacactgccccctccctcgggttgggtggcccagccagctggccagcctccactcccactctgccagacaccctgacacccacccaggctttgaagagcatggagggggagcctcagagctgacagtcctgcttagagcccttaaaaagacttgaaagttcactgggactcagtttaccttaatgccttagcagaagataaatcctacctagagacctttgttccttaaagcaataactgacaactctttgtagtcctccttgtgggtagttaagagtggggtcacccctttaactccaagcactacattttggcggctgccggcctctgggggaggtggcagttatgctgttactagtgattttagggctttgttatttaacttatttcaagggtgctgtgctcagccctgcccatggctgtgcagctccctccgtgcctcagatctgctgtagccagtgcagacctcactgtcgtgtccatgccacccccggcatggctccaggtggcctggtgactccatgatggacgatcttgctcccaggacctgcctcttcccaggcttcctggggaagagttgtacgcccaggcaacaagggctgagctgcgcttgcgtggctgtttcatgaccgcttgtttttctccttttggtgtaatgttttacaaatcctttggcctgagaactaatatgttaattgccttaaataaattaatagaaatctagtccgttaaaaaaaaaa

SEQ ID NO: 313428 - DNA, 9921 bp, Homo sapiens
  misc_feature (4486)..(4486): n is a, c, g, or t
ttatttatttatttatttatttttttgtctatttgttgtgtaggggctatttcttgggctaatgcaagggcagggaccgaacccgcaacctcatggttcctagtcggattcgttaaccactgcgccacgacaggaactcccctgtgtctgacagttttaaagaaagcttttaagtggtgactcgacatcccgaggtgttgcggtcctattatcgcaatgggcactctatcttaggcgttcaaataaaggactaggaagcaaacacccaagcaccggggaacagaacagaaagaaagacggaaggagccaagagttttggagccaactcctggagagggagcggctgaactgattcggaagttggatctctttgtacacaggaatgcggagagaaaaaaaacaaaacccaccccattgcttcatttcccctccaagcctgagcactttctattgtgcaatgaaaaggcttttcacgttgagaaaaatgaatcccgaatttgctctgcaaagggatgagcgcgcctctgggcgccagcctgctctcagctgggcgcggagaccgcgcggtggccgcagggcggccgcggccagggcgctccagggcgcgccctccgcgagcggctccggggtgacgcccgccggagagctggactcccccttccgcgggcgcctgcactggctcttagccagccgagggcccgggtgcagatagtccgggaaccccgagggcggagagctccccactacgcctgggcctcccagggatggcagctccgagagccccctagacccggtgccttgcaggacgcctctggagatcaggagggctggcggcgcattcggcgtccgggaggccgggccccggacgcgcgaggagcgcggggcgcgggaaggcaggcgggtgcacatgggtgccggcgggcgagctgcggggggagggggggcggggtgtggcctccccgcctcccgggcgggatttgcatgtgtgtggtggccccagacttcctgctccttctacgctgcaggtacgcgcgggccgggcggggcgggcgggcggcgggcgcgccaagacgtgggcacctcctcacccggaccccgggccccgccgagccgcctcctggctcccgtggccgccagcccgccccggccgcaccgagcgtcgggatccgaggtgggagcgtacccctccccgctccccggacgcctcagtcctccgcactgagcttggccacgcgcccctaggcgccccccacgccctgggccccggagggccgcagccatgagtgaaatgtccagctttcttcacatcggggacatcgtctccctgtacgccgagggctccgtcaatggcttcatcagcactttggggctggtggatgaccgctgtgtggtggagcccgcggccggggacctggacaacccccctaagaagttccgtgactgcctcttcaaggtgtgccccatgaaccgctactcggcccagaagcagtactggaaggccaagcagactaagcaggacaaggagaagatcgctgatgtggtgttgctgcagaagctgcagcatgcggcgcagatggagcagaagcaaaatgacacggagaacaagaaggtgcatggggatgtcgtgaagtatggcagtgtgatccagctcctgcacatgaagagcaacaagtacctgacagtgaacaagcggcttccggccttgctggagaagaacgccatgcgggtgactctggatgccacaggcaacgagggttcctggctcttcatccagcccttctggaagctgcggagcaacggggacaacgtggtcgtgggggacaaggtgatcctgaatcctgtcaatgccgggcagcctctgcatgccagcaattacgagctcagcgacaacgccggctgcaaggaggtcaattctgtgaactgcaacaccagctggaagatcaacctgtttatgcagtttcgggaccacctggaggaggtgttgaaagggggagacgtggtgcggctgttccatgcggagcaggagaagttcctgacgtgtgacgagtacaagggcaagctgcaggtgttcctgcgaactacactgcgccagtctgccacctcggccaccagctccaatgctctctgggaggtggaggtggtccaccacgacccctgccgtggaggagctgggcactggaatggcttgtaccgcttcaagcacctggctacaggcaactacctggctgctgaggagaaccccagttacaaaggtgatgcctcagatcccaaggcagcaggaatgggggcacagggccgcacaggccgcaggaatgctggggagaagatcaagtactgcctggtggctgtgcctcatggcaatgacatcgcctctctctttgagctggaccccaccaccttgcagaaaaccgactctttcgtgccccggaactcgtacgtccggctgcggcacctctgcaccaacacgtggattcagagcaccaatgtgcccattgacatcgaggaggagcggcccatccggctcatgctgggcacctgccccaccaaggaggacaaggaggcctttgccatcgtgtcagtgcccgtgtctgagatccgagacctggactttgccaatgacgccagctccatgctggccagtgccgtggagaaactcaacgagggcttcatcagccagaatgaccgcaggtttgtcatccagctgctggaagacctggtgttctttgtcagcgatgtccccaacaatgggcagaatgtcctggacatcatggtcactaagcccaaccgggaacggcagaagctgatgagggagcagaacatcctcaaacaggtctttggcattctgaaggccccgttccgtgagaaggggggtgaaggtcccctggtgcggctggaggagctgtcagaccagaagaacgccccctaccagcacatgttccgcctgtgctaccgcgtgttgcggcattcccaggaggactaccgcaagaaccaggagcacattgccaagcagtttgggatgatgcagtcccagattggctacgacatcctggccgaggacaccatcactgccctgctgcacaacaaccgcaagctcctggaaaagcacatcaccaagaccgaggtggagaccttcgtcagccttgtgcgcaagaaccgggagcccaggttcctggactacctctctgacctgtgtgtgtccaaccacatcgccatccccgtcacccaagagctcatctgcaagtgtgtgctggaccccaagaacagtgacattctcatccggaccgagcttcggcccgtgaaggagatggcccaatcccacgagtacctgagcatcgagtactcagaagaggaagtgtggctcacgtggactgacaagaataacgagcatcatgagaagagtgtgaggcagctggcccaggaggcgcgggccggcaacgcccacgacgagaatgtgctcagctactacaggtaccagctgaagctctttgcccgcatgtgcttggaccgccagtacttggccatcgacgagatctcccagcagctgggcgtggacctgattttcctgtgcatggcagacgagatgctgccctttgacctgcgcgcctccttctgccacctgatgctgcacgtgcacgtggaccgtgacccccaggagctggtcacgccggtcaagtttgcccgtctctggactgagatccccacagccatcaccatcaaggactatgattccaacctcaacgcgtcccgagatgacaagaagaacaagtttgccaacaccatggagttcgtggaggactacctcaacaatgtagtcagcgaggccgtgccctttgccaacgaggagaagaacaagctcacttttgaggtggtcagcctggcgcacaatctcatctacttcggcttctacagcttcagcgagctgctgcggctcactcgcacactgctgggcatcatcgactgtgtgcaggggcccccggccatgctgcaggcctatgaggaccccggtggcaagaatgtgcggcggtccatccagggcgtggggcacatgatgtccaccatggtgctgagccgcaagcagtccgtcttcagtgcccccagcctgtctgctggggccagtgctgctgagccgctggacagaagcaagtttgaggagaatgaggacattgtggtgatggagaccaagctgaagatcctggaaatccttcagttcatcctcaacgtccgcctggattaccgcatatcctacctgctgtctgtcttcaagaaggagtttgtggaggtgtttcccatgcaggacagtggggctgatggcacagcccctgccttcgactctaccactgccaacatgaacctggatcgcatcggggagcaggcggaggccatgtttggagtggggaagacaagcagcatgctggaggtggatgacgagggcggccgcatgttcctgcgcgtgctcatccacctcaccatgcacgactatgcgccnctggtctcgggtgccctgcagctgctcttcaagcacttcagccagcgccaggaggccatgcacaccttcaagcaggttcagctgctgatctcagcgcaggacgtggagaactacaaggtgatcaagtcggagctggaccggctgcggaccatggtggagaagtcagagctgtgggtggacaagaagggcagtggcaagggtgaggaggtggaggcaggcgccgccaaggacaagaaagagcgtcccacggacgaggagggctttctgcacccaccaggggagaaaagcagtgagaactaccagatcgtcaagggcatcctggaaaggctgaacaagatgtgcggggttggggagcaaatgaggaagaagcagcaacggctgctgaagaacatggatgcccacaaggtcatgctggacctgctgcagatcccctatgacaagggtgatgccaagatgatggagatcctgcgctacacgcaccagttcctgcagaagttctgtgcagggaaccccggcaaccaggccctgctgcacaaacacctgcacctcttcctcacgccagggctcctggaggcagagaccatgcagcacatcttcctgaacaactatcagctctgctccgagatcagcgagcctgtgttgcagcacttcgtgcacctgctggccacgcacgggcgccatgtgcagtacctggacttcctgcacaccgtcattaaggccgagggcaagtacgtcaagaagtgccaggacatgatcatgactgagctgaccaatgcaggtgacgatgtggtcgtgttctacaatgataaggcatcgctggcccacctgctggacatgatgaaggccgcccgcgacggcgtggaggaccacagccccctcatgtaccacatttccctggtggacctgctggccgcctgtgccgagggcaaaaacgtctacactgagatcaagtgcacctccctgctgccgctggaggacgtggtgtctgtggtgacgcatgaggactgcatcactgaggtgaaaatggcctatgtgaacttcgtgaaccactgctacgtggacacggaggtggagatgaaggagatctacaccagcaaccacatctggacgctctttgagaacttcaccctggacatggctcgggtctgcagcaagcgtgagaagcgcgtggctgaccccaccttggagaagtacgtgctgagcgttgtgctggacaccatcaacgccttcttcagctccccattctctgagaacagcacttccctgcagacacaccagacgattgtggtgcagctgctgcagtctaccacacgcctcctcgagtgtccgtggctacagcagcagcacaagggctccgtggaggcctgcatccggaccctcgccatggtggccaagggccgggccatcttgctgcccatggacctggatgcccacatcagctcgatgctcagcagtggagccagctgtgcagctgccgcccagcggaacgcctccagctacaaggcaaccacgcgggccttcccccgcgtcacccccaccgccaaccagtgggactacaagaacatcattgagaagctgcaggacatcatcacagccctggaggagcggctgaagcccctggtacaggctgagctgtccgtgctggtggatgtcctgcactggcctgagctgctcttcctggagggcagtgaggcctaccagcgctgcgagagtgggggcttcctgtccaagctgatccagcacaccaaggacctcatggagtcggaggagaagctgtgcatcaaggtgctgcggaccctgcagcagatgctgctcaagaagaccaagtacggggaccggggcaaccagctgcgcaagatgctgctgcaaaactacctccagaaccggaagtccacctcgcggggggaccttcccgaccccataggcactggcctggacccagactggtcggcaatcgcagccacccagtgccggctggacaaggagggggccaccaagttggtatgcgacctcatcaccagcaccaagaacgagaagatcttccaggagagcatcggcctggccatccacctgctggatggtggcaacacagagatccagaaatccttccacaacctgatgatgagtgacaagaagtcagagcgcttcttcaaggtgctgcacgaccgcatgaagcgggcccagcaggagaccaagtccacggtggcagtcaacatgaatgacctgggcagccagccacatgaggaccgcgagccagtcgaccccaccaccaaaggccgcgtggcctccttctcgatacctggctcctcatcccgctactcgctgggccccagcctgcgccgggggcacgaggtgagcgaacgtgtgcagagcagtgagatgggcacatccgtgctcatcatgcagcccatcctgcgctttctgcagctgctgtgtgagaaccacaaccgggacctgcagaacttcctgcgctgtcagaacaacaaaaccaactacaacttggtatgcgagacgctgcagttcctggacatcatgtgcggcagcaccacgggcggcctggggctgctggggctctacatcaatgaggacaacgtgggcctcgtcatccagaccttggagaccctcactgagtactgccagggcccctgccatgagaaccagacttgcattgtgactcacgagtccaatggcatagacatcatcaccgcactgatcctcaatgacatcagccccctgtgcaagtaccgcatggatctggtgctgcagctcaaggacaatgcctccaagctgctcctggctctgatggagagccggcatgacagtgaaaatgctgagcgaatcctcatcagcctgcggccccaggagctggtggacgtcatcaagaaggcctacctgcaggaggaagagcgtgagaactcggaggtgagcccacgtgaagtgggccataacatctatatcctggcgctgcagctctccaggcacaataaacagctgcagcacctgctgaagccggtgaagcgcattcaagaggaggaggccgagggtatctcttccatgctcagcctcaacaacaagcagctgtcacagatgctcaagtcctcagcgccagcacaggaggaggaggaagaccccctggcctactatgagaaccacacgtcccagatcgagattgtgcggcaggaccgcagcatggagcagatcgtgttcccagtgcccggcatctgccagttcctgacggaggaaaccaagcaccggctcttcaccactactgagcaggacgagcagggcagcaaagtgagcgacttcttcgaccagtcctccttcctgcacaacgagatggagtggcagcgcaagctccgcagcatgccgctgatctactggttctcccgccgcatgaccctgtggggcagcatctccttcaacctggccgtgtttatcaacatcatcattgccttcttctacccttacatggagggcgcgtccacagctgaccaacaagatcgtgtttgtggtgagcttcgtgggcaaccgtggcaccttcatccggggctataaggccatggtcatggacatggaattcctctaccacgtgggctacatcctgaccagtgtcctgggcctctttgctcatgagctgttctacagcatcctgctctttgacctcatctaccgcgaggagacgctgttcaacgtcatcaagagtgtgacccgcaatggccgctccatcctgctgacagccctgctggccctcatcctggtctacctcttctccatcgtcggcttcctcttcctcaaggatgacttcattctcgaggtcgaccggctgcccaacaaccactccacagccagccccctggggatgccacatggagctgctgcatttgtggacacctgcagtggggacaagatggactgtgtctcagggctctcggtgcctgaggtcctggaagaggacagggagctggacagcacagagcgggcctgtgacactctgttgatgtgcatcgtcactgtcatgaaccatgggctacgcaacggtggtggcgtgggcgacattctccgcaagccctccaaagatgagtctctcttcccagcccgagtggtctatgacctcctgttcttcttcatcgtcatcatcattgtgctgaacctcatctttggggtaatcatcgacaccttcgctgacctgcgtagtgagaagcagaagaaggaggagattcttaagacgacatgcttcatctgtggtctggagagggacaagtttgataacaagacagtgtcatttgaggaacacatcaagctggagcacaacatgtggaactacttgtacttcattgtgctggtccgcgtgaagaacaagaccgactacacgggccctgagagctacgtggcccagatgatcaagaacaagaacctggactggttcccccggatgcgggccatgtcccttgtcagcaatgagggcgagggggagcagaatgagattcggattctccaggacaagctcaactccaccatgaagctggtgtcccacctcactgcccagctcaacgagctcaaggagcagatgacggagcagcggaaacgcaggcaacgcctaggctttgtggatgtccagaactgcattagccgctgaggagagccaccgaaggccccaacaggggatgctcatcactggagactgcgactgggaagaacactgccccctccctcgggttgggtggcccagccagctggccagcctccactcccactctgccagacaccctgacacccacccaggctttgaagagcatggagggggagcctcagagctgacagtcctgcttagagcccttaaaaagacttgaaagttcactgggactcagtttaccttaatgccttagcagaagataaatcctacctagagacctttgttccttaaagcaataactgacaactctttgtagtcctccttgtgggtagttaagagtggggtcacccctttaactccaagcactacattttggcggctgccggcctctgggggaggtggcagttatgctgttactagtgattttagggctttgttatttaacttatttcaagggtgctgtgctcagccctgcccatggctgtgcagctccctccgtgcctcagatctgctgtagccagtgcagacctcactgtcgtgtccatgccacccccggcatggctccaggtggcctggtgactccatgatggacgatcttgctcccaggacctgcctcttcccaggcttcctggggaagagttgtacgcccaggcaacaagggctgagctgcgcttgcgtggctgtttcatgaccgcttgtttttctccttttggtgtaatgttttacaaatcctttggcctgagaactaatatgttaattgccttaaataaattaatagaaatctagtccgttaaaaaaaaaa

SEQ ID NO: 313429 - DNA, 5765 bp, Homo sapiens
  misc_feature (4)..(4): n is a, c, g, or t
  misc_feature (157)..(157): n is a, c, g, or t
gganccccaactctgccacccacagcccgcagcgccggagccggcggaggccatttttggagtggggaagacaagcagcatgctggaggtggatgacgagggcggccgcatgttcctgcgcgtgctcatccacctcaccatgcacgactatgcgccnctggtctcgggtgccctgcagctgctcttcaagcacttcagccagcgccaggaggccatgcacaccttcaagcaggttcagctgctgatctcagcgcaggacgtggagaactacaaggtgatcaagtcggagctggaccggctgcggaccatggtggagaagtcagagctgtgggtggacaagaagggcagtggcaagggtgaggaggtggaggcaggcgccgccaaggacaagaaagagcgtcccacggacgaggagggctttctgcacccaccaggggagaaaagcagtgagaactaccagatcgtcaagggcatcctggaaaggctgaacaagatgtgcggggttggggagcaaatgaggaagaagcagcaacggctgctgaagaacatggatgcccacaaggtcatgctggacctgctgcagatcccctatgacaagggtgatgccaagatgatggagatcctgcgctacacgcaccagttcctgcagaagttctgtgcagggaaccccggcaaccaggccctgctgcacaaacacctgcacctcttcctcacgccagggctcctggaggcagagaccatgcagcacatcttcctgaacaactatcagctctgctccgagatcagcgagcctgtgttgcagcacttcgtgcacctgctggccacgcacgggcgccatgtgcagtacctggacttcctgcacaccgtcattaaggccgagggcaagtacgtcaagaagtgccaggacatgatcatgactgagctgaccaatgcaggtgacgatgtggtcgtgttctacaatgataaggcatcgctggcccacctgctggacatgatgaaggccgcccgcgacggcgtggaggaccacagccccctcatgtaccacatttccctggtggacctgctggccgcctgtgccgagggcaaaaacgtctacactgagatcaagtgcacctccctgctgccgctggaggacgtggtgtctgtggtgacgcatgaggactgcatcactgaggtgaaaatggcctatgtgaacttcgtgaaccactgctacgtggacacggaggtggagatgaaggagatctacaccagcaaccacatctggacgctctttgagaacttcaccctggacatggctcgggtctgcagcaagcgtgagaagcgcgtggctgaccccaccttggagaagtacgtgctgagcgttgtgctggacaccatcaacgccttcttcagctccccattctctgagaacagcacttccctgcagacacaccagacgattgtggtgcagctgctgcagtctaccacacgcctcctcgagtgtccgtggctacagcagcagcacaagggctccgtggaggcctgcatccggaccctcgccatggtggccaagggccgggccatcttgctgcccatggacctggatgcccacatcagctcgatgctcagcagtggagccagctgtgcagctgccgcccagcggaacgcctccagctacaaggcaaccacgcgggccttcccccgcgtcacccccaccgccaaccagtgggactacaagaacatcattgagaagctgcaggacatcatcacagccctggaggagcggctgaagcccctggtacaggctgagctgtccgtgctggtggatgtcctgcactggcctgagctgctcttcctggagggcagtgaggcctaccagcgctgcgagagtgggggcttcctgtccaagctgatccagcacaccaaggacctcatggagtcggaggagaagctgtgcatcaaggtgctgcggaccctgcagcagatgctgctcaagaagaccaagtacggggaccggggcaaccagctgcgcaagatgctgctgcaaaactacctccagaaccggaagtccacctcgcggggggaccttcccgaccccataggcactggcctggacccagactggtcggcaatcgcagccacccagtgccggctggacaaggagggggccaccaagttggtatgcgacctcatcaccagcaccaagaacgagaagatcttccaggagagcatcggcctggccatccacctgctggatggtggcaacacagagatccagaaatccttccacaacctgatgatgagtgacaagaagtcagagcgcttcttcaaggtgctgcacgaccgcatgaagcgggcccagcaggagaccaagtccacggtggcagtcaacatgaatgacctgggcagccagccacatgaggaccgcgagccagtcgaccccaccaccaaaggccgcgtggcctccttctcgatacctggctcctcatcccgctactcgctgggccccagcctgcgccgggggcacgaggtgagcgaacgtgtgcagagcagtgagatgggcacatccgtgctcatcatgcagcccatcctgcgctttctgcagctgctgtgtgagaaccacaaccgggacctgcagaacttcctgcgctgtcagaacaacaaaaccaactacaacttggtatgcgagacgctgcagttcctggacatcatgtgcggcagcaccacgggcggcctggggctgctggggctctacatcaatgaggacaacgtgggcctcgtcatccagaccttggagaccctcactgagtactgccagggcccctgccatgagaaccagacttgcattgtgactcacgagtccaatggcatagacatcatcaccgcactgatcctcaatgacatcagccccctgtgcaagtaccgcatggatctggtgctgcagctcaaggacaatgcctccaagctgctcctggctctgatggagagccggcatgacagtgaaaatgctgagcgaatcctcatcagcctgcggccccaggagctggtggacgtcatcaagaaggcctacctgcaggaggaagagcgtgagaactcggaggtgagcccacgtgaagtgggccataacatctatatcctggcgctgcagctctccaggcacaataaacagctgcagcacctgctgaagccggtgaagcgcattcaagaggaggaggccgagggtatctcttccatgctcagcctcaacaacaagcagctgtcacagatgctcaagtcctcagcgccagcacaggaggaggaggaagaccccctggcctactatgagaaccacacgtcccagatcgagattgtgcggcaggaccgcagcatggagcagatcgtgttcccagtgcccggcatctgccagttcctgacggaggaaaccaagcaccggctcttcaccactactgagcaggacgagcagggcagcaaagtgagcgacttcttcgaccagtcctccttcctgcacaacgagatggagtggcagcgcaagctccgcagcatgccgctgatctactggttctcccgccgcatgaccctgtggggcagcatctccttcaacctggccgtgtttatcaacatcatcattgccttcttctacccttacatggagggcgcgtccacaggcgtgctggactcccctctcatctcattgctcttctggatcctcatctgcttctccatcgcggccctgttcaccaagcgctacagcatccgccccctcatcgtggcgctcatcctgcgctccatctactatctgggcatcgggcccacactcaacatcctgggtgccctcaatctgaccaacaagatcgtgtttgtggtgagcttcgtgggcaaccgtggcaccttcatccggggctataaggccatggtcatggacatggaattcctctaccacgtgggctacatcctgaccagtgtcctgggcctctttgctcatgagctgttctacagcatcctgctctttgacctcatctaccgcgaggagacgctgttcaacgtcatcaagagtgtgacccgcaatggccgctccatcctgctgacagccctgctggccctcatcctggtctacctcttctccatcgtcggcttcctcttcctcaaggatgacttcattctcgaggtcgaccggctgcccaacaaccactccacagccagccccctggggatgccacatggagctgctgcatttgtggacacctgcagtggggacaagatggactgtgtctcagggctctcggtgcctgaggtcctggaagaggacagggagctggacagcacagagcgggcctgtgacactctgttgatgtgcatcgtcactgtcatgaaccatgggctacgcaacggtggtggcgtgggcgacattctccgcaagccctccaaagatgagtctctcttcccagcccgagtggtctatgacctcctgttcttcttcatcgtcatcatcattgtgctgaacctcatctttggggtaatcatcgacaccttcgctgacctgcgtagtgagaagcagaagaaggaggagattcttaagacgacatgcttcatctgtggtctggagagggacaagtttgataacaagacagtgtcatttgaggaacacatcaagctggagcacaacatgtggaactacttgtacttcattgtgctggtccgcgtgaagaacaagaccgactacacgggccctgagagctacgtggcccagatgatcaagaacaagaacctggactggttcccccggatgcgggccatgtcccttgtcagcaatgagggcgagggggagcagaatgagattcggattctccaggacaagctcaactccaccatgaagctggtgtcccacctcactgcccagctcaacgagctcaaggagcagatgacggagcagcggaaacgcaggcaacgcctaggctttgtggatgtccagaactgcattagccgctgaggagagccaccgaaggccccaacaggggatgctcatcactggagactgcgactgggaagaacactgccccctccctcgggttgggtggcccagccagctggccagcctccactcccactctgccagacaccctgacacccacccaggctttgaagagcatggagggggagcctcagagctgacagtcctgcttagagcccttaaaaagacttgaaagttcactgggactcagtttaccttaatgccttagcagaagataaatcctacctagagacctttgttccttaaagcaataactgacaactctttgtagtcctccttgtgggtagttaagagtggggtcacccctttaactccaagcactacattttggcggctgccggcctctgggggaggtggcagttatgctgttactagtgattttagggctttgttatttaacttatttcaagggtgctgtgctcagccctgcccatggctgtgcagctccctccgtgcctcagatctgctgtagccagtgcagacctcactgtcgtgtccatgccacccccggcatggctccaggtggcctggtgactccatgatggacgatcttgctcccaggacctgcctcttcccaggcttcctggggaagagttgtacgcccaggcaacaagggctgagctgcgcttgcgtggctgtttcatgaccgcttgtttttctccttttggtgtaatgttttacaaatcctttggcctgagaactaatatgttaattgccttaaataaattaatagaaatctagtccgttaaaaaaaaaa

SEQ ID NO: 313430 - DNA, 3320 bp, Homo sapiens
cccagtccgttcgactgagccatcccgctactcgctgggccccagcctgcgccgggggcacgaggtgagcgaacgtgtgcagagcagtgagatgggcacatccgtgctcatcatgcagcccatcctgcgctttctgcagctgctgtgtgagaaccacaaccgggacctgcagaacttcctgcgctgtcagaacaacaaaaccaactacaacttggtatgcgagacgctgcagttcctggacatcatgtgcggcagcaccacgggcggcctggggctgctggggctctacatcaatgaggacaacgtgggcctcgtcatccagaccttggagaccctcactgagtactgccagggcccctgccatgagaaccagacttgcattgtgactcacgagtccaatggcatagacatcatcaccgcactgatcctcaatgacatcagccccctgtgcaagtaccgcatggatctggtgctgcagctcaaggacaatgcctccaagctgctcctggctctgatggagagccggcatgacagtgaaaatgctgagcgaatcctcatcagcctgcggccccaggagctggtggacgtcatcaagaaggcctacctgcaggaggaagagcgtgagaactcggaggtgagcccacgtgaagtgggccataacatctatatcctggcgctgcagctctccaggcacaataaacagctgcagcacctgctgaagccggtgaagcgcattcaagaggaggaggccgagggtatctcttccatgctcagcctcaacaacaagcagctgtcacagatgctcaagtcctcagcgccagcacaggaggaggaggaagaccccctggcctactatgagaaccacacgtcccagatcgagattgtgcggcaggaccgcagcatggagcagatcgtgttcccagtgcccggcatctgccagttcctgacggaggaaaccaagcaccggctcttcaccactactgagcaggacgagcagggcagcaaagtgagcgacttcttcgaccagtcctccttcctgcacaacgagatggagtggcagcgcaagctccgcagcatgccgctgatctactggttctcccgccgcatgaccctgtggggcagcatctccttcaacctggccgtgtttatcaacatcatcattgccttcttctacccttacatggagggcgcgtccacaggcgtgctggactcccctctcatctcattgctcttctggatcctcatctgcttctccatcgcggccctgttcaccaagcgctacagcatccgccccctcatcgtggcgctcatcctgcgctccatctactatctgggcatcgggcccacactcaacatcctgggtgccctcaatctgaccaacaagatcgtgtttgtggtgagcttcgtgggcaaccgtggcaccttcatccggggctataaggccatggtcatggacatggaattcctctaccacgtgggctacatcctgaccagtgtcctgggcctctttgctcatgagctgttctacagcatcctgctctttgacctcatctaccgcgaggagacgctgttcaacgtcatcaagagtgtgacccgcaatggccgctccatcctgctgacagccctgctggccctcatcctggtctacctcttctccatcgtcggcttcctcttcctcaaggatgacttcattctcgaggtcgaccggctgcccaacaaccactccacagccagccccctggggatgccacatggagctgctgcatttgtggacacctgcagtggggacaagatggactgtgtctcagggctctcggtgcctgaggtcctggaagaggacagggagctggacagcacagagcgggcctgtgacactctgttgatgtgcatcgtcactgtcatgaaccatgggctacgcaacggtggtggcgtgggcgacattctccgcaagccctccaaagatgagtctctcttcccagcccgagtggtctatgacctcctgttcttcttcatcgtcatcatcattgtgctgaacctcatctttggggtaatcatcgacaccttcgctgacctgcgtagtgagaagcagaagaaggaggagattcttaagacgacatgcttcatctgtggtctggagagggacaagtttgataacaagacagtgtcatttgaggaacacatcaagctggagcacaacatgtggaactacttgtacttcattgtgctggtccgcgtgaagaacaagaccgactacacgggccctgagagctacgtggcccagatgatcaagaacaagaacctggactggttcccccggatgcgggccatgtcccttgtcagcaatgagggcgagggggagcagaatgagattcggattctccaggacaagctcaactccaccatgaagctggtgtcccacctcactgcccagctcaacgagctcaaggagcagatgacggagcagcggaaacgcaggcaacgcctaggctttgtggatgtccagaactgcattagccgctgaggagagccaccgaaggccccaacaggggatgctcatcactggagactgcgactgggaagaacactgccccctccctcgggttgggtggcccagccagctggccagcctccactcccactctgccagacaccctgacacccacccaggctttgaagagcatggagggggagcctcagagctgacagtcctgcttagagcccttaaaaagacttgaaagttcactgggactcagtttaccttaatgccttagcagaagataaatcctacctagagacctttgttccttaaagcaataactgacaactctttgtagtcctccttgtgggtagttaagagtggggtcacccctttaactccaagcactacattttggcggctgccggcctctgggggaggtggcagttatgctgttactagtgattttagggctttgttatttaacttatttcaagggtgctgtgctcagccctgcccatggctgtgcagctccctccgtgcctcagatctgctgtagccagtgcagacctcactgtcgtgtccatgccacccccggcatggctccaggtggcctggtgactccatgatggacgatcttgctcccaggacctgcctcttcccaggcttcctggggaagagttgtacgcccaggcaacaagggctgagctgcgcttgcgtggctgtttcatgaccgcttgtttttctccttttggtgtaatgttttacaaatcctttggcctgagaactaatatgttaattgccttaaataaattaatagaaatctagtccgttaaaaaaaaaa

SEQ ID NO: 313431 - DNA, 1548 bp, Homo sapiens
tcgaggcgggtggtaatcggccgaggctgtgtctcaggctctcggtgcctgaggtcctggaagaggacagggagctggacagcacagagcgggcctgtgacactctgttgatgtgcatcgtcactgtcatgaaccatgggctacgcaacggtggtggcgtgggcgacattctccgcaagccctccaaagatgagtctctcttcccagcccgagtggtctatgacctcctgttcttcttcatcgtcatcatcattgtgctgaacctcatctttggggtaatcatcgacaccttcgctgacctgcgtagtgagaagcagaagaaggaggagattcttaagacgacatgcttcatctgtggtctggagagggacaagtttgataacaagacagtgtcatttgaggaacacatcaagctggagcacaacatgtggaactacttgtacttcattgtgctggtccgcgtgaagaacaagaccgactacacgggccctgagagctacgtggcccagatgatcaagaacaagaacctggactggttcccccggatgcgggccatgtcccttgtcagcaatgagggcgagggggagcagaatgagattcggattctccaggacaagctcaactccaccatgaagctggtgtcccacctcactgcccagctcaacgagctcaaggagcagatgacggagcagcggaaacgcaggcaacgcctaggctttgtggatgtccagaactgcattagccgctgaggagagccaccgaaggccccaacaggggatgctcatcactggagactgcgactgggaagaacactgccccctccctcgggttgggtggcccagccagctggccagcctccactcccactctgccagacaccctgacacccacccaggctttgaagagcatggagggggagcctcagagctgacagtcctgcttagagcccttaaaaagacttgaaagttcactgggactcagtttaccttaatgccttagcagaagataaatcctacctagagacctttgttccttaaagcaataactgacaactctttgtagtcctccttgtgggtagttaagagtggggtcacccctttaactccaagcactacattttggcggctgccggcctctgggggaggtggcagttatgctgttactagtgattttagggctttgttatttaacttatttcaagggtgctgtgctcagccctgcccatggctgtgcagctccctccgtgcctcagatctgctgtagccagtgcagacctcactgtcgtgtccatgccacccccggcatggctccaggtggcctggtgactccatgatggacgatcttgctcccaggacctgcctcttcccaggcttcctggggaagagttgtacgcccaggcaacaagggctgagctgcgcttgcgtggctgtttcatgaccgcttgtttttctccttttggtgtaatgttttacaaatcctttggcctgagaactaatatgttaattgccttaaataaattaatagaaatctagtccgttaaaaaaaaaa

SEQ ID NO: 313432 - DNA, 9665 bp, Homo sapiens
  misc_feature (4486)..(4486): n is a, c, g, or t
ttatttatttatttatttatttttttgtctatttgttgtgtaggggctatttcttgggctaatgcaagggcagggaccgaacccgcaacctcatggttcctagtcggattcgttaaccactgcgccacgacaggaactcccctgtgtctgacagttttaaagaaagcttttaagtggtgactcgacatcccgaggtgttgcggtcctattatcgcaatgggcactctatcttaggcgttcaaataaaggactaggaagcaaacacccaagcaccggggaacagaacagaaagaaagacggaaggagccaagagttttggagccaactcctggagagggagcggctgaactgattcggaagttggatctctttgtacacaggaatgcggagagaaaaaaaacaaaacccaccccattgcttcatttcccctccaagcctgagcactttctattgtgcaatgaaaaggcttttcacgttgagaaaaatgaatcccgaatttgctctgcaaagggatgagcgcgcctctgggcgccagcctgctctcagctgggcgcggagaccgcgcggtggccgcagggcggccgcggccagggcgctccagggcgcgccctccgcgagcggctccggggtgacgcccgccggagagctggactcccccttccgcgggcgcctgcactggctcttagccagccgagggcccgggtgcagatagtccgggaaccccgagggcggagagctccccactacgcctgggcctcccagggatggcagctccgagagccccctagacccggtgccttgcaggacgcctctggagatcaggagggctggcggcgcattcggcgtccgggaggccgggccccggacgcgcgaggagcgcggggcgcgggaaggcaggcgggtgcacatgggtgccggcgggcgagctgcggggggagggggggcggggtgtggcctccccgcctcccgggcgggatttgcatgtgtgtggtggccccagacttcctgctccttctacgctgcaggtacgcgcgggccgggcggggcgggcgggcggcgggcgcgccaagacgtgggcacctcctcacccggaccccgggccccgccgagccgcctcctggctcccgtggccgccagcccgccccggccgcaccgagcgtcgggatccgaggtgggagcgtacccctccccgctccccggacgcctcagtcctccgcactgagcttggccacgcgcccctaggcgccccccacgccctgggccccggagggccgcagccatgagtgaaatgtccagctttcttcacatcggggacatcgtctccctgtacgccgagggctccgtcaatggcttcatcagcactttggggctggtggatgaccgctgtgtggtggagcccgcggccggggacctggacaacccccctaagaagttccgtgactgcctcttcaaggtgtgccccatgaaccgctactcggcccagaagcagtactggaaggccaagcagactaagcaggacaaggagaagatcgctgatgtggtgttgctgcagaagctgcagcatgcggcgcagatggagcagaagcaaaatgacacggagaacaagaaggtgcatggggatgtcgtgaagtatggcagtgtgatccagctcctgcacatgaagagcaacaagtacctgacagtgaacaagcggcttccggccttgctggagaagaacgccatgcgggtgactctggatgccacaggcaacgagggttcctggctcttcatccagcccttctggaagctgcggagcaacggggacaacgtggtcgtgggggacaaggtgatcctgaatcctgtcaatgccgggcagcctctgcatgccagcaattacgagctcagcgacaacgccggctgcaaggaggtcaattctgtgaactgcaacaccagctggaagatcaacctgtttatgcagtttcgggaccacctggaggaggtgttgaaagggggagacgtggtgcggctgttccatgcggagcaggagaagttcctgacgtgtgacgagtacaagggcaagctgcaggtgttcctgcgaactacactgcgccagtctgccacctcggccaccagctccaatgctctctgggaggtggaggtggtccaccacgacccctgccgtggaggagctgggcactggaatggcttgtaccgcttcaagcacctggctacaggcaactacctggctgctgaggagaaccccagttacaaaggtgatgcctcagatcccaaggcagcaggaatgggggcacagggccgcacaggccgcaggaatgctggggagaagatcaagtactgcctggtggctgtgcctcatggcaatgacatcgcctctctctttgagctggaccccaccaccttgcagaaaaccgactctttcgtgccccggaactcgtacgtccggctgcggcacctctgcaccaacacgtggattcagagcaccaatgtgcccattgacatcgaggaggagcggcccatccggctcatgctgggcacctgccccaccaaggaggacaaggaggcctttgccatcgtgtcagtgcccgtgtctgagatccgagacctggactttgccaatgacgccagctccatgctggccagtgccgtggagaaactcaacgagggcttcatcagccagaatgaccgcaggtttgtcatccagctgctggaagacctggtgttctttgtcagcgatgtccccaacaatgggcagaatgtcctggacatcatggtcactaagcccaaccgggaacggcagaagctgatgagggagcagaacatcctcaaacaggtctttggcattctgaaggccccgttccgtgagaaggggggtgaaggtcccctggtgcggctggaggagctgtcagaccagaagaacgccccctaccagcacatgttccgcctgtgctaccgcgtgttgcggcattcccaggaggactaccgcaagaaccaggagcacattgccaagcagtttgggatgatgcagtcccagattggctacgacatcctggccgaggacaccatcactgccctgctgcacaacaaccgcaagctcctggaaaagcacatcaccaagaccgaggtggagaccttcgtcagccttgtgcgcaagaaccgggagcccaggttcctggactacctctctgacctgtgtgtgtccaaccacatcgccatccccgtcacccaagagctcatctgcaagtgtgtgctggaccccaagaacagtgacattctcatccggaccgagcttcggcccgtgaaggagatggcccaatcccacgagtacctgagcatcgagtactcagaagaggaagtgtggctcacgtggactgacaagaataacgagcatcatgagaagagtgtgaggcagctggcccaggaggcgcgggccggcaacgcccacgacgagaatgtgctcagctactacaggtaccagctgaagctctttgcccgcatgtgcttggaccgccagtacttggccatcgacgagatctcccagcagctgggcgtggacctgattttcctgtgcatggcagacgagatgctgccctttgacctgcgcgcctccttctgccacctgatgctgcacgtgcacgtggaccgtgacccccaggagctggtcacgccggtcaagtttgcccgtctctggactgagatccccacagccatcaccatcaaggactatgattccaacctcaacgcgtcccgagatgacaagaagaacaagtttgccaacaccatggagttcgtggaggactacctcaacaatgtagtcagcgaggccgtgccctttgccaacgaggagaagaacaagctcacttttgaggtggtcagcctggcgcacaatctcatctacttcggcttctacagcttcagcgagctgctgcggctcactcgcacactgctgggcatcatcgactgtgtgcaggggcccccggccatgctgcaggcctatgaggaccccggtggcaagaatgtgcggcggtccatccagggcgtggggcacatgatgtccaccatggtgctgagccgcaagcagtccgtcttcagtgcccccagcctgtctgctggggccagtgctgctgagccgctggacagaagcaagtttgaggagaatgaggacattgtggtgatggagaccaagctgaagatcctggaaatccttcagttcatcctcaacgtccgcctggattaccgcatatcctacctgctgtctgtcttcaagaaggagtttgtggaggtgtttcccatgcaggacagtggggctgatggcacagcccctgccttcgactctaccactgccaacatgaacctggatcgcatcggggagcaggcggaggccatgtttggagtggggaagacaagcagcatgctggaggtggatgacgagggcggccgcatgttcctgcgcgtgctcatccacctcaccatgcacgactatgcgccnctggtctcgggtgccctgcagctgctcttcaagcacttcagccagcgccaggaggccatgcacaccttcaagcaggttcagctgctgatctcagcgcaggacgtggagaactacaaggtgatcaagtcggagctggaccggctgcggaccatggtggagaagtcagagctgtgggtggacaagaagggcagtggcaagggtgaggaggtggaggcaggcgccgccaaggacaagaaagagcgtcccacggacgaggagggctttctgcacccaccaggggagaaaagcagtgagaactaccagatcgtcaagggcatcctggaaaggctgaacaagatgtgcggggttggggagcaaatgaggaagaagcagcaacggctgctgaagaacatggatgcccacaaggtcatgctggacctgctgcagatcccctatgacaagggtgatgccaagatgatggagatcctgcgctacacgcaccagttcctgcagaagttctgtgcagggaaccccggcaaccaggccctgctgcacaaacacctgcacctcttcctcacgccagggctcctggaggcagagaccatgcagcacatcttcctgaacaactatcagctctgctccgagatcagcgagcctgtgttgcagcacttcgtgcacctgctggccacgcacgggcgccatgtgcagtacctggacttcctgcacaccgtcattaaggccgagggcaagtacgtcaagaagtgccaggacatgatcatgactgagctgaccaatgcaggtgacgatgtggtcgtgttctacaatgataaggcatcgctggcccacctgctggacatgatgaaggccgcccgcgacggcgtggaggaccacagccccctcatgtaccacatttccctggtggacctgctggccgcctgtgccgagggcaaaaacgtctacactgagatcaagtgcacctccctgctgccgctggaggacgtggtgtctgtggtgacgcatgaggactgcatcactgaggtgaaaatggcctatgtgaacttcgtgaaccactgctacgtggacacggaggtggagatgaaggagatctacaccagcaaccacatctggacgctctttgagaacttcaccctggacatggctcgggtctgcagcaagcgtgagaagcgcgtggctgaccccaccttggagaagtacgtgctgagcgttgtgctggacaccatcaacgccttcttcagctccccattctctgagaacagcacttccctgcagacacaccagacgattgtggtgcagctgctgcagtctaccacacgcctcctcgagtgtccgtggctacagcagcagcacaagggctccgtggaggcctgcatccggaccctcgccatggtggccaagggccgggccatcttgctgcccatggacctggatgcccacatcagctcgatgctcagcagtggagccagctgtgcagctgccgcccagcggaacgcctccagctacaaggcaaccacgcgggccttcccccgcgtcacccccaccgccaaccagtgggactacaagaacatcattgagaagctgcaggacatcatcacagccctggaggagcggctgaagcccctggtacaggctgagctgtccgtgctggtggatgtcctgcactggcctgagctgctcttcctggagggcagtgaggcctaccagcgctgcgagagtgggggcttcctgtccaagctgatccagcacaccaaggacctcatggagtcggaggagaagctgtgcatcaaggtgctgcggaccctgcagcagatgctgctcaagaagaccaagtacggggaccggggcaaccagctgcgcaagatgctgctgcaaaactacctccagaaccggaagtccacctcgcggggggaccttcccgaccccataggcactggcctggacccagactggtcggcaatcgcagccacccagtgccggctggacaaggagggggccaccaagttggtatgcgacctcatcaccagcaccaagaacgagaagatcttccaggagagcatcggcctggccatccacctgctggatggtggcaacacagagatccagaaatccttccacaacctgatgatgagtgacaagaagtcagagcgcttcttcaaggtgctgcacgaccgcatgaagcgggcccagcaggagaccaagtccacggtggcagtcaacatgaatgacctgggcagccagccacatgaggaccgcgagccagtcgaccccaccaccaaaggccgcgtggcctccttctcgatacctggctcctcatcccgctactcgctgggccccagcctgcgccgggggcacgaggtgagcgaacgtgtgcagagcagtgagatgggcacatccgtgctcatcatgcagcccatcctgcgctttctgcagctgctgtgtgagaaccacaaccgggacctgcagaacttcctgcgctgtcagaacaacaaaaccaactacaacttggtatgcgagacgctgcagttcctggacatcatgtgcggcagcaccacgggcggcctggggctgctggggctctacatcaatgaggacaacgtgggcctcgtcatccagaccttggagaccctcactgagtactgccagggcccctgccatgagaaccagacttgcattgtgactcacgagtccaatggcatagacatcatcaccgcactgatcctcaatgacatcagccccctgtgcaagtaccgcatggatctggtgctgcagctcaaggacaatgcctccaagctgctcctggctctgatggagagccggcatgacagtgaaaatgctgagcgaatcctcatcagcctgcggccccaggagctggtggacgtcatcaagaaggcctacctgcaggaggaagagcgtgagaactcggaggtgagcccacgtgaagtgggccataacatctatatcctggcgctgcagctctccaggcacaataaacagctgcagcacctgctgaagccggtgaagcgcattcaagaggaggaggccgagggtatctcttccatgctcagcctcaacaacaagcagctgtcacagatgctcaagtcctcagcgccagcacaggaggaggaggaagaccccctggcctactatgagaaccacacgtcccagatcgagattgtgcggcaggaccgcagcatggagcagatcgtgttcccagtgcccggcatctgccagttcctgacggaggaaaccaagcaccggctcttcaccactactgagcaggacgagcagggcagcaaagtgagcgacttcttcgaccagtcctccttcctgcacaacgagatggagtggcagcgcaagctccgcagcatgccgctgatctactggttctcccgccgcatgaccctgtggggcagcatctccttcaacctggccgtgtttatcaacatcatcattgccttcttctacccttacatggagggcgcgtccacaggcgtgctggactcccctctcatctcattgctcttctggatcctcatctgcttctccatcgcggccctgttcaccaagcgctacagcatccgccccctcatcgtggcgctcatcctgcgctccatctactatctgggcatcgggcccacactcaacatcctgggtgccctcaatctgaccaacaagatcgtgtttgtggtgagcttcgtgggcaaccgtggcaccttcatccggggctataaggccatggtcatggacatggaattcctctaccacgtgggctacatcctgaccagtgtcctgggcctctttgctcatgagctgttctacagcatcctgctctttgacctcatctaccgcgaggagacgctgttcaacgtcatcaagagtgtgacccgcaatggccgctccatcctgctgacagccctgctggccctcatcctggtctacctcttctccatcgtcggcttcctcttcctcaaggatgacttcattctcgaggtcgaccggctgcccaacaaccactccacagccagccccctggggatgccacatggagctgctgcatttgtggacacctgcagtggggacaagatggactgtgtctcagggctctcggtgcctgaggtcctggaagaggacagggagctggacagcacagagcgggcctgtgacactctgttgatgtgcatcgtcactgtcatgaaccatgggctacgcaacggtggtggcgtgggcgacattctccgcaagccctccaaagatgagtctctcttcccagcccgagtggtctatgacctcctgttcttcttcatcgtcatcatcattgtgctgaacctcatctttggggtaatcatcgacaccttcgctgacctgcgtagtgagaagcagaagaaggaggagattcttaagacgacatgcttcatctgtggtctggagagggacaagtttgataacaagacagtgtcatttgaggaacacatcaagctggagcacaacatgtggaactacttgtacttcattgtgctggtccgcgtgaagaacaagaccgactacacgggccctgagagctacgtggcccagatgatcaaggtgtgagcaggggctgtgccaggcctgtgggcccaaaccagccattctagagtcatcactgtgcaccagaggcctcatggttttagcttctgagtaccctgggccctggagaggagtggccctatctgactgttggccctaggaggccaggcagaggggctcggacagctgcagacacttgttgaaaggtcagcagggcgaggagcagcagctggaagcagctctgggctgcacggaagccgctgctgcagaggggcctcctcacacttctgggtgtcaggaaaaatcccacagcaaacccatgcgccccgaagaacacgtgtggtatccctgggcctgtcgtgcagtgatgctgaggaggggtggagttggggagaccctgcccgtggccagtgatctgtgggccgctctcagggagtgttttctagctcggtgggaaggcaggctgcttcctaaaaagtctgaattagatgatcctgggctgaaggggagcctggaaaaactttaaaaatcacttacagaaatcaaatgtcatctgtccaatttctgtaataatggagtgaaggcaatgaatcataaagaaggaattatttatcgttta

SEQ ID NO: 313433 - DNA, 8757 bp, Homo sapiens
  misc_feature (4486)..(4486): n is a, c, g, or t
ttatttatttatttatttatttttttgtctatttgttgtgtaggggctatttcttgggctaatgcaagggcagggaccgaacccgcaacctcatggttcctagtcggattcgttaaccactgcgccacgacaggaactcccctgtgtctgacagttttaaagaaagcttttaagtggtgactcgacatcccgaggtgttgcggtcctattatcgcaatgggcactctatcttaggcgttcaaataaaggactaggaagcaaacacccaagcaccggggaacagaacagaaagaaagacggaaggagccaagagttttggagccaactcctggagagggagcggctgaactgattcggaagttggatctctttgtacacaggaatgcggagagaaaaaaaacaaaacccaccccattgcttcatttcccctccaagcctgagcactttctattgtgcaatgaaaaggcttttcacgttgagaaaaatgaatcccgaatttgctctgcaaagggatgagcgcgcctctgggcgccagcctgctctcagctgggcgcggagaccgcgcggtggccgcagggcggccgcggccagggcgctccagggcgcgccctccgcgagcggctccggggtgacgcccgccggagagctggactcccccttccgcgggcgcctgcactggctcttagccagccgagggcccgggtgcagatagtccgggaaccccgagggcggagagctccccactacgcctgggcctcccagggatggcagctccgagagccccctagacccggtgccttgcaggacgcctctggagatcaggagggctggcggcgcattcggcgtccgggaggccgggccccggacgcgcgaggagcgcggggcgcgggaaggcaggcgggtgcacatgggtgccggcgggcgagctgcggggggagggggggcggggtgtggcctccccgcctcccgggcgggatttgcatgtgtgtggtggccccagacttcctgctccttctacgctgcaggtacgcgcgggccgggcggggcgggcgggcggcgggcgcgccaagacgtgggcacctcctcacccggaccccgggccccgccgagccgcctcctggctcccgtggccgccagcccgccccggccgcaccgagcgtcgggatccgaggtgggagcgtacccctccccgctccccggacgcctcagtcctccgcactgagcttggccacgcgcccctaggcgccccccacgccctgggccccggagggccgcagccatgagtgaaatgtccagctttcttcacatcggggacatcgtctccctgtacgccgagggctccgtcaatggcttcatcagcactttggggctggtggatgaccgctgtgtggtggagcccgcggccggggacctggacaacccccctaagaagttccgtgactgcctcttcaaggtgtgccccatgaaccgctactcggcccagaagcagtactggaaggccaagcagactaagcaggacaaggagaagatcgctgatgtggtgttgctgcagaagctgcagcatgcggcgcagatggagcagaagcaaaatgacacggagaacaagaaggtgcatggggatgtcgtgaagtatggcagtgtgatccagctcctgcacatgaagagcaacaagtacctgacagtgaacaagcggcttccggccttgctggagaagaacgccatgcgggtgactctggatgccacaggcaacgagggttcctggctcttcatccagcccttctggaagctgcggagcaacggggacaacgtggtcgtgggggacaaggtgatcctgaatcctgtcaatgccgggcagcctctgcatgccagcaattacgagctcagcgacaacgccggctgcaaggaggtcaattctgtgaactgcaacaccagctggaagatcaacctgtttatgcagtttcgggaccacctggaggaggtgttgaaagggggagacgtggtgcggctgttccatgcggagcaggagaagttcctgacgtgtgacgagtacaagggcaagctgcaggtgttcctgcgaactacactgcgccagtctgccacctcggccaccagctccaatgctctctgggaggtggaggtggtccaccacgacccctgccgtggaggagctgggcactggaatggcttgtaccgcttcaagcacctggctacaggcaactacctggctgctgaggagaaccccagttacaaaggtgatgcctcagatcccaaggcagcaggaatgggggcacagggccgcacaggccgcaggaatgctggggagaagatcaagtactgcctggtggctgtgcctcatggcaatgacatcgcctctctctttgagctggaccccaccaccttgcagaaaaccgactctttcgtgccccggaactcgtacgtccggctgcggcacctctgcaccaacacgtggattcagagcaccaatgtgcccattgacatcgaggaggagcggcccatccggctcatgctgggcacctgccccaccaaggaggacaaggaggcctttgccatcgtgtcagtgcccgtgtctgagatccgagacctggactttgccaatgacgccagctccatgctggccagtgccgtggagaaactcaacgagggcttcatcagccagaatgaccgcaggtttgtcatccagctgctggaagacctggtgttctttgtcagcgatgtccccaacaatgggcagaatgtcctggacatcatggtcactaagcccaaccgggaacggcagaagctgatgagggagcagaacatcctcaaacaggtctttggcattctgaaggccccgttccgtgagaaggggggtgaaggtcccctggtgcggctggaggagctgtcagaccagaagaacgccccctaccagcacatgttccgcctgtgctaccgcgtgttgcggcattcccaggaggactaccgcaagaaccaggagcacattgccaagcagtttgggatgatgcagtcccagattggctacgacatcctggccgaggacaccatcactgccctgctgcacaacaaccgcaagctcctggaaaagcacatcaccaagaccgaggtggagaccttcgtcagccttgtgcgcaagaaccgggagcccaggttcctggactacctctctgacctgtgtgtgtccaaccacatcgccatccccgtcacccaagagctcatctgcaagtgtgtgctggaccccaagaacagtgacattctcatccggaccgagcttcggcccgtgaaggagatggcccaatcccacgagtacctgagcatcgagtactcagaagaggaagtgtggctcacgtggactgacaagaataacgagcatcatgagaagagtgtgaggcagctggcccaggaggcgcgggccggcaacgcccacgacgagaatgtgctcagctactacaggtaccagctgaagctctttgcccgcatgtgcttggaccgccagtacttggccatcgacgagatctcccagcagctgggcgtggacctgattttcctgtgcatggcagacgagatgctgccctttgacctgcgcgcctccttctgccacctgatgctgcacgtgcacgtggaccgtgacccccaggagctggtcacgccggtcaagtttgcccgtctctggactgagatccccacagccatcaccatcaaggactatgattccaacctcaacgcgtcccgagatgacaagaagaacaagtttgccaacaccatggagttcgtggaggactacctcaacaatgtagtcagcgaggccgtgccctttgccaacgaggagaagaacaagctcacttttgaggtggtcagcctggcgcacaatctcatctacttcggcttctacagcttcagcgagctgctgcggctcactcgcacactgctgggcatcatcgactgtgtgcaggggcccccggccatgctgcaggcctatgaggaccccggtggcaagaatgtgcggcggtccatccagggcgtggggcacatgatgtccaccatggtgctgagccgcaagcagtccgtcttcagtgcccccagcctgtctgctggggccagtgctgctgagccgctggacagaagcaagtttgaggagaatgaggacattgtggtgatggagaccaagctgaagatcctggaaatccttcagttcatcctcaacgtccgcctggattaccgcatatcctacctgctgtctgtcttcaagaaggagtttgtggaggtgtttcccatgcaggacagtggggctgatggcacagcccctgccttcgactctaccactgccaacatgaacctggatcgcatcggggagcaggcggaggccatgtttggagtggggaagacaagcagcatgctggaggtggatgacgagggcggccgcatgttcctgcgcgtgctcatccacctcaccatgcacgactatgcgccnctggtctcgggtgccctgcagctgctcttcaagcacttcagccagcgccaggaggccatgcacaccttcaagcaggttcagctgctgatctcagcgcaggacgtggagaactacaaggtgatcaagtcggagctggaccggctgcggaccatggtggagaagtcagagctgtgggtggacaagaagggcagtggcaagggtgaggaggtggaggcaggcgccgccaaggacaagaaagagcgtcccacggacgaggagggctttctgcacccaccaggggagaaaagcagtgagaactaccagatcgtcaagggcatcctggaaaggctgaacaagatgtgcggggttggggagcaaatgaggaagaagcagcaacggctgctgaagaacatggatgcccacaaggtcatgctggacctgctgcagatcccctatgacaagggtgatgccaagatgatggagatcctgcgctacacgcaccagttcctgcagaagttctgtgcagggaaccccggcaaccaggccctgctgcacaaacacctgcacctcttcctcacgccagggctcctggaggcagagaccatgcagcacatcttcctgaacaactatcagctctgctccgagatcagcgagcctgtgttgcagcacttcgtgcacctgctggccacgcacgggcgccatgtgcagtacctggacttcctgcacaccgtcattaaggccgagggcaagtacgtcaagaagtgccaggacatgatcatgactgagctgaccaatgcaggtgacgatgtggtcgtgttctacaatgataaggcatcgctggcccacctgctggacatgatgaaggccgcccgcgacggcgtggaggaccacagccccctcatgtaccacatttccctggtggacctgctggccgcctgtgccgagggcaaaaacgtctacactgagatcaagtgcacctccctgctgccgctggaggacgtggtgtctgtggtgacgcatgaggactgcatcactgaggtgaaaatggcctatgtgaacttcgtgaaccactgctacgtggacacggaggtggagatgaaggagatctacaccagcaaccacatctggacgctctttgagaacttcaccctggacatggctcgggtctgcagcaagcgtgagaagcgcgtggctgaccccaccttggagaagtacgtgctgagcgttgtgctggacaccatcaacgccttcttcagctccccattctctgagaacagcacttccctgcagacacaccagacgattgtggtgcagctgctgcagtctaccacacgcctcctcgagtgtccgtggctacagcagcagcacaagggctccgtggaggcctgcatccggaccctcgccatggtggccaagggccgggccatcttgctgcccatggacctggatgcccacatcagctcgatgctcagcagtggagccagctgtgcagctgccgcccagcggaacgcctccagctacaaggcaaccacgcgggccttcccccgcgtcacccccaccgccaaccagtgggactacaagaacatcattgagaagctgcaggacatcatcacagccctggaggagcggctgaagcccctggtacaggctgagctgtccgtgctggtggatgtcctgcactggcctgagctgctcttcctggagggcagtgaggcctaccagcgctgcgagagtgggggcttcctgtccaagctgatccagcacaccaaggacctcatggagtcggaggagaagctgtgcatcaaggtgctgcggaccctgcagcagatgctgctcaagaagaccaagtacggggaccggggcaaccagctgcgcaagatgctgctgcaaaactacctccagaaccggaagtccacctcgcggggggaccttcccgaccccataggcactggcctggacccagactggtcggcaatcgcagccacccagtgccggctggacaaggagggggccaccaagttggtatgcgacctcatcaccagcaccaagaacgagaagatcttccaggagagcatcggcctggccatccacctgctggatggtggcaacacagagatccagaaatccttccacaacctgatgatgagtgacaagaagtcagagcgcttcttcaaggtgctgcacgaccgcatgaagcgggcccagcaggagaccaagtccacggtggcagtcaacatgaatgacctgggcagccagccacatgaggaccgcgagccagtcgaccccaccaccaaaggccgcgtggcctccttctcgatacctggctcctcatcccgctactcgctgggccccagcctgcgccgggggcacgaggtgagcgaacgtgtgcagagcagtgagatgggcacatccgtgctcatcatgcagcccatcctgcgctttctgcagctgctgtgtgagaaccacaaccgggacctgcagaacttcctgcgctgtcagaacaacaaaaccaactacaacttggtatgcgagacgctgcagttcctggacatcatgtgcggcagcaccacgggcggcctggggctgctggggctctacatcaatgaggacaacgtgggcctcgtcatccagaccttggagaccctcactgagtactgccagggcccctgccatgagaaccagacttgcattgtgactcacgagtccaatggcatagacatcatcaccgcactgatcctcaatgacatcagccccctgtgcaagtaccgcatggatctggtgctgcagctcaaggacaatgcctccaagctgctcctggctctgatggagagccggcatgacagtgaaaatgctgagcgaatcctcatcagcctgcggccccaggagctggtggacgtcatcaagaaggcctacctgcaggaggaagagcgtgagaactcggaggtgagcccacgtgaagtgggccataacatctatatcctggcgctgcagctctccaggcacaataaacagctgcagcacctgctgaagccggtgaagcgcattcaagaggaggaggccgagggtatctcttccatgctcagcctcaacaacaagcagctgtcacagatgctcaagtcctcagcgccagcacaggaggaggaggaagaccccctggcctactatgagaaccacacgtcccagatcgagattgtgcggcaggaccgcagcatggagcagatcgtgttcccagtgcccggcatctgccagttcctgacggaggaaaccaagcaccggctcttcaccactactgagcaggacgagcagggcagcaaagtgagcgacttcttcgaccagtcctccttcctgcacaacgagatggagtggcagcgcaagctccgcagcatgccgctgatctactggttctcccgccgcatgaccctgtggggcagcatctccttcaacctggccgtgtttatcaacatcatcattgccttcttctacccttacatggagggcgcgtccacaggcgtgctggactcccctctcatctcattgctcttctggatcctcatctgcttctccatcgcggccctgttcaccaagcgctacagcatccgccccctcatcgtggcgctcatcctgcgctccatctactatctgggcatcgggcccacactcaacatcctgggtgccctcaatctgaccaacaagatcgtgtttgtggtgagcttcgtgggcaaccgtggcaccttcatccggggctataaggccatggtcatggacatggaattcctctaccacgtgggctacatcctgaccagtgtcctgggcctctttgctcatgagctgttctacagcatcctgctctttgacctcatctaccgcgaggagacgctgttcaacgtcatcaagagtgtgacccgcaatggccgctccatcctgctgacagccctgctggccctcatcctggtctacctcttctccatcgtcggcttcctcttcctcaaggatgacttcattctcgaggtcgaccggctgcccaacaaccactccacagccagccccctggggatgccacatggagctgctgcatttgtggacacctgcagtggggacaagatggactgtgtctcagggctctcggtgcctgaggtcctggaagaggacagggagctggacagcacagagcgggcctgtgacactctgttgatgtgcatcgtcactgtcatgaaccatgggctacgcaacggtggtggcgtgggcgacattctccgcaagccctccaaagatgtgagcactcctgcccactc

SEQ ID NO: 313434 - DNA, 8758 bp, Homo sapiens
  misc_feature (4486)..(4486): n is a, c, g, or t
ttatttatttatttatttatttttttgtctatttgttgtgtaggggctatttcttgggctaatgcaagggcagggaccgaacccgcaacctcatggttcctagtcggattcgttaaccactgcgccacgacaggaactcccctgtgtctgacagttttaaagaaagcttttaagtggtgactcgacatcccgaggtgttgcggtcctattatcgcaatgggcactctatcttaggcgttcaaataaaggactaggaagcaaacacccaagcaccggggaacagaacagaaagaaagacggaaggagccaagagttttggagccaactcctggagagggagcggctgaactgattcggaagttggatctctttgtacacaggaatgcggagagaaaaaaaacaaaacccaccccattgcttcatttcccctccaagcctgagcactttctattgtgcaatgaaaaggcttttcacgttgagaaaaatgaatcccgaatttgctctgcaaagggatgagcgcgcctctgggcgccagcctgctctcagctgggcgcggagaccgcgcggtggccgcagggcggccgcggccagggcgctccagggcgcgccctccgcgagcggctccggggtgacgcccgccggagagctggactcccccttccgcgggcgcctgcactggctcttagccagccgagggcccgggtgcagatagtccgggaaccccgagggcggagagctccccactacgcctgggcctcccagggatggcagctccgagagccccctagacccggtgccttgcaggacgcctctggagatcaggagggctggcggcgcattcggcgtccgggaggccgggccccggacgcgcgaggagcgcggggcgcgggaaggcaggcgggtgcacatgggtgccggcgggcgagctgcggggggagggggggcggggtgtggcctccccgcctcccgggcgggatttgcatgtgtgtggtggccccagacttcctgctccttctacgctgcaggtacgcgcgggccgggcggggcgggcgggcggcgggcgcgccaagacgtgggcacctcctcacccggaccccgggccccgccgagccgcctcctggctcccgtggccgccagcccgccccggccgcaccgagcgtcgggatccgaggtgggagcgtacccctccccgctccccggacgcctcagtcctccgcactgagcttggccacgcgcccctaggcgccccccacgccctgggccccggagggccgcagccatgagtgaaatgtccagctttcttcacatcggggacatcgtctccctgtacgccgagggctccgtcaatggcttcatcagcactttggggctggtggatgaccgctgtgtggtggagcccgcggccggggacctggacaacccccctaagaagttccgtgactgcctcttcaaggtgtgccccatgaaccgctactcggcccagaagcagtactggaaggccaagcagactaagcaggacaaggagaagatcgctgatgtggtgttgctgcagaagctgcagcatgcggcgcagatggagcagaagcaaaatgacacggagaacaagaaggtgcatggggatgtcgtgaagtatggcagtgtgatccagctcctgcacatgaagagcaacaagtacctgacagtgaacaagcggcttccggccttgctggagaagaacgccatgcgggtgactctggatgccacaggcaacgagggttcctggctcttcatccagcccttctggaagctgcggagcaacggggacaacgtggtcgtgggggacaaggtgatcctgaatcctgtcaatgccgggcagcctctgcatgccagcaattacgagctcagcgacaacgccggctgcaaggaggtcaattctgtgaactgcaacaccagctggaagatcaacctgtttatgcagtttcgggaccacctggaggaggtgttgaaagggggagacgtggtgcggctgttccatgcggagcaggagaagttcctgacgtgtgacgagtacaagggcaagctgcaggtgttcctgcgaactacactgcgccagtctgccacctcggccaccagctccaatgctctctgggaggtggaggtggtccaccacgacccctgccgtggaggagctgggcactggaatggcttgtaccgcttcaagcacctggctacaggcaactacctggctgctgaggagaaccccagttacaaaggtgatgcctcagatcccaaggcagcaggaatgggggcacagggccgcacaggccgcaggaatgctggggagaagatcaagtactgcctggtggctgtgcctcatggcaatgacatcgcctctctctttgagctggaccccaccaccttgcagaaaaccgactctttcgtgccccggaactcgtacgtccggctgcggcacctctgcaccaacacgtggattcagagcaccaatgtgcccattgacatcgaggaggagcggcccatccggctcatgctgggcacctgccccaccaaggaggacaaggaggcctttgccatcgtgtcagtgcccgtgtctgagatccgagacctggactttgccaatgacgccagctccatgctggccagtgccgtggagaaactcaacgagggcttcatcagccagaatgaccgcaggtttgtcatccagctgctggaagacctggtgttctttgtcagcgatgtccccaacaatgggcagaatgtcctggacatcatggtcactaagcccaaccgggaacggcagaagctgatgagggagcagaacatcctcaaacaggtctttggcattctgaaggccccgttccgtgagaaggggggtgaaggtcccctggtgcggctggaggagctgtcagaccagaagaacgccccctaccagcacatgttccgcctgtgctaccgcgtgttgcggcattcccaggaggactaccgcaagaaccaggagcacattgccaagcagtttgggatgatgcagtcccagattggctacgacatcctggccgaggacaccatcactgccctgctgcacaacaaccgcaagctcctggaaaagcacatcaccaagaccgaggtggagaccttcgtcagccttgtgcgcaagaaccgggagcccaggttcctggactacctctctgacctgtgtgtgtccaaccacatcgccatccccgtcacccaagagctcatctgcaagtgtgtgctggaccccaagaacagtgacattctcatccggaccgagcttcggcccgtgaaggagatggcccaatcccacgagtacctgagcatcgagtactcagaagaggaagtgtggctcacgtggactgacaagaataacgagcatcatgagaagagtgtgaggcagctggcccaggaggcgcgggccggcaacgcccacgacgagaatgtgctcagctactacaggtaccagctgaagctctttgcccgcatgtgcttggaccgccagtacttggccatcgacgagatctcccagcagctgggcgtggacctgattttcctgtgcatggcagacgagatgctgccctttgacctgcgcgcctccttctgccacctgatgctgcacgtgcacgtggaccgtgacccccaggagctggtcacgccggtcaagtttgcccgtctctggactgagatccccacagccatcaccatcaaggactatgattccaacctcaacgcgtcccgagatgacaagaagaacaagtttgccaacaccatggagttcgtggaggactacctcaacaatgtagtcagcgaggccgtgccctttgccaacgaggagaagaacaagctcacttttgaggtggtcagcctggcgcacaatctcatctacttcggcttctacagcttcagcgagctgctgcggctcactcgcacactgctgggcatcatcgactgtgtgcaggggcccccggccatgctgcaggcctatgaggaccccggtggcaagaatgtgcggcggtccatccagggcgtggggcacatgatgtccaccatggtgctgagccgcaagcagtccgtcttcagtgcccccagcctgtctgctggggccagtgctgctgagccgctggacagaagcaagtttgaggagaatgaggacattgtggtgatggagaccaagctgaagatcctggaaatccttcagttcatcctcaacgtccgcctggattaccgcatatcctacctgctgtctgtcttcaagaaggagtttgtggaggtgtttcccatgcaggacagtggggctgatggcacagcccctgccttcgactctaccactgccaacatgaacctggatcgcatcggggagcaggcggaggccatgtttggagtggggaagacaagcagcatgctggaggtggatgacgagggcggccgcatgttcctgcgcgtgctcatccacctcaccatgcacgactatgcgccnctggtctcgggtgccctgcagctgctcttcaagcacttcagccagcgccaggaggccatgcacaccttcaagcaggttcagctgctgatctcagcgcaggacgtggagaactacaaggtgatcaagtcggagctggaccggctgcggaccatggtggagaagtcagagctgtgggtggacaagaagggcagtggcaagggtgaggaggtggaggcaggcgccgccaaggacaagaaagagcgtcccacggacgaggagggctttctgcacccaccaggggagaaaagcagtgagaactaccagatcgtcaagggcatcctggaaaggctgaacaagatgtgcggggttggggagcaaatgaggaagaagcagcaacggctgctgaagaacatggatgcccacaaggtcatgctggacctgctgcagatcccctatgacaagggtgatgccaagatgatggagatcctgcgctacacgcaccagttcctgcagaagttctgtgcagggaaccccggcaaccaggccctgctgcacaaacacctgcacctcttcctcacgccagggctcctggaggcagagaccatgcagcacatcttcctgaacaactatcagctctgctccgagatcagcgagcctgtgttgcagcacttcgtgcacctgctggccacgcacgggcgccatgtgcagtacctggacttcctgcacaccgtcattaaggccgagggcaagtacgtcaagaagtgccaggacatgatcatgactgagctgaccaatgcaggtgacgatgtggtcgtgttctacaatgataaggcatcgctggcccacctgctggacatgatgaaggccgcccgcgacggcgtggaggaccacagccccctcatgtaccacatttccctggtggacctgctggccgcctgtgccgagggcaaaaacgtctacactgagatcaagtgcacctccctgctgccgctggaggacgtggtgtctgtggtgacgcatgaggactgcatcactgaggtgaaaatggcctatgtgaacttcgtgaaccactgctacgtggacacggaggtggagatgaaggagatctacaccagcaaccacatctggacgctctttgagaacttcaccctggacatggctcgggtctgcagcaagcgtgagaagcgcgtggctgaccccaccttggagaagtacgtgctgagcgttgtgctggacaccatcaacgccttcttcagctccccattctctgagaacagcacttccctgcagacacaccagacgattgtggtgcagctgctgcagtctaccacacgcctcctcgagtgtccgtggctacagcagcagcacaagggctccgtggaggcctgcatccggaccctcgccatggtggccaagggccgggccatcttgctgcccatggacctggatgcccacatcagctcgatgctcagcagtggagccagctgtgcagctgccgcccagcggaacgcctccagctacaaggcaaccacgcgggccttcccccgcgtcacccccaccgccaaccagtgggactacaagaacatcattgagaagctgcaggacatcatcacagccctggaggagcggctgaagcccctggtacaggctgagctgtccgtgctggtggatgtcctgcactggcctgagctgctcttcctggagggcagtgaggcctaccagcgctgcgagagtgggggcttcctgtccaagctgatccagcacaccaaggacctcatggagtcggaggagaagctgtgcatcaaggtgctgcggaccctgcagcagatgctgctcaagaagaccaagtacggggaccggggcaaccagctgcgcaagatgctgctgcaaaactacctccagaaccggaagtccacctcgcggggggaccttcccgaccccataggcactggcctggacccagactggtcggcaatcgcagccacccagtgccggctggacaaggagggggccaccaagttggtatgcgacctcatcaccagcaccaagaacgagaagatcttccaggagagcatcggcctggccatccacctgctggatggtggcaacacagagatccagaaatccttccacaacctgatgatgagtgacaagaagtcagagcgcttcttcaaggtgctgcacgaccgcatgaagcgggcccagcaggagaccaagtccacggtggcagtcaacatgaatgacctgggcagccagccacatgaggaccgcgagccagtcgaccccaccaccaaaggccgcgtggcctccttctcgatacctggctcctcatcccgctactcgctgggccccagcctgcgccgggggcacgaggtgagcgaacgtgtgcagagcagtgagatgggcacatccgtgctcatcatgcagcccatcctgcgctttctgcagctgctgtgtgagaaccacaaccgggacctgcagaacttcctgcgctgtcagaacaacaaaaccaactacaacttggtatgcgagacgctgcagttcctggacatcatgtgcggcagcaccacgggcggcctggggctgctggggctctacatcaatgaggacaacgtgggcctcgtcatccagaccttggagaccctcactgagtactgccagggcccctgccatgagaaccagacttgcattgtgactcacgagtccaatggcatagacatcatcaccgcactgatcctcaatgacatcagccccctgtgcaagtaccgcatggatctggtgctgcagctcaaggacaatgcctccaagctgctcctggctctgatggagagccggcatgacagtgaaaatgctgagcgaatcctcatcagcctgcggccccaggagctggtggacgtcatcaagaaggcctacctgcaggaggaagagcgtgagaactcggaggtgagcccacgtgaagtgggccataacatctatatcctggcgctgcagctctccaggcacaataaacagctgcagcacctgctgaagccggtgaagcgcattcaagaggaggaggccgagggtatctcttccatgctcagcctcaacaacaagcagctgtcacagatgctcaagtcctcagcgccagcacaggaggaggaggaagaccccctggcctactatgagaaccacacgtcccagatcgagattgtgcggcaggaccgcagcatggagcagatcgtgttcccagtgcccggcatctgccagttcctgacggaggaaaccaagcaccggctcttcaccactactgagcaggacgagcagggcagcaaagtgagcgacttcttcgaccagtcctccttcctgcacaacgagatggagtggcagcgcaagctccgcagcatgccgctgatctactggttctcccgccgcatgaccctgtggggcagcatctccttcaacctggccgtgtttatcaacatcatcattgccttcttctacccttacatggagggcgcgtccacaggcgtgctggactcccctctcatctcattgctcttctggatcctcatctgcttctccatcgcggccctgttcaccaagcgctacagcatccgccccctcatcgtggcgctcatcctgcgctccatctactatctgggcatcgggcccacactcaacatcctgggtgccctcaatctgaccaacaagatcgtgtttgtggtgagcttcgtgggcaaccgtggcaccttcatccggggctataaggccatggtcatggacatggaattcctctaccacgtgggctacatcctgaccagtgtcctgggcctctttgctcatgagctgttctacagcatcctgctctttgacctcatctaccgcgaggagacgctgttcaacgtcatcaagagtgtgacccgcaatggccgctccatcctgctgacagccctgctggccctcatcctggtctacctcttctccatcgtcggcttcctcttcctcaaggatgacttcattctcgaggtcgaccggctgcccaacaaccactccacagccagccccctggggatgccacatggagctgctgcatttgtggacacctgcagtggggacaagatggactgtgtctcagggctctcggtgcctgaggtcctggaagaggacagggagctggacagcacagagcgggcctgtgacactctgttgatgtgcatcgtcactgtcatgaaccatgggctacgcaacggtggtggcgtgggcaggagtgctcacatctttggagggctttagagggagcctctagagtcg

SEQ ID NO: 313435 - DNA, 1426 bp, Homo sapiens
ccttcctgacccaccctcttccccactggcctctggccctgggcctggatgagaaggcaggtgccaaacccactctcccctgcatggcaagtcagactggggttgacaacccctgccttgggccgctaaagacaaggccaagtggaaactttagtacagggtggtggggccctctgtctctcatccccttcctctgacagctgccaggtaggtcctttgaggggatccccatcactggagatgggggagtttaaggccctcttgcctagacatcctcttctgcatctggcagtgcctgcatgaagatgaggcagcctctgttagtgggctggtttcccagctgcatcaaatccagggtttgtgacacgctaattgagaacaagggtttggtgctgacatcgacatccttaaagcaccccgaggggccctggcccgccgccagtgccgaatagcagctgggcccacaggggaagacgggtgccaagctcttccacagcacccatggagggaaggtgccaggcggcctgaccaggcctgttggcatctgcttaaccctagatgacggagcagcggaaacgcaggcaacgcctaggctttgtggatgtccagaactgcattagccgctgaggagagccaccgaaggccccaacaggggatgctcatcactggagactgcgactgggaagaacactgccccctccctcgggttgggtggcccagccagctggccagcctccactcccactctgccagacaccctgacacccacccaggctttgaagagcatggagggggagcctcagagctgacagtcctgcttagagcccttaaaaagacttgaaagttcactgggactcagtttaccttaatgccttagcagaagataaatcctacctagagacctttgttccttaaagcaataactgacaactctttgtagtcctccttgtgggtagttaagagtggggtcacccctttaactccaagcactacattttggcggctgccggcctctgggggaggtggcagttatgctgttactagtgattttagggctttgttatttaacttatttcaagggtgctgtgctcagccctgcccatggctgtgcagctccctccgtgcctcagatctgctgtagccagtgcagacctcactgtcgtgtccatgccacccccggcatggctccaggtggcctggtgactccatgatggacgatcttgctcccaggacctgcctcttcccaggcttcctggggaagagttgtacgcccaggcaacaagggctgagctgcgcttgcgtggctgtttcatgaccgcttgtttttctccttttggtgtaatgttttacaaatcctttggcctgagaactaatatgttaattgccttaaataaattaatagaaatctagtccgttaaaaaaaaaa

SEQ ID NO: 313436 - DNA, 7937 bp, Homo sapiens
  misc_feature (4486)..(4486): n is a, c, g, or t
ttatttatttatttatttatttttttgtctatttgttgtgtaggggctatttcttgggctaatgcaagggcagggaccgaacccgcaacctcatggttcctagtcggattcgttaaccactgcgccacgacaggaactcccctgtgtctgacagttttaaagaaagcttttaagtggtgactcgacatcccgaggtgttgcggtcctattatcgcaatgggcactctatcttaggcgttcaaataaaggactaggaagcaaacacccaagcaccggggaacagaacagaaagaaagacggaaggagccaagagttttggagccaactcctggagagggagcggctgaactgattcggaagttggatctctttgtacacaggaatgcggagagaaaaaaaacaaaacccaccccattgcttcatttcccctccaagcctgagcactttctattgtgcaatgaaaaggcttttcacgttgagaaaaatgaatcccgaatttgctctgcaaagggatgagcgcgcctctgggcgccagcctgctctcagctgggcgcggagaccgcgcggtggccgcagggcggccgcggccagggcgctccagggcgcgccctccgcgagcggctccggggtgacgcccgccggagagctggactcccccttccgcgggcgcctgcactggctcttagccagccgagggcccgggtgcagatagtccgggaaccccgagggcggagagctccccactacgcctgggcctcccagggatggcagctccgagagccccctagacccggtgccttgcaggacgcctctggagatcaggagggctggcggcgcattcggcgtccgggaggccgggccccggacgcgcgaggagcgcggggcgcgggaaggcaggcgggtgcacatgggtgccggcgggcgagctgcggggggagggggggcggggtgtggcctccccgcctcccgggcgggatttgcatgtgtgtggtggccccagacttcctgctccttctacgctgcaggtacgcgcgggccgggcggggcgggcgggcggcgggcgcgccaagacgtgggcacctcctcacccggaccccgggccccgccgagccgcctcctggctcccgtggccgccagcccgccccggccgcaccgagcgtcgggatccgaggtgggagcgtacccctccccgctccccggacgcctcagtcctccgcactgagcttggccacgcgcccctaggcgccccccacgccctgggccccggagggccgcagccatgagtgaaatgtccagctttcttcacatcggggacatcgtctccctgtacgccgagggctccgtcaatggcttcatcagcactttggggctggtggatgaccgctgtgtggtggagcccgcggccggggacctggacaacccccctaagaagttccgtgactgcctcttcaaggtgtgccccatgaaccgctactcggcccagaagcagtactggaaggccaagcagactaagcaggacaaggagaagatcgctgatgtggtgttgctgcagaagctgcagcatgcggcgcagatggagcagaagcaaaatgacacggagaacaagaaggtgcatggggatgtcgtgaagtatggcagtgtgatccagctcctgcacatgaagagcaacaagtacctgacagtgaacaagcggcttccggccttgctggagaagaacgccatgcgggtgactctggatgccacaggcaacgagggttcctggctcttcatccagcccttctggaagctgcggagcaacggggacaacgtggtcgtgggggacaaggtgatcctgaatcctgtcaatgccgggcagcctctgcatgccagcaattacgagctcagcgacaacgccggctgcaaggaggtcaattctgtgaactgcaacaccagctggaagatcaacctgtttatgcagtttcgggaccacctggaggaggtgttgaaagggggagacgtggtgcggctgttccatgcggagcaggagaagttcctgacgtgtgacgagtacaagggcaagctgcaggtgttcctgcgaactacactgcgccagtctgccacctcggccaccagctccaatgctctctgggaggtggaggtggtccaccacgacccctgccgtggaggagctgggcactggaatggcttgtaccgcttcaagcacctggctacaggcaactacctggctgctgaggagaaccccagttacaaaggtgatgcctcagatcccaaggcagcaggaatgggggcacagggccgcacaggccgcaggaatgctggggagaagatcaagtactgcctggtggctgtgcctcatggcaatgacatcgcctctctctttgagctggaccccaccaccttgcagaaaaccgactctttcgtgccccggaactcgtacgtccggctgcggcacctctgcaccaacacgtggattcagagcaccaatgtgcccattgacatcgaggaggagcggcccatccggctcatgctgggcacctgccccaccaaggaggacaaggaggcctttgccatcgtgtcagtgcccgtgtctgagatccgagacctggactttgccaatgacgccagctccatgctggccagtgccgtggagaaactcaacgagggcttcatcagccagaatgaccgcaggtttgtcatccagctgctggaagacctggtgttctttgtcagcgatgtccccaacaatgggcagaatgtcctggacatcatggtcactaagcccaaccgggaacggcagaagctgatgagggagcagaacatcctcaaacaggtctttggcattctgaaggccccgttccgtgagaaggggggtgaaggtcccctggtgcggctggaggagctgtcagaccagaagaacgccccctaccagcacatgttccgcctgtgctaccgcgtgttgcggcattcccaggaggactaccgcaagaaccaggagcacattgccaagcagtttgggatgatgcagtcccagattggctacgacatcctggccgaggacaccatcactgccctgctgcacaacaaccgcaagctcctggaaaagcacatcaccaagaccgaggtggagaccttcgtcagccttgtgcgcaagaaccgggagcccaggttcctggactacctctctgacctgtgtgtgtccaaccacatcgccatccccgtcacccaagagctcatctgcaagtgtgtgctggaccccaagaacagtgacattctcatccggaccgagcttcggcccgtgaaggagatggcccaatcccacgagtacctgagcatcgagtactcagaagaggaagtgtggctcacgtggactgacaagaataacgagcatcatgagaagagtgtgaggcagctggcccaggaggcgcgggccggcaacgcccacgacgagaatgtgctcagctactacaggtaccagctgaagctctttgcccgcatgtgcttggaccgccagtacttggccatcgacgagatctcccagcagctgggcgtggacctgattttcctgtgcatggcagacgagatgctgccctttgacctgcgcgcctccttctgccacctgatgctgcacgtgcacgtggaccgtgacccccaggagctggtcacgccggtcaagtttgcccgtctctggactgagatccccacagccatcaccatcaaggactatgattccaacctcaacgcgtcccgagatgacaagaagaacaagtttgccaacaccatggagttcgtggaggactacctcaacaatgtagtcagcgaggccgtgccctttgccaacgaggagaagaacaagctcacttttgaggtggtcagcctggcgcacaatctcatctacttcggcttctacagcttcagcgagctgctgcggctcactcgcacactgctgggcatcatcgactgtgtgcaggggcccccggccatgctgcaggcctatgaggaccccggtggcaagaatgtgcggcggtccatccagggcgtggggcacatgatgtccaccatggtgctgagccgcaagcagtccgtcttcagtgcccccagcctgtctgctggggccagtgctgctgagccgctggacagaagcaagtttgaggagaatgaggacattgtggtgatggagaccaagctgaagatcctggaaatccttcagttcatcctcaacgtccgcctggattaccgcatatcctacctgctgtctgtcttcaagaaggagtttgtggaggtgtttcccatgcaggacagtggggctgatggcacagcccctgccttcgactctaccactgccaacatgaacctggatcgcatcggggagcaggcggaggccatgtttggagtggggaagacaagcagcatgctggaggtggatgacgagggcggccgcatgttcctgcgcgtgctcatccacctcaccatgcacgactatgcgccnctggtctcgggtgccctgcagctgctcttcaagcacttcagccagcgccaggaggccatgcacaccttcaagcaggttcagctgctgatctcagcgcaggacgtggagaactacaaggtgatcaagtcggagctggaccggctgcggaccatggtggagaagtcagagctgtgggtggacaagaagggcagtggcaagggtgaggaggtggaggcaggcgccgccaaggacaagaaagagcgtcccacggacgaggagggctttctgcacccaccaggggagaaaagcagtgagaactaccagatcgtcaagggcatcctggaaaggctgaacaagatgtgcggggttggggagcaaatgaggaagaagcagcaacggctgctgaagaacatggatgcccacaaggtcatgctggacctgctgcagatcccctatgacaagggtgatgccaagatgatggagatcctgcgctacacgcaccagttcctgcagaagttctgtgcagggaaccccggcaaccaggccctgctgcacaaacacctgcacctcttcctcacgccagggctcctggaggcagagaccatgcagcacatcttcctgaacaactatcagctctgctccgagatcagcgagcctgtgttgcagcacttcgtgcacctgctggccacgcacgggcgccatgtgcagtacctggacttcctgcacaccgtcattaaggccgagggcaagtacgtcaagaagtgccaggacatgatcatgactgagctgaccaatgcaggtgacgatgtggtcgtgttctacaatgataaggcatcgctggcccacctgctggacatgatgaaggccgcccgcgacggcgtggaggaccacagccccctcatgtaccacatttccctggtggacctgctggccgcctgtgccgagggcaaaaacgtctacactgagatcaagtgcacctccctgctgccgctggaggacgtggtgtctgtggtgacgcatgaggactgcatcactgaggtgaaaatggcctatgtgaacttcgtgaaccactgctacgtggacacggaggtggagatgaaggagatctacaccagcaaccacatctggacgctctttgagaacttcaccctggacatggctcgggtctgcagcaagcgtgagaagcgcgtggctgaccccaccttggagaagtacgtgctgagcgttgtgctggacaccatcaacgccttcttcagctccccattctctgagaacagcacttccctgcagacacaccagacgattgtggtgcagctgctgcagtctaccacacgcctcctcgagtgtccgtggctacagcagcagcacaagggctccgtggaggcctgcatccggaccctcgccatggtggccaagggccgggccatcttgctgcccatggacctggatgcccacatcagctcgatgctcagcagtggagccagctgtgcagctgccgcccagcggaacgcctccagctacaaggcaaccacgcgggccttcccccgcgtcacccccaccgccaaccagtgggactacaagaacatcattgagaagctgcaggacatcatcacagccctggaggagcggctgaagcccctggtacaggctgagctgtccgtgctggtggatgtcctgcactggcctgagctgctcttcctggagggcagtgaggcctaccagcgctgcgagagtgggggcttcctgtccaagctgatccagcacaccaaggacctcatggagtcggaggagaagctgtgcatcaaggtgctgcggaccctgcagcagatgctgctcaagaagaccaagtacggggaccggggcaaccagctgcgcaagatgctgctgcaaaactacctccagaaccggaagtccacctcgcggggggaccttcccgaccccataggcactggcctggacccagactggtcggcaatcgcagccacccagtgccggctggacaaggagggggccaccaagttggtatgcgacctcatcaccagcaccaagaacgagaagatcttccaggagagcatcggcctggccatccacctgctggatggtggcaacacagagatccagaaatccttccacaacctgatgatgagtgacaagaagtcagagcgcttcttcaaggtgctgcacgaccgcatgaagcgggcccagcaggagaccaagtccacggtggcagtcaacatgaatgacctgggcagccagccacatgaggaccgcgagccagtcgaccccaccaccaaaggccgcgtggcctccttctcgatacctggctcctcatcccgctactcgctgggccccagcctgcgccgggggcacgaggtgagcgaacgtgtgcagagcagtgagatgggcacatccgtgctcatcatgcagcccatcctgcgctttctgcagctgctgtgtgagaaccacaaccgggacctgcagaacttcctgcgctgtcagaacaacaaaaccaactacaacttggtatgcgagacgctgcagttcctggacatcatgtgcggcagcaccacgggcggcctggggctgctggggctctacatcaatgaggacaacgtgggcctcgtcatccagaccttggagaccctcactgagtactgccagggcccctgccatgagaaccagacttgcattgtgactcacgagtccaatggcatagacatcatcaccgcactgatcctcaatgacatcagccccctgtgcaagtaccgcatggatctggtgctgcagctcaaggacaatgcctccaagctgctcctggctctgatggagagccggcatgacagtgaaaatgctgagcgaatcctcatcagcctgcggccccaggagctggtggacgtcatcaagaaggcctacctgcaggaggaagagcgtgagaactcggaggtgagcccacgtgaagtgggccataacatctatatcctggcgctgcagctctccaggcacaataaacagctgcagcacctgctgaagccggtgaagcgcattcaagaggaggaggccgagggtatctcttccatgctcagcctcaacaacaagcagctgtcacagatgctcaagtcctcagcgccagcacaggaggaggaggaagaccccctggcctactatgagaaccacacgtcccagatcgagattgtgcggcaggaccgcagcatggagcagatcgtgttcccagtgcccggcatctgccagttccatgatggacgatcttgctcccaggacctgcctcttcccaggcttcctggggaagagttgtacgcccaggcaacaagggctgagctgcgcttgcgtggctgtttcatgaccgcttgtttttctccttttggtgtaatgttttacaaatcctttggcctgagaactaatatgttaattgccttaaataaattaatagaaatctagtccgttaaaaaaaaaa

SEQ ID NO: 313437 - DNA, 5622 bp, Homo sapiens
  misc_feature (4486)..(4486): n is a, c, g, or t
ttatttatttatttatttatttttttgtctatttgttgtgtaggggctatttcttgggctaatgcaagggcagggaccgaacccgcaacctcatggttcctagtcggattcgttaaccactgcgccacgacaggaactcccctgtgtctgacagttttaaagaaagcttttaagtggtgactcgacatcccgaggtgttgcggtcctattatcgcaatgggcactctatcttaggcgttcaaataaaggactaggaagcaaacacccaagcaccggggaacagaacagaaagaaagacggaaggagccaagagttttggagccaactcctggagagggagcggctgaactgattcggaagttggatctctttgtacacaggaatgcggagagaaaaaaaacaaaacccaccccattgcttcatttcccctccaagcctgagcactttctattgtgcaatgaaaaggcttttcacgttgagaaaaatgaatcccgaatttgctctgcaaagggatgagcgcgcctctgggcgccagcctgctctcagctgggcgcggagaccgcgcggtggccgcagggcggccgcggccagggcgctccagggcgcgccctccgcgagcggctccggggtgacgcccgccggagagctggactcccccttccgcgggcgcctgcactggctcttagccagccgagggcccgggtgcagatagtccgggaaccccgagggcggagagctccccactacgcctgggcctcccagggatggcagctccgagagccccctagacccggtgccttgcaggacgcctctggagatcaggagggctggcggcgcattcggcgtccgggaggccgggccccggacgcgcgaggagcgcggggcgcgggaaggcaggcgggtgcacatgggtgccggcgggcgagctgcggggggagggggggcggggtgtggcctccccgcctcccgggcgggatttgcatgtgtgtggtggccccagacttcctgctccttctacgctgcaggtacgcgcgggccgggcggggcgggcgggcggcgggcgcgccaagacgtgggcacctcctcacccggaccccgggccccgccgagccgcctcctggctcccgtggccgccagcccgccccggccgcaccgagcgtcgggatccgaggtgggagcgtacccctccccgctccccggacgcctcagtcctccgcactgagcttggccacgcgcccctaggcgccccccacgccctgggccccggagggccgcagccatgagtgaaatgtccagctttcttcacatcggggacatcgtctccctgtacgccgagggctccgtcaatggcttcatcagcactttggggctggtggatgaccgctgtgtggtggagcccgcggccggggacctggacaacccccctaagaagttccgtgactgcctcttcaaggtgtgccccatgaaccgctactcggcccagaagcagtactggaaggccaagcagactaagcaggacaaggagaagatcgctgatgtggtgttgctgcagaagctgcagcatgcggcgcagatggagcagaagcaaaatgacacggagaacaagaaggtgcatggggatgtcgtgaagtatggcagtgtgatccagctcctgcacatgaagagcaacaagtacctgacagtgaacaagcggcttccggccttgctggagaagaacgccatgcgggtgactctggatgccacaggcaacgagggttcctggctcttcatccagcccttctggaagctgcggagcaacggggacaacgtggtcgtgggggacaaggtgatcctgaatcctgtcaatgccgggcagcctctgcatgccagcaattacgagctcagcgacaacgccggctgcaaggaggtcaattctgtgaactgcaacaccagctggaagatcaacctgtttatgcagtttcgggaccacctggaggaggtgttgaaagggggagacgtggtgcggctgttccatgcggagcaggagaagttcctgacgtgtgacgagtacaagggcaagctgcaggtgttcctgcgaactacactgcgccagtctgccacctcggccaccagctccaatgctctctgggaggtggaggtggtccaccacgacccctgccgtggaggagctgggcactggaatggcttgtaccgcttcaagcacctggctacaggcaactacctggctgctgaggagaaccccagttacaaaggtgatgcctcagatcccaaggcagcaggaatgggggcacagggccgcacaggccgcaggaatgctggggagaagatcaagtactgcctggtggctgtgcctcatggcaatgacatcgcctctctctttgagctggaccccaccaccttgcagaaaaccgactctttcgtgccccggaactcgtacgtccggctgcggcacctctgcaccaacacgtggattcagagcaccaatgtgcccattgacatcgaggaggagcggcccatccggctcatgctgggcacctgccccaccaaggaggacaaggaggcctttgccatcgtgtcagtgcccgtgtctgagatccgagacctggactttgccaatgacgccagctccatgctggccagtgccgtggagaaactcaacgagggcttcatcagccagaatgaccgcaggtttgtcatccagctgctggaagacctggtgttctttgtcagcgatgtccccaacaatgggcagaatgtcctggacatcatggtcactaagcccaaccgggaacggcagaagctgatgagggagcagaacatcctcaaacaggtctttggcattctgaaggccccgttccgtgagaaggggggtgaaggtcccctggtgcggctggaggagctgtcagaccagaagaacgccccctaccagcacatgttccgcctgtgctaccgcgtgttgcggcattcccaggaggactaccgcaagaaccaggagcacattgccaagcagtttgggatgatgcagtcccagattggctacgacatcctggccgaggacaccatcactgccctgctgcacaacaaccgcaagctcctggaaaagcacatcaccaagaccgaggtggagaccttcgtcagccttgtgcgcaagaaccgggagcccaggttcctggactacctctctgacctgtgtgtgtccaaccacatcgccatccccgtcacccaagagctcatctgcaagtgtgtgctggaccccaagaacagtgacattctcatccggaccgagcttcggcccgtgaaggagatggcccaatcccacgagtacctgagcatcgagtactcagaagaggaagtgtggctcacgtggactgacaagaataacgagcatcatgagaagagtgtgaggcagctggcccaggaggcgcgggccggcaacgcccacgacgagaatgtgctcagctactacaggtaccagctgaagctctttgcccgcatgtgcttggaccgccagtacttggccatcgacgagatctcccagcagctgggcgtggacctgattttcctgtgcatggcagacgagatgctgccctttgacctgcgcgcctccttctgccacctgatgctgcacgtgcacgtggaccgtgacccccaggagctggtcacgccggtcaagtttgcccgtctctggactgagatccccacagccatcaccatcaaggactatgattccaacctcaacgcgtcccgagatgacaagaagaacaagtttgccaacaccatggagttcgtggaggactacctcaacaatgtagtcagcgaggccgtgccctttgccaacgaggagaagaacaagctcacttttgaggtggtcagcctggcgcacaatctcatctacttcggcttctacagcttcagcgagctgctgcggctcactcgcacactgctgggcatcatcgactgtgtgcaggggcccccggccatgctgcaggcctatgaggaccccggtggcaagaatgtgcggcggtccatccagggcgtggggcacatgatgtccaccatggtgctgagccgcaagcagtccgtcttcagtgcccccagcctgtctgctggggccagtgctgctgagccgctggacagaagcaagtttgaggagaatgaggacattgtggtgatggagaccaagctgaagatcctggaaatccttcagttcatcctcaacgtccgcctggattaccgcatatcctacctgctgtctgtcttcaagaaggagtttgtggaggtgtttcccatgcaggacagtggggctgatggcacagcccctgccttcgactctaccactgccaacatgaacctggatcgcatcggggagcaggcggaggccatgtttggagtggggaagacaagcagcatgctggaggtggatgacgagggcggccgcatgttcctgcgcgtgctcatccacctcaccatgcacgactatgcgccnctggtctcgggtgccctgcagctgctcttcaagcacttcagccagcgccaggaggccatgcacaccttcaagcaggttcagctgctgatctcagcgcaggacgtggagaactacaaggtgatcaagtcggagctggaccggctgcggaccatggtggagaagtcagagctgtgggtggacaagaagggcagtggcaagggtgaggaggtggaggcaggcgccgccaaggacaagaaagagcgtcccacggacgaggagggctttctgcacccaccaggggagaaaagcagtgagaactaccagatcgtcaagggcatcctggaaaggctgaacaagatgtgcggggttggggagcaaatgaggaagaagcagcaacggctgctgaagaacatggatgcccacaaggtcatgctggacctgctgcagatcccctatgacaaggtggctctgacttctgacctctgactccccagggtggcttccccctgaaccccggcctgacctgtatgctaggccctaatgcaggcaacctctcccagcctcgcctggcctcttacactgccctgtttgtttgcaggcacaccttgaccctgaacctgtcttagtatcggttcaacctttgaccctctacccctcatcctaattccctttgaccttgatttgaccccagccttatgctgattcttgaccttgactcccttttcttccccctctccagcctaaccctgataatctcagcttcatctcaacctttgaccctcagcttccttaccttgacccatgttgaccctaactgaacccaacctctccttgacccatgacatcaatgctggccttgtcctgacccctggttttgattcctcatcctgacatcttatgctgacctgtccccaggcccaccctggctcctgactccaatcttagtctcatctccccttttgaccctcagccccttgccatgactgatcttgatctcagtatgtcccaggcctcaccttgacgctgaccgtgacacttcaccttgccccaactccagcctcatcttggccattgagctcccgcccctcacacatttccatcctgacctgggggccccactttccctttacgctggcctcttcacggtcccagtccca

SEQ ID NO: 313438 - DNA, 4389 bp, Homo sapiens
ttatttatttatttatttatttttttgtctatttgttgtgtaggggctatttcttgggctaatgcaagggcagggaccgaacccgcaacctcatggttcctagtcggattcgttaaccactgcgccacgacaggaactcccctgtgtctgacagttttaaagaaagcttttaagtggtgactcgacatcccgaggtgttgcggtcctattatcgcaatgggcactctatcttaggcgttcaaataaaggactaggaagcaaacacccaagcaccggggaacagaacagaaagaaagacggaaggagccaagagttttggagccaactcctggagagggagcggctgaactgattcggaagttggatctctttgtacacaggaatgcggagagaaaaaaaacaaaacccaccccattgcttcatttcccctccaagcctgagcactttctattgtgcaatgaaaaggcttttcacgttgagaaaaatgaatcccgaatttgctctgcaaagggatgagcgcgcctctgggcgccagcctgctctcagctgggcgcggagaccgcgcggtggccgcagggcggccgcggccagggcgctccagggcgcgccctccgcgagcggctccggggtgacgcccgccggagagctggactcccccttccgcgggcgcctgcactggctcttagccagccgagggcccgggtgcagatagtccgggaaccccgagggcggagagctccccactacgcctgggcctcccagggatggcagctccgagagccccctagacccggtgccttgcaggacgcctctggagatcaggagggctggcggcgcattcggcgtccgggaggccgggccccggacgcgcgaggagcgcggggcgcgggaaggcaggcgggtgcacatgggtgccggcgggcgagctgcggggggagggggggcggggtgtggcctccccgcctcccgggcgggatttgcatgtgtgtggtggccccagacttcctgctccttctacgctgcaggtacgcgcgggccgggcggggcgggcgggcggcgggcgcgccaagacgtgggcacctcctcacccggaccccgggccccgccgagccgcctcctggctcccgtggccgccagcccgccccggccgcaccgagcgtcgggatccgaggtgggagcgtacccctccccgctccccggacgcctcagtcctccgcactgagcttggccacgcgcccctaggcgccccccacgccctgggccccggagggccgcagccatgagtgaaatgtccagctttcttcacatcggggacatcgtctccctgtacgccgagggctccgtcaatggcttcatcagcactttggggctggtggatgaccgctgtgtggtggagcccgcggccggggacctggacaacccccctaagaagttccgtgactgcctcttcaaggtgtgccccatgaaccgctactcggcccagaagcagtactggaaggccaagcagactaagcaggacaaggagaagatcgctgatgtggtgttgctgcagaagctgcagcatgcggcgcagatggagcagaagcaaaatgacacggagaacaagaaggtgcatggggatgtcgtgaagtatggcagtgtgatccagctcctgcacatgaagagcaacaagtacctgacagtgaacaagcggcttccggccttgctggagaagaacgccatgcgggtgactctggatgccacaggcaacgagggttcctggctcttcatccagcccttctggaagctgcggagcaacggggacaacgtggtcgtgggggacaaggtgatcctgaatcctgtcaatgccgggcagcctctgcatgccagcaattacgagctcagcgacaacgccggctgcaaggaggtcaattctgtgaactgcaacaccagctggaagatcaacctgtttatgcagtttcgggaccacctggaggaggtgttgaaagggggagacgtggtgcggctgttccatgcggagcaggagaagttcctgacgtgtgacgagtacaagggcaagctgcaggtgttcctgcgaactacactgcgccagtctgccacctcggccaccagctccaatgctctctgggaggtggaggtggtccaccacgacccctgccgtggaggagctgggcactggaatggcttgtaccgcttcaagcacctggctacaggcaactacctggctgctgaggagaaccccagttacaaaggtgatgcctcagatcccaaggcagcaggaatgggggcacagggccgcacaggccgcaggaatgctggggagaagatcaagtactgcctggtggctgtgcctcatggcaatgacatcgcctctctctttgagctggaccccaccaccttgcagaaaaccgactctttcgtgccccggaactcgtacgtccggctgcggcacctctgcaccaacacgtggattcagagcaccaatgtgcccattgacatcgaggaggagcggcccatccggctcatgctgggcacctgccccaccaaggaggacaaggaggcctttgccatcgtgtcagtgcccgtgtctgagatccgagacctggactttgccaatgacgccagctccatgctggccagtgccgtggagaaactcaacgagggcttcatcagccagaatgaccgcaggtttgtcatccagctgctggaagacctggtgttctttgtcagcgatgtccccaacaatgggcagaatgtcctggacatcatggtcactaagcccaaccgggaacggcagaagctgatgagggagcagaacatcctcaaacaggtctttggcattctgaaggccccgttccgtgagaaggggggtgaaggtcccctggtgcggctggaggagctgtcagaccagaagaacgccccctaccagcacatgttccgcctgtgctaccgcgtgttgcggcattcccaggaggactaccgcaagaaccaggagcacattgccaagcagtttgggatgatgcagtcccagattggctacgacatcctggccgaggacaccatcactgccctgctgcacaacaaccgcaagctcctggaaaagcacatcaccaagaccgaggtggagaccttcgtcagccttgtgcgcaagaaccgggagcccaggttcctggactacctctctgacctgtgtgtgtccaaccacatcgccatccccgtcacccaagagctcatctgcaagtgtgtgctggaccccaagaacagtgacattctcatccggaccgagcttcggcccgtgaaggagatggcccaatcccacgagtacctgagcatcgagtactcagaagaggaagtgtggctcacgtggactgacaagaataacgagcatcatgagaagagtgtgaggcagctggcccaggaggcgcgggccggcaacgcccacgacgagaatgtgctcagctactacaggtaccagctgaagctctttgcccgcatgtgcttggaccgccagtacttggccatcgacgagatctcccagcagctgggcgtggacctgattttcctgtgcatggcagacgagatgctgccctttgacctgcgcgcctccttctgccacctgatgctgcacgtgcacgtggaccgtgacccccaggagctggtcacgccggtcaagtttgcccgtctctggactgagatccccacagccatcaccatcaaggactatgattccaacctcaacgcgtcccgagatgacaagaagaacaagtttgccaacaccatggagttcgtggaggactacctcaacaatgtagtcagcgaggccgtgccctttgccaacgaggagaagaacaagctcacttttgaggtggtcagcctggcgcacaatctcatctacttcggcttctacagcttcagcgagctgctgcggctcactcgcacactgctgggcatcatcgactgtgtgcaggggcccccggccatgctgcaggcctatgaggaccccggtggcaagaatgtgcggcggtccatccagggcgtggggcacatgatgtccaccatggtgctgagccgcaagcagtccgtcttcagtgcccccagcctgtctgctggggccagtgctgctgagccgctggacagaagcaagtttgaggagaatgaggacattgtggtgatggagaccaagctgaagatcctggaaatccttcagttcatcctcaacgtccgcctggattaccgcatatcctacctgctgtctgtcttcaagaaggagtttgtggaggtgtttcccatgcaggacagtggggctgatggcacagcccctgccttcgactctaccactgccaacatgactgatcaatcgggatgcacaaaccgaagggatcctctaga

SEQ ID NO: 313439 - DNA, 3769 bp, Homo sapiens
ttatttatttatttatttatttttttgtctatttgttgtgtaggggctatttcttgggctaatgcaagggcagggaccgaacccgcaacctcatggttcctagtcggattcgttaaccactgcgccacgacaggaactcccctgtgtctgacagttttaaagaaagcttttaagtggtgactcgacatcccgaggtgttgcggtcctattatcgcaatgggcactctatcttaggcgttcaaataaaggactaggaagcaaacacccaagcaccggggaacagaacagaaagaaagacggaaggagccaagagttttggagccaactcctggagagggagcggctgaactgattcggaagttggatctctttgtacacaggaatgcggagagaaaaaaaacaaaacccaccccattgcttcatttcccctccaagcctgagcactttctattgtgcaatgaaaaggcttttcacgttgagaaaaatgaatcccgaatttgctctgcaaagggatgagcgcgcctctgggcgccagcctgctctcagctgggcgcggagaccgcgcggtggccgcagggcggccgcggccagggcgctccagggcgcgccctccgcgagcggctccggggtgacgcccgccggagagctggactcccccttccgcgggcgcctgcactggctcttagccagccgagggcccgggtgcagatagtccgggaaccccgagggcggagagctccccactacgcctgggcctcccagggatggcagctccgagagccccctagacccggtgccttgcaggacgcctctggagatcaggagggctggcggcgcattcggcgtccgggaggccgggccccggacgcgcgaggagcgcggggcgcgggaaggcaggcgggtgcacatgggtgccggcgggcgagctgcggggggagggggggcggggtgtggcctccccgcctcccgggcgggatttgcatgtgtgtggtggccccagacttcctgctccttctacgctgcaggtacgcgcgggccgggcggggcgggcgggcggcgggcgcgccaagacgtgggcacctcctcacccggaccccgggccccgccgagccgcctcctggctcccgtggccgccagcccgccccggccgcaccgagcgtcgggatccgaggtgggagcgtacccctccccgctccccggacgcctcagtcctccgcactgagcttggccacgcgcccctaggcgccccccacgccctgggccccggagggccgcagccatgagtgaaatgtccagctttcttcacatcggggacatcgtctccctgtacgccgagggctccgtcaatggcttcatcagcactttggggctggtggatgaccgctgtgtggtggagcccgcggccggggacctggacaacccccctaagaagttccgtgactgcctcttcaaggtgtgccccatgaaccgctactcggcccagaagcagtactggaaggccaagcagactaagcaggacaaggagaagatcgctgatgtggtgttgctgcagaagctgcagcatgcggcgcagatggagcagaagcaaaatgacacggagaacaagaaggtgcatggggatgtcgtgaagtatggcagtgtgatccagctcctgcacatgaagagcaacaagtacctgacagtgaacaagcggcttccggccttgctggagaagaacgccatgcgggtgactctggatgccacaggcaacgagggttcctggctcttcatccagcccttctggaagctgcggagcaacggggacaacgtggtcgtgggggacaaggtgatcctgaatcctgtcaatgccgggcagcctctgcatgccagcaattacgagctcagcgacaacgccggctgcaaggaggtcaattctgtgaactgcaacaccagctggaagatcaacctgtttatgcagtttcgggaccacctggaggaggtgttgaaagggggagacgtggtgcggctgttccatgcggagcaggagaagttcctgacgtgtgacgagtacaagggcaagctgcaggtgttcctgcgaactacactgcgccagtctgccacctcggccaccagctccaatgctctctgggaggtggaggtggtccaccacgacccctgccgtggaggagctgggcactggaatggcttgtaccgcttcaagcacctggctacaggcaactacctggctgctgaggagaaccccagttacaaaggtgatgcctcagatcccaaggcagcaggaatgggggcacagggccgcacaggccgcaggaatgctggggagaagatcaagtactgcctggtggctgtgcctcatggcaatgacatcgcctctctctttgagctggaccccaccaccttgcagaaaaccgactctttcgtgccccggaactcgtacgtccggctgcggcacctctgcaccaacacgtggattcagagcaccaatgtgcccattgacatcgaggaggagcggcccatccggctcatgctgggcacctgccccaccaaggaggacaaggaggcctttgccatcgtgtcagtgcccgtgtctgagatccgagacctggactttgccaatgacgccagctccatgctggccagtgccgtggagaaactcaacgagggcttcatcagccagaatgaccgcaggtttgtcatccagctgctggaagacctggtgttctttgtcagcgatgtccccaacaatgggcagaatgtcctggacatcatggtcactaagcccaaccgggaacggcagaagctgatgagggagcagaacatcctcaaacaggtctttggcattctgaaggccccgttccgtgagaaggggggtgaaggtcccctggtgcggctggaggagctgtcagaccagaagaacgccccctaccagcacatgttccgcctgtgctaccgcgtgttgcggcattcccaggaggactaccgcaagaaccaggagcacattgccaagcagtttgggatgatgcagtcccagattggctacgacatcctggccgaggacaccatcactgccctgctgcacaacaaccgcaagctcctggaaaagcacatcaccaagaccgaggtggagaccttcgtcagccttgtgcgcaagaaccgggagcccaggttcctggactacctctctgacctgtgtgtgtccaaccacatcgccatccccgtcacccaagagctcatctgcaagtgtgtgctggaccccaagaacagtgacattctcatccggaccgagcttcggcccgtgaaggagatggcccaatcccacgagtacctgagcatcgagtactcagaagaggaagtgtggctcacgtggactgacaagaataacgagcatcatgagaagagtgtgaggcagctggcccaggaggcgcgggccggcaacgcccacgacgagaatgtgctcagctactacaggtaccagctgaagctctttgcccgcatgtgcttggaccgccagtacttggccatcgacgagatctcccagcagctgggcgtggacctgattttcctgtgcatggcagacgagatgctgccctttgacctgcgcgcctccttctgccacctgatgctgcacgtgcacgtggaccgtgacccccaggagctggtcacgccggtcaagtttgcccgtctctggactgagatccccatatctaacaacgtgaaaatcaaatgacagtttgaacatacttaacccaccccataactccccagacta

SEQ ID NO: 313440 - DNA, 645 bp, Homo sapiens
ttatttatttatttatttatttttttgtctatttgttgtgtaggggctatttcttgggctaatgcaagggcagggaccgaacccgcaacctcatggttcctagtcggattcgttaaccactgcgccacgacaggaactcccctgtgtctgacagttttaaagaaagcttttaagtggtgactcgacatcccgaggtgttgcggtcctattatcgcaatgggcactctatcttaggcgttcaaataaaggactaggaagcaaacacccaagcaccggggaacagaacagaaagaataacataagaaagaagcaggaaagttaggaaattgccatcgggatctccactttatttctatacttggcctctgcactgtccccaacccagtcatgtcaactacctctgactcagatggaagaatgtgcttcctggcgtgggatttcccttgggctttaatcttgtgtgtgattatgcattgatgtgaatgtgtcttagactgtaaactcactgagagtagtgacttatcaccccagcaagcagattctaaataaagcctctgttcttgatgactgaggataagaagggaagaggacatgagcctagaggaagcttctgatgagccgaatctgggggccgagtatcgcggt

SEQ ID NO: 313441 - DNA, 419 bp, Homo sapiens
tcggggtagggatctgcagccccagtggtcctgggggctcccgctggcccggccccctgtgcctctccctgtgctggccactggccctcacaagagacatctttcagcctttgctgcacattaaaaacagccctgccaaggtccagatggaattattttaaagccgaaggaattccatgaaattccatttcacagtcatattgttctatttacttttatgggtggaattggtttttttagtgcttccctagcctgttgcaagggtctgattcagcgcctgtgacctccttcccccttcctgtcccgggtgccagctggaacttggctgtggtgggctgggcagagggcagcctgagaagtagggaaggggctctggctcacccgcctcccctgcagatcctggaaaggctgaacaagat

SEQ ID NO: 313442 - DNA, 559 bp, Homo sapiens
aatgacctgggcagccagccacatgaggaccgcgagccagtcgaccccaccaccaaaggtcaggggtctgaggcagaggcacggcgtgacggggatcccaggataagatgtgcaggggggtggccaagggggtgggcagctccagcctcaccaggtctcgcccacaggccgcgtggcctccttctcgatacctggctcctcatcccgctactcgctgggccccagcctgcgccgggggcacgaggtgagcgaacgtgtgcagagcagtgagatgggcacatccgtgctcatcatgcagcccatcctgcgctttctgcagctgctgtgtgagaaccacaaccgggacctgcaggtgagtgcctcgccacacacctgccccttcccccgctggccagccggcatgcagactaggcagtgtggctggtgtccctctatggcaggtgtgccctgccctgggcactgctgctttgtggctggtggttcccctacccctgcagcacacaagatcgtgcttcccaggccagcctccctctccgtgctgtagctgtgctgtgcccaa

SEQ ID NO: 313443 - DNA, 546 bp, Homo sapiens
attctgtgaggttcttccaaccgcttcctctctacctgcagcggggaacgggggtggggaagggttgggagagaagagctgcaggctggggttttctccagggagggccctgagccccaagatgaatcattcccctcacccccaacctgccccaccacagactgcctcttcaaggtgtgccccatgaaccgctactcggcccagaagcagtactggaaggccaagcagactaagcaggacaaggagaagatcgctgatgtggtgttgctgcagaagctgcaggtatgtgtgtgtgtgcaggcgtgcatctgtgcacatgtaccaggaacctgggtacacaagcagcggtgctgcttgtcggagccagtaggggctctgtggctgagctgagtggtttctaaaactcgtatgggcgtgacagttcacacctgtaattccagcactttgggaggccaaggcaggaggattgcttgaggccaggagtttgagagcagcttgggcaacatagcaagaccctatctctacaaaaaattaataaaaaataaa

SEQ ID NO: 313444 - DNA, 10040 bp, Homo sapiens
  misc_feature (4486)..(4486): n is a, c, g, or t
ttatttatttatttatttatttttttgtctatttgttgtgtaggggctatttcttgggctaatgcaagggcagggaccgaacccgcaacctcatggttcctagtcggattcgttaaccactgcgccacgacaggaactcccctgtgtctgacagttttaaagaaagcttttaagtggtgactcgacatcccgaggtgttgcggtcctattatcgcaatgggcactctatcttaggcgttcaaataaaggactaggaagcaaacacccaagcaccggggaacagaacagaaagaaagacggaaggagccaagagttttggagccaactcctggagagggagcggctgaactgattcggaagttggatctctttgtacacaggaatgcggagagaaaaaaaacaaaacccaccccattgcttcatttcccctccaagcctgagcactttctattgtgcaatgaaaaggcttttcacgttgagaaaaatgaatcccgaatttgctctgcaaagggatgagcgcgcctctgggcgccagcctgctctcagctgggcgcggagaccgcgcggtggccgcagggcggccgcggccagggcgctccagggcgcgccctccgcgagcggctccggggtgacgcccgccggagagctggactcccccttccgcgggcgcctgcactggctcttagccagccgagggcccgggtgcagatagtccgggaaccccgagggcggagagctccccactacgcctgggcctcccagggatggcagctccgagagccccctagacccggtgccttgcaggacgcctctggagatcaggagggctggcggcgcattcggcgtccgggaggccgggccccggacgcgcgaggagcgcggggcgcgggaaggcaggcgggtgcacatgggtgccggcgggcgagctgcggggggagggggggcggggtgtggcctccccgcctcccgggcgggatttgcatgtgtgtggtggccccagacttcctgctccttctacgctgcaggtacgcgcgggccgggcggggcgggcgggcggcgggcgcgccaagacgtgggcacctcctcacccggaccccgggccccgccgagccgcctcctggctcccgtggccgccagcccgccccggccgcaccgagcgtcgggatccgaggtgggagcgtacccctccccgctccccggacgcctcagtcctccgcactgagcttggccacgcgcccctaggcgccccccacgccctgggccccggagggccgcagccatgagtgaaatgtccagctttcttcacatcggggacatcgtctccctgtacgccgagggctccgtcaatggcttcatcagcactttggggctggtggatgaccgctgtgtggtggagcccgcggccggggacctggacaacccccctaagaagttccgtgactgcctcttcaaggtgtgccccatgaaccgctactcggcccagaagcagtactggaaggccaagcagactaagcaggacaaggagaagatcgctgatgtggtgttgctgcagaagctgcagcatgcggcgcagatggagcagaagcaaaatgacacggagaacaagaaggtgcatggggatgtcgtgaagtatggcagtgtgatccagctcctgcacatgaagagcaacaagtacctgacagtgaacaagcggcttccggccttgctggagaagaacgccatgcgggtgactctggatgccacaggcaacgagggttcctggctcttcatccagcccttctggaagctgcggagcaacggggacaacgtggtcgtgggggacaaggtgatcctgaatcctgtcaatgccgggcagcctctgcatgccagcaattacgagctcagcgacaacgccggctgcaaggaggtcaattctgtgaactgcaacaccagctggaagatcaacctgtttatgcagtttcgggaccacctggaggaggtgttgaaagggggagacgtggtgcggctgttccatgcggagcaggagaagttcctgacgtgtgacgagtacaagggcaagctgcaggtgttcctgcgaactacactgcgccagtctgccacctcggccaccagctccaatgctctctgggaggtggaggtggtccaccacgacccctgccgtggaggagctgggcactggaatggcttgtaccgcttcaagcacctggctacaggcaactacctggctgctgaggagaaccccagttacaaaggtgatgcctcagatcccaaggcagcaggaatgggggcacagggccgcacaggccgcaggaatgctggggagaagatcaagtactgcctggtggctgtgcctcatggcaatgacatcgcctctctctttgagctggaccccaccaccttgcagaaaaccgactctttcgtgccccggaactcgtacgtccggctgcggcacctctgcaccaacacgtggattcagagcaccaatgtgcccattgacatcgaggaggagcggcccatccggctcatgctgggcacctgccccaccaaggaggacaaggaggcctttgccatcgtgtcagtgcccgtgtctgagatccgagacctggactttgccaatgacgccagctccatgctggccagtgccgtggagaaactcaacgagggcttcatcagccagaatgaccgcaggtttgtcatccagctgctggaagacctggtgttctttgtcagcgatgtccccaacaatgggcagaatgtcctggacatcatggtcactaagcccaaccgggaacggcagaagctgatgagggagcagaacatcctcaaacaggtctttggcattctgaaggccccgttccgtgagaaggggggtgaaggtcccctggtgcggctggaggagctgtcagaccagaagaacgccccctaccagcacatgttccgcctgtgctaccgcgtgttgcggcattcccaggaggactaccgcaagaaccaggagcacattgccaagcagtttgggatgatgcagtcccagattggctacgacatcctggccgaggacaccatcactgccctgctgcacaacaaccgcaagctcctggaaaagcacatcaccaagaccgaggtggagaccttcgtcagccttgtgcgcaagaaccgggagcccaggttcctggactacctctctgacctgtgtgtgtccaaccacatcgccatccccgtcacccaagagctcatctgcaagtgtgtgctggaccccaagaacagtgacattctcatccggaccgagcttcggcccgtgaaggagatggcccaatcccacgagtacctgagcatcgagtactcagaagaggaagtgtggctcacgtggactgacaagaataacgagcatcatgagaagagtgtgaggcagctggcccaggaggcgcgggccggcaacgcccacgacgagaatgtgctcagctactacaggtaccagctgaagctctttgcccgcatgtgcttggaccgccagtacttggccatcgacgagatctcccagcagctgggcgtggacctgattttcctgtgcatggcagacgagatgctgccctttgacctgcgcgcctccttctgccacctgatgctgcacgtgcacgtggaccgtgacccccaggagctggtcacgccggtcaagtttgcccgtctctggactgagatccccacagccatcaccatcaaggactatgattccaacctcaacgcgtcccgagatgacaagaagaacaagtttgccaacaccatggagttcgtggaggactacctcaacaatgtagtcagcgaggccgtgccctttgccaacgaggagaagaacaagctcacttttgaggtggtcagcctggcgcacaatctcatctacttcggcttctacagcttcagcgagctgctgcggctcactcgcacactgctgggcatcatcgactgtgtgcaggggcccccggccatgctgcaggcctatgaggaccccggtggcaagaatgtgcggcggtccatccagggcgtggggcacatgatgtccaccatggtgctgagccgcaagcagtccgtcttcagtgcccccagcctgtctgctggggccagtgctgctgagccgctggacagaagcaagtttgaggagaatgaggacattgtggtgatggagaccaagctgaagatcctggaaatccttcagttcatcctcaacgtccgcctggattaccgcatatcctacctgctgtctgtcttcaagaaggagtttgtggaggtgtttcccatgcaggacagtggggctgatggcacagcccctgccttcgactctaccactgccaacatgaacctggatcgcatcggggagcaggcggaggccatgtttggagtggggaagacaagcagcatgctggaggtggatgacgagggcggccgcatgttcctgcgcgtgctcatccacctcaccatgcacgactatgcgccnctggtctcgggtgccctgcagctgctcttcaagcacttcagccagcgccaggaggccatgcacaccttcaagcaggttcagctgctgatctcagcgcaggacgtggagaactacaaggtgatcaagtcggagctggaccggctgcggaccatggtggagaagtcagagctgtgggtggacaagaagggcagtggcaagggtgaggaggtggaggcaggcgccgccaaggacaagaaagagcgtcccacggacgaggagggctttctgcacccaccaggggagaaaagcagtgagaactaccagatcgtcaagggcatcctggaaaggctgaacaagatgtgcggggttggggagcaaatgaggaagaagcagcaacggctgctgaagaacatggatgcccacaaggtcatgctggacctgctgcagatcccctatgacaagggtgatgccaagatgatggagatcctgcgctacacgcaccagttcctgcagaagttctgtgcagggaaccccggcaaccaggccctgctgcacaaacacctgcacctcttcctcacgccagggctcctggaggcagagaccatgcagcacatcttcctgaacaactatcagctctgctccgagatcagcgagcctgtgttgcagcacttcgtgcacctgctggccacgcacgggcgccatgtgcagtacctggacttcctgcacaccgtcattaaggccgagggcaagtacgtcaagaagtgccaggacatgatcatgactgagctgaccaatgcaggtgacgatgtggtcgtgttctacaatgataaggcatcgctggcccacctgctggacatgatgaaggccgcccgcgacggcgtggaggaccacagccccctcatgtaccacatttccctggtggacctgctggccgcctgtgccgagggcaaaaacgtctacactgagatcaagtgcacctccctgctgccgctggaggacgtggtgtctgtggtgacgcatgaggactgcatcactgaggtgaaaatggcctatgtgaacttcgtgaaccactgctacgtggacacggaggtggagatgaaggagatctacaccagcaaccacatctggacgctctttgagaacttcaccctggacatggctcgggtctgcagcaagcgtgagaagcgcgtggctgaccccaccttggagaagtacgtgctgagcgttgtgctggacaccatcaacgccttcttcagctccccattctctgagaacagcacttccctgcagacacaccagacgattgtggtgcagctgctgcagtctaccacacgcctcctcgagtgtccgtggctacagcagcagcacaagggctccgtggaggcctgcatccggaccctcgccatggtggccaagggccgggccatcttgctgcccatggacctggatgcccacatcagctcgatgctcagcagtggagccagctgtgcagctgccgcccagcggaacgcctccagctacaaggcaaccacgcgggccttcccccgcgtcacccccaccgccaaccagtgggactacaagaacatcattgagaagctgcaggacatcatcacagccctggaggagcggctgaagcccctggtacaggctgagctgtccgtgctggtggatgtcctgcactggcctgagctgctcttcctggagggcagtgaggcctaccagcgctgcgagagtgggggcttcctgtccaagctgatccagcacaccaaggacctcatggagtcggaggagaagctgtgcatcaaggtgctgcggaccctgcagcagatgctgctcaagaagaccaagtacggggaccggggcaaccagctgcgcaagatgctgctgcaaaactacctccagaaccggaagtccacctcgcggggggaccttcccgaccccataggcactggcctggacccagactggtcggcaatcgcagccacccagtgccggctggacaaggagggggccaccaagttggtatgcgacctcatcaccagcaccaagaacgagaagatcttccaggagagcatcggcctggccatccacctgctggatggtggcaacacagagatccagaaatccttccacaacctgatgatgagtgacaagaagtcagagcgcttcttcaaggtgctgcacgaccgcatgaagcgggcccagcaggagaccaagtccacggtggcagtcaacatgaatgacctgggcagccagccacatgaggaccgcgagccagtcgaccccaccaccaaaggccgcgtggcctccttctcgatacctggctcctcatcccgctactcgctgggccccagcctgcgccgggggcacgaggtgagcgaacgtgtgcagagcagtgagatgggcacatccgtgctcatcatgcagcccatcctgcgctttctgcagctgctgtgtgagaaccacaaccgggacctgcagaacttcctgcgctgtcagaacaacaaaaccaactacaacttggtatgcgagacgctgcagttcctggacatcatgtgcggcagcaccacgggcggcctggggctgctggggctctacatcaatgaggacaacgtgggcctcgtcatccagaccttggagaccctcactgagtactgccagggcccctgccatgagaaccagacttgcattgtgactcacgagtccaatggcatagacatcatcaccgcactgatcctcaatgacatcagccccctgtgcaagtaccgcatggatctggtgctgcagctcaaggacaatgcctccaagctgctcctggctctgatggagagccggcatgacagtgaaaatgctgagcgaatcctcatcagcctgcggccccaggagctggtggacgtcatcaagaaggcctacctgcaggaggaagagcgtgagaactcggaggtgagcccacgtgaagtgggccataacatctatatcctggcgctgcagctctccaggcacaataaacagctgcagcacctgctgaagccggtgaagcgcattcaagaggaggaggccgagggtatctcttccatgctcagcctcaacaacaagcagctgtcacagatgctcaagtcctcagcgccagcacaggaggaggaggaagaccccctggcctactatgagaaccacacgtcccagatcgagattgtgcggcaggaccgcagcatggagcagatcgtgttcccagtgcccggcatctgccagttcctgacggaggaaaccaagcaccggctcttcaccactactgagcaggacgagcagggcagcaaagtgagcgacttcttcgaccagtcctccttcctgcacaacgagatggagtggcagcgcaagctccgcagcatgccgctgatctactggttctcccgccgcatgaccctgtggggcagcatctccttcaacctggccgtgtttatcaacatcatcattgccttcttctacccttacatggagggcgcgtccacaggcgtgctggactcccctctcatctcattgctcttctggatcctcatctgcttctccatcgcggccctgttcaccaagcgctacagcatccgccccctcatcgtggcgctcatcctgcgctccatctactatctgggcatcgggcccacactcaacatcctgggtgccctcaatctgaccaacaagatcgtgtttgtggtgagcttcgtgggcaaccgtggcaccttcatccggggctataaggccatggtcatggacatggaattcctctaccacgtgggctacatcctgaccagtgtcctgggcctctttgctcatgagctgttctacagcatcctgctctttgacctcatctaccgcgaggagacgctgttcaacgtcatcaagagtgtgacccgcaatggccgctccatcctgctgacagccctgctggccctcatcctggtctacctcttctccatcgtcggcttcctcttcctcaaggatgacttcattctcgaggtcgaccggctgcccaacaaccactccacagccagccccctggggatgccacatggagctgctgcatttgtggacacctgcagtggggacaagatggactgtgtctcagggctctcggtgcctgaggtcctggaagaggacagggagctggacagcacagagcgggcctgtgacactctgttgatgtgcatcgtcactgtcatgaaccatgggctacgcaacggtggtggcgtgggcgacattctccgcaagccctccaaagatgagtctctcttcccagcccgagtggtctatgacctcctgttcttcttcatcgtcatcatcattgtgctgaacctcatctttggggtaatcatcgacaccttcgctgacctgcgtagtgagaagcagaagaaggaggagattcttaagacgacatgcttcatctgtggtctggagagggacaagtttgataacaagacagtgtcatttgaggaacacatcaagctggagcacaacatgtggaactacttgtacttcattgtgctggtccgcgtgaagaacaagaccgactacacgggccctgagagctacgtggcccagatgatcaagaacaagaacctggactggttcccccggatgcgggccatgtcccttgtcagcaatgagggcgagggggagcagaatgagattcggattctccaggacaagctcaactccaccatgaagctggtgtcccacctcactgcccagctcaacgagctcaaggagcagatgacggagcagcggaaacgcaggcaacgcctaggctttgtggatgtccagaactgcattagccgctgaggagagccaccgaaggccccaacaggggatgctcatcactggagactgcgactgggaagaacactgccccctccctcgggttgggtggcccagccagctggccagcctccactcccactctgccagacaccctgacacccacccaggctttgaagagcatggagggggagcctcagagctgacagtcctgcttagagcccttataaatcctacctagagacctttgttccttaaagcaataactgacaactctttgtagtcctccttgtgggtagttaagagtggggtcacccctttaactccaagcactacattttggcggctgccggcctctgggggaggtggcagttatgctgttactagtgattttagggctttgttatttaacttatttcaagggtgctgtgctcagccctgcccatggctgtgcagctccctccgtgcctcagatctgctgtagccagtgcagacctcactgtcgtgtccatgccacccccggcatggctccaggtggcctggtgactccatgatggacgatcttgctcccaggacctgcctcttcccaggcttcctggggaagagttgtacgcccaggcaacaagggctgagctgcgcttgcgtggctgtttcatgaccgcttgtttttctccttttggtgtaatgttttacaaatcctttggcctgagaactaatatgttaattgccttaaataaattaatagaaatctagtccgttaaaaaaaaaa

SEQ ID NO: 313445 - DNA, 10224 bp, Homo sapiens
  misc_feature (4486)..(4486): n is a, c, g, or t
ttatttatttatttatttatttttttgtctatttgttgtgtaggggctatttcttgggctaatgcaagggcagggaccgaacccgcaacctcatggttcctagtcggattcgttaaccactgcgccacgacaggaactcccctgtgtctgacagttttaaagaaagcttttaagtggtgactcgacatcccgaggtgttgcggtcctattatcgcaatgggcactctatcttaggcgttcaaataaaggactaggaagcaaacacccaagcaccggggaacagaacagaaagaaagacggaaggagccaagagttttggagccaactcctggagagggagcggctgaactgattcggaagttggatctctttgtacacaggaatgcggagagaaaaaaaacaaaacccaccccattgcttcatttcccctccaagcctgagcactttctattgtgcaatgaaaaggcttttcacgttgagaaaaatgaatcccgaatttgctctgcaaagggatgagcgcgcctctgggcgccagcctgctctcagctgggcgcggagaccgcgcggtggccgcagggcggccgcggccagggcgctccagggcgcgccctccgcgagcggctccggggtgacgcccgccggagagctggactcccccttccgcgggcgcctgcactggctcttagccagccgagggcccgggtgcagatagtccgggaaccccgagggcggagagctccccactacgcctgggcctcccagggatggcagctccgagagccccctagacccggtgccttgcaggacgcctctggagatcaggagggctggcggcgcattcggcgtccgggaggccgggccccggacgcgcgaggagcgcggggcgcgggaaggcaggcgggtgcacatgggtgccggcgggcgagctgcggggggagggggggcggggtgtggcctccccgcctcccgggcgggatttgcatgtgtgtggtggccccagacttcctgctccttctacgctgcaggtacgcgcgggccgggcggggcgggcgggcggcgggcgcgccaagacgtgggcacctcctcacccggaccccgggccccgccgagccgcctcctggctcccgtggccgccagcccgccccggccgcaccgagcgtcgggatccgaggtgggagcgtacccctccccgctccccggacgcctcagtcctccgcactgagcttggccacgcgcccctaggcgccccccacgccctgggccccggagggccgcagccatgagtgaaatgtccagctttcttcacatcggggacatcgtctccctgtacgccgagggctccgtcaatggcttcatcagcactttggggctggtggatgaccgctgtgtggtggagcccgcggccggggacctggacaacccccctaagaagttccgtgactgcctcttcaaggtgtgccccatgaaccgctactcggcccagaagcagtactggaaggccaagcagactaagcaggacaaggagaagatcgctgatgtggtgttgctgcagaagctgcagcatgcggcgcagatggagcagaagcaaaatgacacggagaacaagaaggtgcatggggatgtcgtgaagtatggcagtgtgatccagctcctgcacatgaagagcaacaagtacctgacagtgaacaagcggcttccggccttgctggagaagaacgccatgcgggtgactctggatgccacaggcaacgagggttcctggctcttcatccagcccttctggaagctgcggagcaacggggacaacgtggtcgtgggggacaaggtgatcctgaatcctgtcaatgccgggcagcctctgcatgccagcaattacgagctcagcgacaacgccggctgcaaggaggtcaattctgtgaactgcaacaccagctggaagatcaacctgtttatgcagtttcgggaccacctggaggaggtgttgaaagggggagacgtggtgcggctgttccatgcggagcaggagaagttcctgacgtgtgacgagtacaagggcaagctgcaggtgttcctgcgaactacactgcgccagtctgccacctcggccaccagctccaatgctctctgggaggtggaggtggtccaccacgacccctgccgtggaggagctgggcactggaatggcttgtaccgcttcaagcacctggctacaggcaactacctggctgctgaggagaaccccagttacaaaggtgatgcctcagatcccaaggcagcaggaatgggggcacagggccgcacaggccgcaggaatgctggggagaagatcaagtactgcctggtggctgtgcctcatggcaatgacatcgcctctctctttgagctggaccccaccaccttgcagaaaaccgactctttcgtgccccggaactcgtacgtccggctgcggcacctctgcaccaacacgtggattcagagcaccaatgtgcccattgacatcgaggaggagcggcccatccggctcatgctgggcacctgccccaccaaggaggacaaggaggcctttgccatcgtgtcagtgcccgtgtctgagatccgagacctggactttgccaatgacgccagctccatgctggccagtgccgtggagaaactcaacgagggcttcatcagccagaatgaccgcaggtttgtcatccagctgctggaagacctggtgttctttgtcagcgatgtccccaacaatgggcagaatgtcctggacatcatggtcactaagcccaaccgggaacggcagaagctgatgagggagcagaacatcctcaaacaggtctttggcattctgaaggccccgttccgtgagaaggggggtgaaggtcccctggtgcggctggaggagctgtcagaccagaagaacgccccctaccagcacatgttccgcctgtgctaccgcgtgttgcggcattcccaggaggactaccgcaagaaccaggagcacattgccaagcagtttgggatgatgcagtcccagattggctacgacatcctggccgaggacaccatcactgccctgctgcacaacaaccgcaagctcctggaaaagcacatcaccaagaccgaggtggagaccttcgtcagccttgtgcgcaagaaccgggagcccaggttcctggactacctctctgacctgtgtgtgtccaaccacatcgccatccccgtcacccaagagctcatctgcaagtgtgtgctggaccccaagaacagtgacattctcatccggaccgagcttcggcccgtgaaggagatggcccaatcccacgagtacctgagcatcgagtactcagaagaggaagtgtggctcacgtggactgacaagaataacgagcatcatgagaagagtgtgaggcagctggcccaggaggcgcgggccggcaacgcccacgacgagaatgtgctcagctactacaggtaccagctgaagctctttgcccgcatgtgcttggaccgccagtacttggccatcgacgagatctcccagcagctgggcgtggacctgattttcctgtgcatggcagacgagatgctgccctttgacctgcgcgcctccttctgccacctgatgctgcacgtgcacgtggaccgtgacccccaggagctggtcacgccggtcaagtttgcccgtctctggactgagatccccacagccatcaccatcaaggactatgattccaacctcaacgcgtcccgagatgacaagaagaacaagtttgccaacaccatggagttcgtggaggactacctcaacaatgtagtcagcgaggccgtgccctttgccaacgaggagaagaacaagctcacttttgaggtggtcagcctggcgcacaatctcatctacttcggcttctacagcttcagcgagctgctgcggctcactcgcacactgctgggcatcatcgactgtgtgcaggggcccccggccatgctgcaggcctatgaggaccccggtggcaagaatgtgcggcggtccatccagggcgtggggcacatgatgtccaccatggtgctgagccgcaagcagtccgtcttcagtgcccccagcctgtctgctggggccagtgctgctgagccgctggacagaagcaagtttgaggagaatgaggacattgtggtgatggagaccaagctgaagatcctggaaatccttcagttcatcctcaacgtccgcctggattaccgcatatcctacctgctgtctgtcttcaagaaggagtttgtggaggtgtttcccatgcaggacagtggggctgatggcacagcccctgccttcgactctaccactgccaacatgaacctggatcgcatcggggagcaggcggaggccatgtttggagtggggaagacaagcagcatgctggaggtggatgacgagggcggccgcatgttcctgcgcgtgctcatccacctcaccatgcacgactatgcgccnctggtctcgggtgccctgcagctgctcttcaagcacttcagccagcgccaggaggccatgcacaccttcaagcaggttcagctgctgatctcagcgcaggacgtggagaactacaaggtgatcaagtcggagctggaccggctgcggaccatggtggagaagtcagagctgtgggtggacaagaagggcagtggcaagggtgaggaggtggaggcaggcgccgccaaggacaagaaagagcgtcccacggacgaggagggctttctgcacccaccaggggagaaaagcagtgagaactaccagatcgtcaagggcatcctggaaaggctgaacaagatgtgcggggttggggagcaaatgaggaagaagcagcaacggctgctgaagaacatggatgcccacaaggtcatgctggacctgctgcagatcccctatgacaagggtgatgccaagatgatggagatcctgcgctacacgcaccagttcctgcagaagttctgtgcagggaaccccggcaaccaggccctgctgcacaaacacctgcacctcttcctcacgccagggctcctggaggcagagaccatgcagcacatcttcctgaacaactatcagctctgctccgagatcagcgagcctgtgttgcagcacttcgtgcacctgctggccacgcacgggcgccatgtgcagtacctggacttcctgcacaccgtcattaaggccgagggcaagtacgtcaagaagtgccaggacatgatcatgactgagctgaccaatgcaggtgacgatgtggtcgtgttctacaatgataaggcatcgctggcccacctgctggacatgatgaaggccgcccgcgacggcgtggaggaccacagccccctcatgtaccacatttccctggtggacctgctggccgcctgtgccgagggcaaaaacgtctacactgagatcaagtgcacctccctgctgccgctggaggacgtggtgtctgtggtgacgcatgaggactgcatcactgaggtgaaaatggcctatgtgaacttcgtgaaccactgctacgtggacacggaggtggagatgaaggagatctacaccagcaaccacatctggacgctctttgagaacttcaccctggacatggctcgggtctgcagcaagcgtgagaagcgcgtggctgaccccaccttggagaagtacgtgctgagcgttgtgctggacaccatcaacgccttcttcagctccccattctctgagaacagcacttccctgcagacacaccagacgattgtggtgcagctgctgcagtctaccacacgcctcctcgagtgtccgtggctacagcagcagcacaagggctccgtggaggcctgcatccggaccctcgccatggtggccaagggccgggccatcttgctgcccatggacctggatgcccacatcagctcgatgctcagcagtggagccagctgtgcagctgccgcccagcggaacgcctccagctacaaggcaaccacgcgggccttcccccgcgtcacccccaccgccaaccagtgggactacaagaacatcattgagaagctgcaggacatcatcacagccctggaggagcggctgaagcccctggtacaggctgagctgtccgtgctggtggatgtcctgcactggcctgagctgctcttcctggagggcagtgaggcctaccagcgctgcgagagtgggggcttcctgtccaagctgatccagcacaccaaggacctcatggagtcggaggagaagctgtgcatcaaggtgctgcggaccctgcagcagatgctgctcaagaagaccaagtacggggaccggggcaaccagctgcgcaagatgctgctgcaaaactacctccagaaccggaagtccacctcgcggggggaccttcccgaccccataggcactggcctggacccagactggtcggcaatcgcagccacccagtgccggctggacaaggagggggccaccaagttggtatgcgacctcatcaccagcaccaagaacgagaagatcttccaggagagcatcggcctggccatccacctgctggatggtggcaacacagagatccaggtgtggggggcctggggcctggacatgccctcctttgcctccctccctttttggaggaggtgggccttgagttgggcactgaaggccgaggagggtgtgaaagaggagaggcctgagcagtggctgagagaaatccttccacaacctgatgatgagtgacaagaagtcagagcgcttcttcaaggtgctgcacgaccgcatgaagcgggcccagcaggagaccaagtccacggtggcagtcaacatgaatgacctgggcagccagccacatgaggaccgcgagccagtcgaccccaccaccaaaggccgcgtggcctccttctcgatacctggctcctcatcccgctactcgctgggccccagcctgcgccgggggcacgaggtgagcgaacgtgtgcagagcagtgagatgggcacatccgtgctcatcatgcagcccatcctgcgctttctgcagctgctgtgtgagaaccacaaccgggacctgcagaacttcctgcgctgtcagaacaacaaaaccaactacaacttggtatgcgagacgctgcagttcctggacatcatgtgcggcagcaccacgggcggcctggggctgctggggctctacatcaatgaggacaacgtgggcctcgtcatccagaccttggagaccctcactgagtactgccagggcccctgccatgagaaccagacttgcattgtgactcacgagtccaatggcatagacatcatcaccgcactgatcctcaatgacatcagccccctgtgcaagtaccgcatggatctggtgctgcagctcaaggacaatgcctccaagctgctcctggctctgatggagagccggcatgacagtgaaaatgctgagcgaatcctcatcagcctgcggccccaggagctggtggacgtcatcaagaaggcctacctgcaggaggaagagcgtgagaactcggaggtgagcccacgtgaagtgggccataacatctatatcctggcgctgcagctctccaggcacaataaacagctgcagcacctgctgaagccggtgaagcgcattcaagaggaggaggccgagggtatctcttccatgctcagcctcaacaacaagcagctgtcacagatgctcaagtcctcagcgccagcacaggaggaggaggaagaccccctggcctactatgagaaccacacgtcccagatcgagattgtgcggcaggaccgcagcatggagcagatcgtgttcccagtgcccggcatctgccagttcctgacggaggaaaccaagcaccggctcttcaccactactgagcaggacgagcagggcagcaaagtgagcgacttcttcgaccagtcctccttcctgcacaacgagatggagtggcagcgcaagctccgcagcatgccgctgatctactggttctcccgccgcatgaccctgtggggcagcatctccttcaacctggccgtgtttatcaacatcatcattgccttcttctacccttacatggagggcgcgtccacaggcgtgctggactcccctctcatctcattgctcttctggatcctcatctgcttctccatcgcggccctgttcaccaagcgctacagcatccgccccctcatcgtggcgctcatcctgcgctccatctactatctgggcatcgggcccacactcaacatcctgggtgccctcaatctgaccaacaagatcgtgtttgtggtgagcttcgtgggcaaccgtggcaccttcatccggggctataaggccatggtcatggacatggaattcctctaccacgtgggctacatcctgaccagtgtcctgggcctctttgctcatgagctgttctacagcatcctgctctttgacctcatctaccgcgaggagacgctgttcaacgtcatcaagagtgtgacccgcaatggccgctccatcctgctgacagccctgctggccctcatcctggtctacctcttctccatcgtcggcttcctcttcctcaaggatgacttcattctcgaggtcgaccggctgcccaacaaccactccacagccagccccctggggatgccacatggagctgctgcatttgtggacacctgcagtggggacaagatggactgtgtctcagggctctcggtgcctgaggtcctggaagaggacagggagctggacagcacagagcgggcctgtgacactctgttgatgtgcatcgtcactgtcatgaaccatgggctacgcaacggtggtggcgtgggcgacattctccgcaagccctccaaagatgagtctctcttcccagcccgagtggtctatgacctcctgttcttcttcatcgtcatcatcattgtgctgaacctcatctttggggtaatcatcgacaccttcgctgacctgcgtagtgagaagcagaagaaggaggagattcttaagacgacatgcttcatctgtggtctggagagggacaagtttgataacaagacagtgtcatttgaggaacacatcaagctggagcacaacatgtggaactacttgtacttcattgtgctggtccgcgtgaagaacaagaccgactacacgggccctgagagctacgtggcccagatgatcaagaacaagaacctggactggttcccccggatgcgggccatgtcccttgtcagcaatgagggcgagggggagcagaatgagattcggattctccaggacaagctcaactccaccatgaagctggtgtcccacctcactgcccagctcaacgagctcaaggagcagatgacggagcagcggaaacgcaggcaacgcctaggctttgtggatgtccagaactgcattagccgctgaggagagccaccgaaggccccaacaggggatgctcatcactggagactgcgactgggaagaacactgccccctccctcgggttgggtggcccagccagctggccagcctccactcccactctgccagacaccctgacacccacccaggctttgaagagcatggagggggagcctcagagctgacagtcctgcttagagcccttaaaaagacttgaaagttcactgggactcagtttaccttaatgccttagcagaagataaatcctacctagagacctttgttccttaaagcaataactgacaactctttgtagtcctccttgtgggtagttaagagtggggtcacccctttaactccaagcactacattttggcggctgccggcctctgggggaggtggcagttatgctgttactagtgattttagggctttgttatttaacttatttcaagggtgctgtgctcagccctgcccatggctgtgcagctccctccgtgcctcagatctgctgtagccagtgcagacctcactgtcgtgtccatgccacccccggcatggctccaggtggcctggtgactccatgatggacgatcttgctcccaggacctgcctcttcccaggcttcctggggaagagttgtacgcccaggcaacaagggctgagctgcgcttgcgtggctgtttcatgaccgcttgtttttctccttttggtgtaatgttttacaaatcctttggcctgagaactaatatgttaattgccttaaataaattaatagaaatctagtccgttaaaaaaaaaa

SEQ ID NO: 313446 - DNA, 9893 bp, Homo sapiens
  misc_feature (4285)..(4285): n is a, c, g, or t
ttatttatttatttatttatttttttgtctatttgttgtgtaggggctatttcttgggctaatgcaagggcagggaccgaacccgcaacctcatggttcctagtcggattcgttaaccactgcgccacgacaggaactcccctgtgtctgacagttttaaagaaagcttttaagtggtgactcgacatcccgaggtgttgcggtcctattatcgcaatgggcactctatcttaggcgttcaaataaaggactaggaagcaaacacccaagcaccggggaacagaacagaaagaaagacggaaggagccaagagttttggagccaactcctggagagggagcggctgaactgattcggaagttggatctctttgtacacaggaatgcggagagaaaaaaaacaaaacccaccccattgcttcatttcccctccaagcctgagcactttctattgtgcaatgaaaaggcttttcacgttgagaaaaatgaatcccgaatttgctctgcaaagggatgagcgcgcctctgggcgccagcctgctctcagctgggcgcggagaccgcgcggtggccgcagggcggccgcggccagggcgctccagggcgcgccctccgcgagcggctccggggtgacgcccgccggagagctggactcccccttccgcgggcgcctgcactggctcttagccagccgagggcccgggtgcagatagtccgggaaccccgagggcggagagctccccactacgcctgggcctcccagggatggcagctccgagagccccctagacccggtgccttgcaggacgcctctggagatcaggagggctggcggcgcattcggcgtccgggaggccgggccccggacgcgcgaggagcgcggggcgcgggaaggcaggcgggtgcacatgggtgccggcgggcgagctgcggggggagggggggcggggtgtggcctccccgcctcccgggcgggatttgcatgtgtgtggtggccccagacttcctgctccttctacgctgcaggtacgcgcgggccgggcggggcgggcgggcggcgggcgcgccaagacgtgggcacctcctcacccggaccccgggccccgccgagccgcctcctggctcccgtggccgccagcccgccccggccgcaccgagcgtcgggatccgaggtgggagcgtacccctccccgctccccggacgcctcagtcctccgcactgagcttggccacgcgcccctaggcgccccccacgccctgggccccggagggccgcagccatgagtgaaatgtccagctttcttcacatcggggacatcgtctccctgtacgccgagggctccgtcaatggcttcatcagcactttggggctggtggatgaccgctgtgtggtggagcccgcggccggggacctggacaacccccctaagaagttccgtgactgcctcttcaaggtgtgccccatgaaccgctactcggcccagaagcagtactggaaggccaagcagactaagcaggacaaggagaagatcgctgatgtggtgttgctgcagaagctgcagcatgcggcgcagatggagcagaagcaaaatgacacggagaacaagaaggtgcatggggatgtcgtgaagtatggcagtgtgatccagctcctgcacatgaagagcaacaagtacctgacagtgaacaagcggcttccggccttgctggagaagaacgccatgcgggtgactctggatgccacaggcaacgagggttcctggctcttcatccagcccttctggaagctgcggagcaacggggacaacgtggtcgtgggggacaaggtgatcctgaatcctgtcaatgccgggcagcctctgcatgccagcaattacgagctcagcgacaacgccggctgcaaggaggtcaattctgtgaactgcaacaccagctggaagatcaacctgtttatgcagtttcgggaccacctggaggaggtgttgaaagggggagacgtggtgcggctgttccatgcggagcaggagaagttcctgacgtgtgacgagtacaagggcaagctgcaggtgttcctgcgaactacactgcgccagtctgccacctcggccaccagctccaatgctctctgggaggtggaggtggtccaccacgacccctgccgtggaggagctgggcactggaatggcttgtaccgcttcaagcacctggctacaggcaactacctggctgctgaggagaaccccagttacaaaggtgatgcctcagatcccaaggcagcaggaatgggggcacagggccgcacaggccgcaggaatgctggggagaagatcaagtactgcctggtggctgtgcctcatggcaatgacatcgcctctctctttgagctggaccccaccaccttgcagaaaaccgactctttcgtgccccggaactcgtacgtccggctgcggcacctctgcaccaacacgtggattcagagcaccaatgtgcccattgacatcgaggaggagcggcccatccggctcatgctgggcacctgccccaccaaggaggacaaggaggcctttgccatcgtgtcagtgcccgtgtctgagatccgagacctggactttgccaatgacgccagctccatgctggccagtgccgtggagaaactcaacgagggcttcatcagccagaatgaccgcaggtttgtcatccagctgctggaagacctggtgttctttgtcagcgatgtccccaacaatgggcagaatgtcctggacatcatggtcactaagcccaaccgggaacggcagaagctgatgagggagcagaacatcctcaaacaggtctttggcattctgaaggccccgttccgtgagaaggggggtgaaggtcccctggtgcggctggaggagctgtcagaccagaagaacgccccctaccagcacatgttccgcctgtgctaccgcgtgttgcggcattcccaggaggactaccgcaagaaccaggagcacattgccaagcagtttgggatgatgcagtcccagattggctacgacatcctggccgaggacaccatcactgccctgctgcacaacaaccgcaagctcctggaaaagcacatcaccaagaccgaggtggagaccttcgtcagccttgtgcgcaagaaccgggagcccaggttcctggactacctctctgacctgtgtgtgtccaaccacatcgccatccccgtcacccaagagctcatctgcaagtgtgtgctggaccccaagaacagtgacattctcatccggaccgagcttcggcccgtgaaggagatggcccaatcccacgagtacctgagcatcgagtactcagaagaggaagtgtggctcacgtggactgacaagaataacgagcatcatgagaagagtgtgaggcagctggcccaggaggcgcgggccggcaacgcccacgacgagaatgtgctcagctactacaggtaccagctgaagctctttgcccgcatgtgcttggaccgccagtacttggccatcgacgagatctcccagcagctgggcgtggacctgattttcctgtgcatggcagacgagatgctgccctttgacctgcgcgcctccttctgccacctgatgctgcacgtgcacgtggaccgtgacccccaggagctggtcacgccggtcaagtttgcccgtctctggactgagatccccacagccatcaccatcaaggactatgattccaacctcaacgcgtcccgagatgacaagaagaacaagtttgccaacaccatggagttcgtggaggactacctcaacaatgtagtcagcgaggccgtgccctttgccaacgaggagaagaacaagctcacttttgaggtggtcagcctggcgcacaatctcatctacttcggcttctacagcttcagcgagctgctgcggctcactcgcacactgctgggcatcatcgactgtgtgcaggggcccccggccatgctgcaggcctatgaggaccccggtggcaagaatgtgcggcggtccatccagggcgtggggcacatgatgtccaccatggtgctgagccgcaagcagtccgtcttcagtgcccccagcctgtctgctggggccagtgctgctgagccgctggacagaagcaagtttgaggagaatgaggacattgtggtgatggagaccaagctgaagatcctggaaatccttcagttcatcctcaacgtccgcctggattaccgcatgttcctgcgcgtgctcatccacctcaccatgcacgactatgcgccnctggtctcgggtgccctgcagctgctcttcaagcacttcagccagcgccaggaggccatgcacaccttcaagcaggttcagctgctgatctcagcgcaggacgtggagaactacaaggtgatcaagtcggagctggaccggctgcggaccatggtggagaagtcagagctgtgggtggacaagaagggcagtggcaagggtgaggaggtggaggcaggcgccgccaaggacaagaaagagcgtcccacggacgaggagggctttctgcacccaccaggggagaaaagcagtgagaactaccagatcgtcaagggcatcctggaaaggctgaacaagatgtgcggggttggggagcaaatgaggaagaagcagcaacggctgctgaagaacatggatgcccacaaggtcatgctggacctgctgcagatcccctatgacaagggtgatgccaagatgatggagatcctgcgctacacgcaccagttcctgcagaagttctgtgcagggaaccccggcaaccaggccctgctgcacaaacacctgcacctcttcctcacgccagggctcctggaggcagagaccatgcagcacatcttcctgaacaactatcagctctgctccgagatcagcgagcctgtgttgcagcacttcgtgcacctgctggccacgcacgggcgccatgtgcagtacctggacttcctgcacaccgtcattaaggccgagggcaagtacgtcaagaagtgccaggacatgatcatgactgagctgaccaatgcaggtgacgatgtggtcgtgttctacaatgataaggcatcgctggcccacctgctggacatgatgaaggccgcccgcgacggcgtggaggaccacagccccctcatgtaccacatttccctggtggacctgctggccgcctgtgccgagggcaaaaacgtctacactgagatcaagtgcacctccctgctgccgctggaggacgtggtgtctgtggtgacgcatgaggactgcatcactgaggtgaaaatggcctatgtgaacttcgtgaaccactgctacgtggacacggaggtggagatgaaggagatctacaccagcaaccacatctggacgctctttgagaacttcaccctggacatggctcgggtctgcagcaagcgtgagaagcgcgtggctgaccccaccttggagaagtacgtgctgagcgttgtgctggacaccatcaacgccttcttcagctccccattctctgagaacagcacttccctgcagacacaccagacgattgtggtgcagctgctgcagtctaccacacgcctcctcgagtgtccgtggctacagcagcagcacaagggctccgtggaggcctgcatccggaccctcgccatggtggccaagggccgggccatcttgctgcccatggacctggatgcccacatcagctcgatgctcagcagtggagccagctgtgcagctgccgcccagcggaacgcctccagctacaaggcaaccacgcgggccttcccccgcgtcacccccaccgccaaccagtgggactacaagaacatcattgagaagctgcaggacatcatcacagccctggaggagcggctgaagcccctggtacaggctgagctgtccgtgctggtggatgtcctgcactggcctgagctgctcttcctggagggcagtgaggcctaccagcgctgcgagagtgggggcttcctgtccaagctgatccagcacaccaaggacctcatggagtcggaggagaagctgtgcatcaaggtgctgcggaccctgcagcagatgctgctcaagaagaccaagtacggggaccggggcaaccagctgcgcaagatgctgctgcaaaactacctccagaaccggaagtccacctcgcggggggaccttcccgaccccataggcactggcctggacccagactggtcggcaatcgcagccacccagtgccggctggacaaggagggggccaccaagttggtatgcgacctcatcaccagcaccaagaacgagaagatcttccaggagagcatcggcctggccatccacctgctggatggtggcaacacagagatccagaaatccttccacaacctgatgatgagtgacaagaagtcagagcgcttcttcaaggtgctgcacgaccgcatgaagcgggcccagcaggagaccaagtccacggtggcagtcaacatgaatgacctgggcagccagccacatgaggaccgcgagccagtcgaccccaccaccaaaggccgcgtggcctccttctcgatacctggctcctcatcccgctactcgctgggccccagcctgcgccgggggcacgaggtgagcgaacgtgtgcagagcagtgagatgggcacatccgtgctcatcatgcagcccatcctgcgctttctgcagctgctgtgtgagaaccacaaccgggacctgcagaacttcctgcgctgtcagaacaacaaaaccaactacaacttggtatgcgagacgctgcagttcctggacatcatgtgcggcagcaccacgggcggcctggggctgctggggctctacatcaatgaggacaacgtgggcctcgtcatccagaccttggagaccctcactgagtactgccagggcccctgccatgagaaccagacttgcattgtgactcacgagtccaatggcatagacatcatcaccgcactgatcctcaatgacatcagccccctgtgcaagtaccgcatggatctggtgctgcagctcaaggacaatgcctccaagctgctcctggctctgatggagagccggcatgacagtgaaaatgctgagcgaatcctcatcagcctgcggccccaggagctggtggacgtcatcaagaaggcctacctgcaggaggaagagcgtgagaactcggaggtgagcccacgtgaagtgggccataacatctatatcctggcgctgcagctctccaggcacaataaacagctgcagcacctgctgaagccggtgaagcgcattcaagaggaggaggccgagggtatctcttccatgctcagcctcaacaacaagcagctgtcacagatgctcaagtcctcagcgccagcacaggaggaggaggaagaccccctggcctactatgagaaccacacgtcccagatcgagattgtgcggcaggaccgcagcatggagcagatcgtgttcccagtgcccggcatctgccagttcctgacggaggaaaccaagcaccggctcttcaccactactgagcaggacgagcagggcagcaaagtgagcgacttcttcgaccagtcctccttcctgcacaacgagatggagtggcagcgcaagctccgcagcatgccgctgatctactggttctcccgccgcatgaccctgtggggcagcatctccttcaacctggccgtgtttatcaacatcatcattgccttcttctacccttacatggagggcgcgtccacaggcgtgctggactcccctctcatctcattgctcttctggatcctcatctgcttctccatcgcggccctgttcaccaagcgctacagcatccgccccctcatcgtggcgctcatcctgcgctccatctactatctgggcatcgggcccacactcaacatcctgggtgccctcaatctgaccaacaagatcgtgtttgtggtgagcttcgtgggcaaccgtggcaccttcatccggggctataaggccatggtcatggacatggaattcctctaccacgtgggctacatcctgaccagtgtcctgggcctctttgctcatgagctgttctacagcatcctgctctttgacctcatctaccgcgaggagacgctgttcaacgtcatcaagagtgtgacccgcaatggccgctccatcctgctgacagccctgctggccctcatcctggtctacctcttctccatcgtcggcttcctcttcctcaaggatgacttcattctcgaggtcgaccggctgcccaacaaccactccacagccagccccctggggatgccacatggagctgctgcatttgtggacacctgcagtggggacaagatggactgtgtctcagggctctcggtgcctgaggtcctggaagaggacagggagctggacagcacagagcgggcctgtgacactctgttgatgtgcatcgtcactgtcatgaaccatgggctacgcaacggtggtggcgtgggcgacattctccgcaagccctccaaagatgagtctctcttcccagcccgagtggtctatgacctcctgttcttcttcatcgtcatcatcattgtgctgaacctcatctttggggtaatcatcgacaccttcgctgacctgcgtagtgagaagcagaagaaggaggagattcttaagacgacatgcttcatctgtggtctggagagggacaagtttgataacaagacagtgtcatttgaggaacacatcaagctggagcacaacatgtggaactacttgtacttcattgtgctggtccgcgtgaagaacaagaccgactacacgggccctgagagctacgtggcccagatgatcaagaacaagaacctggactggttcccccggatgcgggccatgtcccttgtcagcaatgagggcgagggggagcagaatgagattcggattctccaggacaagctcaactccaccatgaagctggtgtcccacctcactgcccagctcaacgagctcaaggagcagatgacggagcagcggaaacgcaggcaacgcctaggctttgtggatgtccagaactgcattagccgctgaggagagccaccgaaggccccaacaggggatgctcatcactggagactgcgactgggaagaacactgccccctccctcgggttgggtggcccagccagctggccagcctccactcccactctgccagacaccctgacacccacccaggctttgaagagcatggagggggagcctcagagctgacagtcctgcttagagcccttaaaaagacttgaaagttcactgggactcagtttaccttaatgccttagcagaagataaatcctacctagagacctttgttccttaaagcaataactgacaactctttgtagtcctccttgtgggtagttaagagtggggtcacccctttaactccaagcactacattttggcggctgccggcctctgggggaggtggcagttatgctgttactagtgattttagggctttgttatttaacttatttcaagggtgctgtgctcagccctgcccatggctgtgcagctccctccgtgcctcagatctgctgtagccagtgcagacctcactgtcgtgtccatgccacccccggcatggctccaggtggcctggtgactccatgatggacgatcttgctcccaggacctgcctcttcccaggcttcctggggaagagttgtacgcccaggcaacaagggctgagctgcgcttgcgtggctgtttcatgaccgcttgtttttctccttttggtgtaatgttttacaaatcctttggcctgagaactaatatgttaattgccttaaataaattaatagaaatctagtccgttaaaaaaaaaa

SEQ ID NO: 313447 - DNA, 11312 bp, Homo sapiens
  misc_feature (4486)..(4486): n is a, c, g, or t
ttatttatttatttatttatttttttgtctatttgttgtgtaggggctatttcttgggctaatgcaagggcagggaccgaacccgcaacctcatggttcctagtcggattcgttaaccactgcgccacgacaggaactcccctgtgtctgacagttttaaagaaagcttttaagtggtgactcgacatcccgaggtgttgcggtcctattatcgcaatgggcactctatcttaggcgttcaaataaaggactaggaagcaaacacccaagcaccggggaacagaacagaaagaaagacggaaggagccaagagttttggagccaactcctggagagggagcggctgaactgattcggaagttggatctctttgtacacaggaatgcggagagaaaaaaaacaaaacccaccccattgcttcatttcccctccaagcctgagcactttctattgtgcaatgaaaaggcttttcacgttgagaaaaatgaatcccgaatttgctctgcaaagggatgagcgcgcctctgggcgccagcctgctctcagctgggcgcggagaccgcgcggtggccgcagggcggccgcggccagggcgctccagggcgcgccctccgcgagcggctccggggtgacgcccgccggagagctggactcccccttccgcgggcgcctgcactggctcttagccagccgagggcccgggtgcagatagtccgggaaccccgagggcggagagctccccactacgcctgggcctcccagggatggcagctccgagagccccctagacccggtgccttgcaggacgcctctggagatcaggagggctggcggcgcattcggcgtccgggaggccgggccccggacgcgcgaggagcgcggggcgcgggaaggcaggcgggtgcacatgggtgccggcgggcgagctgcggggggagggggggcggggtgtggcctccccgcctcccgggcgggatttgcatgtgtgtggtggccccagacttcctgctccttctacgctgcaggtacgcgcgggccgggcggggcgggcgggcggcgggcgcgccaagacgtgggcacctcctcacccggaccccgggccccgccgagccgcctcctggctcccgtggccgccagcccgccccggccgcaccgagcgtcgggatccgaggtgggagcgtacccctccccgctccccggacgcctcagtcctccgcactgagcttggccacgcgcccctaggcgccccccacgccctgggccccggagggccgcagccatgagtgaaatgtccagctttcttcacatcggggacatcgtctccctgtacgccgagggctccgtcaatggcttcatcagcactttggggctggtggatgaccgctgtgtggtggagcccgcggccggggacctggacaacccccctaagaagttccgtgactgcctcttcaaggtgtgccccatgaaccgctactcggcccagaagcagtactggaaggccaagcagactaagcaggacaaggagaagatcgctgatgtggtgttgctgcagaagctgcagcatgcggcgcagatggagcagaagcaaaatgacacggagaacaagaaggtgcatggggatgtcgtgaagtatggcagtgtgatccagctcctgcacatgaagagcaacaagtacctgacagtgaacaagcggcttccggccttgctggagaagaacgccatgcgggtgactctggatgccacaggcaacgagggttcctggctcttcatccagcccttctggaagctgcggagcaacggggacaacgtggtcgtgggggacaaggtgatcctgaatcctgtcaatgccgggcagcctctgcatgccagcaattacgagctcagcgacaacgccggctgcaaggaggtcaattctgtgaactgcaacaccagctggaagatcaacctgtttatgcagtttcgggaccacctggaggaggtgttgaaagggggagacgtggtgcggctgttccatgcggagcaggagaagttcctgacgtgtgacgagtacaagggcaagctgcaggtgttcctgcgaactacactgcgccagtctgccacctcggccaccagctccaatgctctctgggaggtggaggtggtccaccacgacccctgccgtggaggagctgggcactggaatggcttgtaccgcttcaagcacctggctacaggcaactacctggctgctgaggagaaccccagttacaaaggtgatgcctcagatcccaaggcagcaggaatgggggcacagggccgcacaggccgcaggaatgctggggagaagatcaagtactgcctggtggctgtgcctcatggcaatgacatcgcctctctctttgagctggaccccaccaccttgcagaaaaccgactctttcgtgccccggaactcgtacgtccggctgcggcacctctgcaccaacacgtggattcagagcaccaatgtgcccattgacatcgaggaggagcggcccatccggctcatgctgggcacctgccccaccaaggaggacaaggaggcctttgccatcgtgtcagtgcccgtgtctgagatccgagacctggactttgccaatgacgccagctccatgctggccagtgccgtggagaaactcaacgagggcttcatcagccagaatgaccgcaggtttgtcatccagctgctggaagacctggtgttctttgtcagcgatgtccccaacaatgggcagaatgtcctggacatcatggtcactaagcccaaccgggaacggcagaagctgatgagggagcagaacatcctcaaacaggtctttggcattctgaaggccccgttccgtgagaaggggggtgaaggtcccctggtgcggctggaggagctgtcagaccagaagaacgccccctaccagcacatgttccgcctgtgctaccgcgtgttgcggcattcccaggaggactaccgcaagaaccaggagcacattgccaagcagtttgggatgatgcagtcccagattggctacgacatcctggccgaggacaccatcactgccctgctgcacaacaaccgcaagctcctggaaaagcacatcaccaagaccgaggtggagaccttcgtcagccttgtgcgcaagaaccgggagcccaggttcctggactacctctctgacctgtgtgtgtccaaccacatcgccatccccgtcacccaagagctcatctgcaagtgtgtgctggaccccaagaacagtgacattctcatccggaccgagcttcggcccgtgaaggagatggcccaatcccacgagtacctgagcatcgagtactcagaagaggaagtgtggctcacgtggactgacaagaataacgagcatcatgagaagagtgtgaggcagctggcccaggaggcgcgggccggcaacgcccacgacgagaatgtgctcagctactacaggtaccagctgaagctctttgcccgcatgtgcttggaccgccagtacttggccatcgacgagatctcccagcagctgggcgtggacctgattttcctgtgcatggcagacgagatgctgccctttgacctgcgcgcctccttctgccacctgatgctgcacgtgcacgtggaccgtgacccccaggagctggtcacgccggtcaagtttgcccgtctctggactgagatccccacagccatcaccatcaaggactatgattccaacctcaacgcgtcccgagatgacaagaagaacaagtttgccaacaccatggagttcgtggaggactacctcaacaatgtagtcagcgaggccgtgccctttgccaacgaggagaagaacaagctcacttttgaggtggtcagcctggcgcacaatctcatctacttcggcttctacagcttcagcgagctgctgcggctcactcgcacactgctgggcatcatcgactgtgtgcaggggcccccggccatgctgcaggcctatgaggaccccggtggcaagaatgtgcggcggtccatccagggcgtggggcacatgatgtccaccatggtgctgagccgcaagcagtccgtcttcagtgcccccagcctgtctgctggggccagtgctgctgagccgctggacagaagcaagtttgaggagaatgaggacattgtggtgatggagaccaagctgaagatcctggaaatccttcagttcatcctcaacgtccgcctggattaccgcatatcctacctgctgtctgtcttcaagaaggagtttgtggaggtgtttcccatgcaggacagtggggctgatggcacagcccctgccttcgactctaccactgccaacatgaacctggatcgcatcggggagcaggcggaggccatgtttggagtggggaagacaagcagcatgctggaggtggatgacgagggcggccgcatgttcctgcgcgtgctcatccacctcaccatgcacgactatgcgccnctggtctcgggtgccctgcagctgctcttcaagcacttcagccagcgccaggaggccatgcacaccttcaagcaggttcagctgctgatctcagcgcaggacgtggagaactacaaggtgatcaagtcggagctggaccggctgcggaccatggtggagaagtcagagctgtgggtggacaagaagggcagtggcaagggtgaggaggtggaggcaggcgccgccaaggacaagaaagagcgtcccacggacgaggagggctttctgcacccaccaggggagaaaagcagtgagaactaccagatcgtcaagggcatcctggaaaggctgaacaagatgtgcggggttggggagcaaatgaggaagaagcagcaacggctgctgaagaacatggatgcccacaaggtcatgctggacctgctgcagatcccctatgacaagggtgatgccaagatgatggagatcctgcgctacacgcaccagttcctgcagaagttctgtgcagggaaccccggcaaccaggccctgctgcacaaacacctgcacctcttcctcacgccagggctcctggaggcagagaccatgcagcacatcttcctgaacaactatcagctctgctccgagatcagcgagcctgtgttgcagcacttcgtgcacctgctggccacgcacgggcgccatgtgcagtacctggacttcctgcacaccgtcattaaggccgagggcaagtacgtcaagaagtgccaggacatgatcatgactgagctgaccaatgcaggtgacgatgtggtcgtgttctacaatgataaggcatcgctggcccacctgctggacatgatgaaggccgcccgcgacggcgtggaggaccacagccccctcatgtaccacatttccctggtggacctgctggccgcctgtgccgagggcaaaaacgtctacactgagatcaagtgcacctccctgctgccgctggaggacgtggtgtctgtggtgacgcatgaggactgcatcactgaggtgaaaatggcctatgtgaacttcgtgaaccactgctacgtggacacggaggtggagatgaaggagatctacaccagcaaccacatctggacgctctttgagaacttcaccctggacatggctcgggtctgcagcaagcgtgagaagcgcgtggctgaccccaccttggagaagtacgtgctgagcgttgtgctggacaccatcaacgccttcttcagctccccattctctgagaacagcacttccctgcagacacaccagacgattgtggtgcagctgctgcagtctaccacacgcctcctcgagtgtccgtggctacagcagcagcacaagggctccgtggaggcctgcatccggaccctcgccatggtggccaagggccgggccatcttgctgcccatggacctggatgcccacatcagctcgatgctcagcagtggagccagctgtgcagctgccgcccagcggaacgcctccagctacaaggcaaccacgcgggccttcccccgcgtcacccccaccgccaaccagtgggactacaagaacatcattgagaagctgcaggacatcatcacagccctggaggagcggctgaagcccctggtacaggctgagctgtccgtgctggtggatgtcctgcactggcctgagctgctcttcctggagggcagtgaggcctaccagcgctgcgagagtgggggcttcctgtccaagctgatccagcacaccaaggacctcatggagtcggaggagaagctgtgcatcaaggtgctgcggaccctgcagcagatgctgctcaagaagaccaagtacggggaccggggcaaccagctgcgcaagatgctgctgcaaaactacctccagaaccggaagtccacctcgcggggggaccttcccgaccccataggcactggcctggacccagactggtcggcaatcgcagccacccagtgccggctggacaaggagggggccaccaagttggtatgcgacctcatcaccagcaccaagaacgagaagatcttccaggagagcatcggcctggccatccacctgctggatggtggcaacacagagatccagaaatccttccacaacctgatgatgagtgacaagaagtcagagcgcttcttcaaggtgctgcacgaccgcatgaagcgggcccagcaggagaccaagtccacggtggcagtcaacatgaatgacctgggcagccagccacatgaggaccgcgagccagtcgaccccaccaccaaaggccgcgtggcctccttctcgatacctggctcctcatcccgctactcgctgggccccagcctgcgccgggggcacgaggtgagcgaacgtgtgcagagcagtgagatgggcacatccgtgctcatcatgcagcccatcctgcgctttctgcagctgctgtgtgagaaccacaaccgggacctgcagaacttcctgcgctgtcagaacaacaaaaccaactacaacttggtatgcgagacgctgcagttcctggacatcatgtgcggcagcaccacgggcggcctggggctgctggggctctacatcaatgaggacaacgtgggcctcgtcatccagaccttggagaccctcactgagtactgccagggcccctgccatgagaaccagacttgcattgtgactcacgagtccaatggcatagacatcatcaccgcactgatcctcaatgacatcagccccctgtgcaagtaccgcatggatctggtgctgcagctcaaggacaatgcctccaagctgctcctggctctgatggagagccggcatgacagtgaaaatgctgagcgaatcctcatcagcctgcggccccaggagctggtggacgtcatcaagaaggcctacctgcaggaggaagagcgtgagaactcggaggtgagcccacgtgaagtgggccataacatctatatcctggcgctgcagctctccaggcacaataaacagctgcagcacctgctgaagccggtgaagcgcattcaagaggaggaggccgagggtatctcttccatgctcagcctcaacaacaagcagctgtcacagatgctcaagtcctcagcgccagcacaggaggaggaggaagaccccctggcctactatgagaaccacacgtcccagatcgagattgtgcggcaggaccgcagcatggagcagatcgtgttcccagtgcccggcatctgccagttcctgacggaggaaaccaagcaccggctcttcaccactactgagcaggacgagcagggcagcaaagtgagcgacttcttcgaccagtcctccttcctgcacaacgagatggagtggcagcgcaagctccgcagcatgccgctgatctactggttctcccgccgcatgaccctgtggggcagcatctccttcaacctggccgtgtttatcaacatcatcattgccttcttctacccttacatggagggcgcgtccacaggcgtgctggactcccctctcatctcattgctcttctggatcctcatctgcttctccatcgcggccctgttcaccaagcgctacagcatccgccccctcatcgtggcgctcatcctgcgctccatctactatctgggcatcgggcccacactcaacatcctgggtgccctcaatctgaccaacaagatcgtgtttgtggtgagcttcgtgggcaaccgtggcaccttcatccggggctataaggccatggtcatggacatggaattcctctaccacgtgggctacatcctgaccagtgtcctgggcctctttgctcatgagctgttctacagcatcctgctctttgacctcatctaccgcgaggagacgctgttcaacgtcatcaagagtgtgacccgcaatggccgctccatcctgctgacagccctgctggccctcatcctggtctacctcttctccatcgtcggcttcctcttcctcaaggatgacttcattctcgaggtcgaccggctgcccaacaaccactccacagccagccccctggggatgccacatggagctgctgcatttgtggacacctgcagtggggacaagatggactgtgtctcagggctctcggtgcctgaggtcctggaagaggacagggagctggacagcacagagcgggcctgtgacactctgttgatgtgcatcgtcactgtcatgaaccatgggctacgcaacggtggtggcgtgggcgacattctccgcaagccctccaaagatgagtctctcttcccagcccgagtggtctatgacctcctgttcttcttcatcgtcatcatcattgtgctgaacctcatctttggggtaatcatcgacaccttcgctgacctgcgtagtgagaagcagaagaaggaggagattcttaagacgacatgcttcatctgtggtctggagagggacaagtttgataacaagacagtgtcatttgaggaacacatcaagctggagcacaacatgtggaactacttgtacttcattgtgctggtccgcgtgaagaacaagaccgactacacgggccctgagagctacgtggcccagatgatcaaggtgtgagcaggggctgtgccaggcctgtgggcccaaaccagccattctagagtcatcactgtgcaccagaggcctcatggttttagcttctgagtaccctgggccctggagaggagtggccctatctgactgttggccctaggaggccaggcagaggggctcggacagctgcagacacttgttgaaaggtcagcagggcgaggagcagcagctggaagcagctctgggctgcacggaagccgctgctgcagaggggcctcctcacacttctgggtgtcaggaaaaatcccacagcaaacccatgcgccccgaagaacacgtgtggtatccctgggcctgtcgtgcagtgatgctgaggaggggtggagttggggagaccctgcccgtggccagtgatctgtgggccgctctcagggagtgttttctagctcggtgggaaggcaggctgcttcctaaaaagtctgaattagatgatcctgggctgaaggggagcctggaaaaactttaaaaatcacttacagaaatcaaatgtcatctgtccaatttctgtaataatggagtgaaggcaatgaatcataaagaaggaattatttatcgtttagtctgtatttcaaactgatctttgtgtacaggtttatctgttggtctgagaattcacagcttactacaaggaagctgagaattgcttggtgccccctccccccccgactcctctgtcctgggaaacgtggctttgcctcccagacacgtgtcagatgccagctctcctcagcggagcctcccgatccctcaatttgccatctgtctgactcgcgtcttcccggggcgtggggcgtgcttgtcaggcaggcgggcgggaggaaggaaggaaggagatccagggtctgtctgggtgcagaggccttcctccacctctcagggggtgttatgagagtaaacagatggtgctgataccagcaaaggactcaaactcagctgccgacgctgcctaacggaagtcagcctgtctcggtggcagagggttgacaagagggttgactgccagctcactctggccccggggaggaccaggtcaattcagattttcccatgacacatccctgacgagtagttttgttaagggtgtggcagaagcctccccccacattactgtttttctaaatgaggcctttctaggccgggcccacgcctgcttaacccactggtgatgtttttcagaacaagaacctggactggttcccccggatgcgggccatgtcccttgtcagcaatgagggcgagggggagcagaatgagattcggattctccaggacaagctcaactccaccatgaagctggtgtcccacctcactgcccagctcaacgagctcaaggagcagatgacggagcagcggaaacgcaggcaacgcctaggctttgtggatgtccagaactgcattagccgctgaggagagccaccgaaggccccaacaggggatgctcatcactggagactgcgactgggaagaacactgccccctccctcgggttgggtggcccagccagctggccagcctccactcccactctgccagacaccctgacacccacccaggctttgaagagcatggagggggagcctcagagctgacagtcctgcttagagcccttaaaaagacttgaaagttcactgggactcagtttaccttaatgccttagcagaagataaatcctacctagagacctttgttccttaaagcaataactgacaactctttgtagtcctccttgtgggtagttaagagtggggtcacccctttaactccaagcactacattttggcggctgccggcctctgggggaggtggcagttatgctgttactagtgattttagggctttgttatttaacttatttcaagggtgctgtgctcagccctgcccatggctgtgcagctccctccgtgcctcagatctgctgtagccagtgcagacctcactgtcgtgtccatgccacccccggcatggctccaggtggcctggtgactccatgatggacgatcttgctcccaggacctgcctcttcccaggcttcctggggaagagttgtacgcccaggcaacaagggctgagctgcgcttgcgtggctgtttcatgaccgcttgtttttctccttttggtgtaatgttttacaaatcctttggcctgagaactaatatgttaattgccttaaataaattaatagaaatctagtccgttaaaaaaaaaa

SEQ ID NO: 313448 - DNA, 6339 bp, Homo sapiens
  misc_feature (731)..(731): n is a, c, g, or t
acagaaaattctcagtcatctccccacacagctcacctttgccctgacacctccttcttttcccagatttgcttaaagctcatgtcctccaggaagccttcctgggttagccctgtcccttccttagcaaggctttgccctgcagctgacataaacagattatgcatcctctgcctccctcatcagaccagggacccctgtgtacagcctctacaacctccttggcaacctcctctgcttccccctccacaggcaagaatgtgcggcggtccatccagggcgtggggcacatgatgtccaccatggtgctgagccgcaagcagtccgtcttcagtgcccccagcctgtctgctggggccagtgctgctgagccgctggacagaagcaagtttgaggagaatgaggacattgtggtgatggagaccaagctgaagatcctggaaatccttcagttcatcctcaacgtccgcctggattaccgcatatcctacctgctgtctgtcttcaagaaggagtttgtggaggtgtttcccatgcaggacagtggggctgatggcacagcccctgccttcgactctaccactgccaacatgaacctggatcgcatcggggagcaggcggaggccatgtttggagtggggaagacaagcagcatgctggaggtggatgacgagggcggccgcatgttcctgcgcgtgctcatccacctcaccatgcacgactatgcgccnctggtctcgggtgccctgcagctgctcttcaagcacttcagccagcgccaggaggccatgcacaccttcaagcaggttcagctgctgatctcagcgcaggacgtggagaactacaaggtgatcaagtcggagctggaccggctgcggaccatggtggagaagtcagagctgtgggtggacaagaagggcagtggcaagggtgaggaggtggaggcaggcgccgccaaggacaagaaagagcgtcccacggacgaggagggctttctgcacccaccaggggagaaaagcagtgagaactaccagatcgtcaagggcatcctggaaaggctgaacaagatgtgcggggttggggagcaaatgaggaagaagcagcaacggctgctgaagaacatggatgcccacaaggtcatgctggacctgctgcagatcccctatgacaagggtgatgccaagatgatggagatcctgcgctacacgcaccagttcctgcagaagttctgtgcagggaaccccggcaaccaggccctgctgcacaaacacctgcacctcttcctcacgccagggctcctggaggcagagaccatgcagcacatcttcctgaacaactatcagctctgctccgagatcagcgagcctgtgttgcagcacttcgtgcacctgctggccacgcacgggcgccatgtgcagtacctggacttcctgcacaccgtcattaaggccgagggcaagtacgtcaagaagtgccaggacatgatcatgactgagctgaccaatgcaggtgacgatgtggtcgtgttctacaatgataaggcatcgctggcccacctgctggacatgatgaaggccgcccgcgacggcgtggaggaccacagccccctcatgtaccacatttccctggtggacctgctggccgcctgtgccgagggcaaaaacgtctacactgagatcaagtgcacctccctgctgccgctggaggacgtggtgtctgtggtgacgcatgaggactgcatcactgaggtgaaaatggcctatgtgaacttcgtgaaccactgctacgtggacacggaggtggagatgaaggagatctacaccagcaaccacatctggacgctctttgagaacttcaccctggacatggctcgggtctgcagcaagcgtgagaagcgcgtggctgaccccaccttggagaagtacgtgctgagcgttgtgctggacaccatcaacgccttcttcagctccccattctctgagaacagcacttccctgcagacacaccagacgattgtggtgcagctgctgcagtctaccacacgcctcctcgagtgtccgtggctacagcagcagcacaagggctccgtggaggcctgcatccggaccctcgccatggtggccaagggccgggccatcttgctgcccatggacctggatgcccacatcagctcgatgctcagcagtggagccagctgtgcagctgccgcccagcggaacgcctccagctacaaggcaaccacgcgggccttcccccgcgtcacccccaccgccaaccagtgggactacaagaacatcattgagaagctgcaggacatcatcacagccctggaggagcggctgaagcccctggtacaggctgagctgtccgtgctggtggatgtcctgcactggcctgagctgctcttcctggagggcagtgaggcctaccagcgctgcgagagtgggggcttcctgtccaagctgatccagcacaccaaggacctcatggagtcggaggagaagctgtgcatcaaggtgctgcggaccctgcagcagatgctgctcaagaagaccaagtacggggaccggggcaaccagctgcgcaagatgctgctgcaaaactacctccagaaccggaagtccacctcgcggggggaccttcccgaccccataggcactggcctggacccagactggtcggcaatcgcagccacccagtgccggctggacaaggagggggccaccaagttggtatgcgacctcatcaccagcaccaagaacgagaagatcttccaggagagcatcggcctggccatccacctgctggatggtggcaacacagagatccagaaatccttccacaacctgatgatgagtgacaagaagtcagagcgcttcttcaaggtgctgcacgaccgcatgaagcgggcccagcaggagaccaagtccacggtggcagtcaacatgaatgacctgggcagccagccacatgaggaccgcgagccagtcgaccccaccaccaaaggccgcgtggcctccttctcgatacctggctcctcatcccgctactcgctgggccccagcctgcgccgggggcacgaggtgagcgaacgtgtgcagagcagtgagatgggcacatccgtgctcatcatgcagcccatcctgcgctttctgcagctgctgtgtgagaaccacaaccgggacctgcagaacttcctgcgctgtcagaacaacaaaaccaactacaacttggtatgcgagacgctgcagttcctggacatcatgtgcggcagcaccacgggcggcctggggctgctggggctctacatcaatgaggacaacgtgggcctcgtcatccagaccttggagaccctcactgagtactgccagggcccctgccatgagaaccagacttgcattgtgactcacgagtccaatggcatagacatcatcaccgcactgatcctcaatgacatcagccccctgtgcaagtaccgcatggatctggtgctgcagctcaaggacaatgcctccaagctgctcctggctctgatggagagccggcatgacagtgaaaatgctgagcgaatcctcatcagcctgcggccccaggagctggtggacgtcatcaagaaggcctacctgcaggaggaagagcgtgagaactcggaggtgagcccacgtgaagtgggccataacatctatatcctggcgctgcagctctccaggcacaataaacagctgcagcacctgctgaagccggtgaagcgcattcaagaggaggaggccgagggtatctcttccatgctcagcctcaacaacaagcagctgtcacagatgctcaagtcctcagcgccagcacaggaggaggaggaagaccccctggcctactatgagaaccacacgtcccagatcgagattgtgcggcaggaccgcagcatggagcagatcgtgttcccagtgcccggcatctgccagttcctgacggaggaaaccaagcaccggctcttcaccactactgagcaggacgagcagggcagcaaagtgagcgacttcttcgaccagtcctccttcctgcacaacgagatggagtggcagcgcaagctccgcagcatgccgctgatctactggttctcccgccgcatgaccctgtggggcagcatctccttcaacctggccgtgtttatcaacatcatcattgccttcttctacccttacatggagggcgcgtccacaggcgtgctggactcccctctcatctcattgctcttctggatcctcatctgcttctccatcgcggccctgttcaccaagcgctacagcatccgccccctcatcgtggcgctcatcctgcgctccatctactatctgggcatcgggcccacactcaacatcctgggtgccctcaatctgaccaacaagatcgtgtttgtggtgagcttcgtgggcaaccgtggcaccttcatccggggctataaggccatggtcatggacatggaattcctctaccacgtgggctacatcctgaccagtgtcctgggcctctttgctcatgagctgttctacagcatcctgctctttgacctcatctaccgcgaggagacgctgttcaacgtcatcaagagtgtgacccgcaatggccgctccatcctgctgacagccctgctggccctcatcctggtctacctcttctccatcgtcggcttcctcttcctcaaggatgacttcattctcgaggtcgaccggctgcccaacaaccactccacagccagccccctggggatgccacatggagctgctgcatttgtggacacctgcagtggggacaagatggactgtgtctcagggctctcggtgcctgaggtcctggaagaggacagggagctggacagcacagagcgggcctgtgacactctgttgatgtgcatcgtcactgtcatgaaccatgggctacgcaacggtggtggcgtgggcgacattctccgcaagccctccaaagatgagtctctcttcccagcccgagtggtctatgacctcctgttcttcttcatcgtcatcatcattgtgctgaacctcatctttggggtaatcatcgacaccttcgctgacctgcgtagtgagaagcagaagaaggaggagattcttaagacgacatgcttcatctgtggtctggagagggacaagtttgataacaagacagtgtcatttgaggaacacatcaagctggagcacaacatgtggaactacttgtacttcattgtgctggtccgcgtgaagaacaagaccgactacacgggccctgagagctacgtggcccagatgatcaagaacaagaacctggactggttcccccggatgcgggccatgtcccttgtcagcaatgagggcgagggggagcagaatgagattcggattctccaggacaagctcaactccaccatgaagctggtgtcccacctcactgcccagctcaacgagctcaaggagcagatgacggagcagcggaaacgcaggcaacgcctaggctttgtggatgtccagaactgcattagccgctgaggagagccaccgaaggccccaacaggggatgctcatcactggagactgcgactgggaagaacactgccccctccctcgggttgggtggcccagccagctggccagcctccactcccactctgccagacaccctgacacccacccaggctttgaagagcatggagggggagcctcagagctgacagtcctgcttagagcccttaaaaagacttgaaagttcactgggactcagtttaccttaatgccttagcagaagataaatcctacctagagacctttgttccttaaagcaataactgacaactctttgtagtcctccttgtgggtagttaagagtggggtcacccctttaactccaagcactacattttggcggctgccggcctctgggggaggtggcagttatgctgttactagtgattttagggctttgttatttaacttatttcaagggtgctgtgctcagccctgcccatggctgtgcagctccctccgtgcctcagatctgctgtagccagtgcagacctcactgtcgtgtccatgccacccccggcatggctccaggtggcctggtgactccatgatggacgatcttgctcccaggacctgcctcttcccaggcttcctggggaagagttgtacgcccaggcaacaagggctgagctgcgcttgcgtggctgtttcatgaccgcttgtttttctccttttggtgtaatgttttacaaatcctttggcctgagaactaatatgttaattgccttaaataaattaatagaaatctagtccgttaaaaaaaaaa

SEQ ID NO: 313449 - DNA, 2487 bp, Homo sapiens
agccccgggtgaatcggccgaggatgagaacacacgtccagatcgagattgtgcggcaggaccgcagcatggagcagatcgtgttcccagtgcccggcatctgccagttcctgacggaggaaaccaagcaccggctcttcaccactactgagcaggacgagcagggcagcaaagtgagcgacttcttcgaccagtcctccttcctgcacaacgagatggagtggcagcgcaagctccgcagcatgccgctgatctactggttctcccgccgcatgaccctgtggggcagcatctccttcaacctggccgtgtttatcaacatcatcattgccttcttctacccttacatggagggcgcgtccacaggcgtgctggactcccctctcatctcattgctcttctggatcctcatctgcttctccatcgcggccctgttcaccaagcgctacagcatccgccccctcatcgtggcgctcatcctgcgctccatctactatctgggcatcgggcccacactcaacatcctgggtgccctcaatctgaccaacaagatcgtgtttgtggtgagcttcgtgggcaaccgtggcaccttcatccggggctataaggccatggtcatggacatggaattcctctaccacgtgggctacatcctgaccagtgtcctgggcctctttgctcatgagctgttctacagcatcctgctctttgacctcatctaccgcgaggagacgctgttcaacgtcatcaagagtgtgacccgcaatggccgctccatcctgctgacagccctgctggccctcatcctggtctacctcttctccatcgtcggcttcctcttcctcaaggatgacttcattctcgaggtcgaccggctgcccaacaaccactccacagccagccccctggggatgccacatggagctgctgcatttgtggacacctgcagtggggacaagatggactgtgtctcagggctctcggtgcctgaggtcctggaagaggacagggagctggacagcacagagcgggcctgtgacactctgttgatgtgcatcgtcactgtcatgaaccatgggctacgcaacggtggtggcgtgggcgacattctccgcaagccctccaaagatgagtctctcttcccagcccgagtggtctatgacctcctgttcttcttcatcgtcatcatcattgtgctgaacctcatctttggggtaatcatcgacaccttcgctgacctgcgtagtgagaagcagaagaaggaggagattcttaagacgacatgcttcatctgtggtctggagagggacaagtttgataacaagacagtgtcatttgaggaacacatcaagctggagcacaacatgtggaactacttgtacttcattgtgctggtccgcgtgaagaacaagaccgactacacgggccctgagagctacgtggcccagatgatcaagaacaagaacctggactggttcccccggatgcgggccatgtcccttgtcagcaatgagggcgagggggagcagaatgagattcggattctccaggacaagctcaactccaccatgaagctggtgtcccacctcactgcccagctcaacgagctcaaggagcagatgacggagcagcggaaacgcaggcaacgcctaggctttgtggatgtccagaactgcattagccgctgaggagagccaccgaaggccccaacaggggatgctcatcactggagactgcgactgggaagaacactgccccctccctcgggttgggtggcccagccagctggccagcctccactcccactctgccagacaccctgacacccacccaggctttgaagagcatggagggggagcctcagagctgacagtcctgcttagagcccttaaaaagacttgaaagttcactgggactcagtttaccttaatgccttagcagaagataaatcctacctagagacctttgttccttaaagcaataactgacaactctttgtagtcctccttgtgggtagttaagagtggggtcacccctttaactccaagcactacattttggcggctgccggcctctgggggaggtggcagttatgctgttactagtgattttagggctttgttatttaacttatttcaagggtgctgtgctcagccctgcccatggctgtgcagctccctccgtgcctcagatctgctgtagccagtgcagacctcactgtcgtgtccatgccacccccggcatggctccaggtggcctggtgactccatgatggacgatcttgctcccaggacctgcctcttcccaggcttcctggggaagagttgtacgcccaggcaacaagggctgagctgcgcttgcgtggctgtttcatgaccgcttgtttttctccttttggtgtaatgttttacaaatcctttggcctgagaactaatatgttaattgccttaaataaattaatagaaatctagtccgttaaaaaaaaaa

SEQ ID NO: 313450 - DNA, 9264 bp, Homo sapiens
  misc_feature (4486)..(4486): n is a, c, g, or t
ttatttatttatttatttatttttttgtctatttgttgtgtaggggctatttcttgggctaatgcaagggcagggaccgaacccgcaacctcatggttcctagtcggattcgttaaccactgcgccacgacaggaactcccctgtgtctgacagttttaaagaaagcttttaagtggtgactcgacatcccgaggtgttgcggtcctattatcgcaatgggcactctatcttaggcgttcaaataaaggactaggaagcaaacacccaagcaccggggaacagaacagaaagaaagacggaaggagccaagagttttggagccaactcctggagagggagcggctgaactgattcggaagttggatctctttgtacacaggaatgcggagagaaaaaaaacaaaacccaccccattgcttcatttcccctccaagcctgagcactttctattgtgcaatgaaaaggcttttcacgttgagaaaaatgaatcccgaatttgctctgcaaagggatgagcgcgcctctgggcgccagcctgctctcagctgggcgcggagaccgcgcggtggccgcagggcggccgcggccagggcgctccagggcgcgccctccgcgagcggctccggggtgacgcccgccggagagctggactcccccttccgcgggcgcctgcactggctcttagccagccgagggcccgggtgcagatagtccgggaaccccgagggcggagagctccccactacgcctgggcctcccagggatggcagctccgagagccccctagacccggtgccttgcaggacgcctctggagatcaggagggctggcggcgcattcggcgtccgggaggccgggccccggacgcgcgaggagcgcggggcgcgggaaggcaggcgggtgcacatgggtgccggcgggcgagctgcggggggagggggggcggggtgtggcctccccgcctcccgggcgggatttgcatgtgtgtggtggccccagacttcctgctccttctacgctgcaggtacgcgcgggccgggcggggcgggcgggcggcgggcgcgccaagacgtgggcacctcctcacccggaccccgggccccgccgagccgcctcctggctcccgtggccgccagcccgccccggccgcaccgagcgtcgggatccgaggtgggagcgtacccctccccgctccccggacgcctcagtcctccgcactgagcttggccacgcgcccctaggcgccccccacgccctgggccccggagggccgcagccatgagtgaaatgtccagctttcttcacatcggggacatcgtctccctgtacgccgagggctccgtcaatggcttcatcagcactttggggctggtggatgaccgctgtgtggtggagcccgcggccggggacctggacaacccccctaagaagttccgtgactgcctcttcaaggtgtgccccatgaaccgctactcggcccagaagcagtactggaaggccaagcagactaagcaggacaaggagaagatcgctgatgtggtgttgctgcagaagctgcagcatgcggcgcagatggagcagaagcaaaatgacacggagaacaagaaggtgcatggggatgtcgtgaagtatggcagtgtgatccagctcctgcacatgaagagcaacaagtacctgacagtgaacaagcggcttccggccttgctggagaagaacgccatgcgggtgactctggatgccacaggcaacgagggttcctggctcttcatccagcccttctggaagctgcggagcaacggggacaacgtggtcgtgggggacaaggtgatcctgaatcctgtcaatgccgggcagcctctgcatgccagcaattacgagctcagcgacaacgccggctgcaaggaggtcaattctgtgaactgcaacaccagctggaagatcaacctgtttatgcagtttcgggaccacctggaggaggtgttgaaagggggagacgtggtgcggctgttccatgcggagcaggagaagttcctgacgtgtgacgagtacaagggcaagctgcaggtgttcctgcgaactacactgcgccagtctgccacctcggccaccagctccaatgctctctgggaggtggaggtggtccaccacgacccctgccgtggaggagctgggcactggaatggcttgtaccgcttcaagcacctggctacaggcaactacctggctgctgaggagaaccccagttacaaaggtgatgcctcagatcccaaggcagcaggaatgggggcacagggccgcacaggccgcaggaatgctggggagaagatcaagtactgcctggtggctgtgcctcatggcaatgacatcgcctctctctttgagctggaccccaccaccttgcagaaaaccgactctttcgtgccccggaactcgtacgtccggctgcggcacctctgcaccaacacgtggattcagagcaccaatgtgcccattgacatcgaggaggagcggcccatccggctcatgctgggcacctgccccaccaaggaggacaaggaggcctttgccatcgtgtcagtgcccgtgtctgagatccgagacctggactttgccaatgacgccagctccatgctggccagtgccgtggagaaactcaacgagggcttcatcagccagaatgaccgcaggtttgtcatccagctgctggaagacctggtgttctttgtcagcgatgtccccaacaatgggcagaatgtcctggacatcatggtcactaagcccaaccgggaacggcagaagctgatgagggagcagaacatcctcaaacaggtctttggcattctgaaggccccgttccgtgagaaggggggtgaaggtcccctggtgcggctggaggagctgtcagaccagaagaacgccccctaccagcacatgttccgcctgtgctaccgcgtgttgcggcattcccaggaggactaccgcaagaaccaggagcacattgccaagcagtttgggatgatgcagtcccagattggctacgacatcctggccgaggacaccatcactgccctgctgcacaacaaccgcaagctcctggaaaagcacatcaccaagaccgaggtggagaccttcgtcagccttgtgcgcaagaaccgggagcccaggttcctggactacctctctgacctgtgtgtgtccaaccacatcgccatccccgtcacccaagagctcatctgcaagtgtgtgctggaccccaagaacagtgacattctcatccggaccgagcttcggcccgtgaaggagatggcccaatcccacgagtacctgagcatcgagtactcagaagaggaagtgtggctcacgtggactgacaagaataacgagcatcatgagaagagtgtgaggcagctggcccaggaggcgcgggccggcaacgcccacgacgagaatgtgctcagctactacaggtaccagctgaagctctttgcccgcatgtgcttggaccgccagtacttggccatcgacgagatctcccagcagctgggcgtggacctgattttcctgtgcatggcagacgagatgctgccctttgacctgcgcgcctccttctgccacctgatgctgcacgtgcacgtggaccgtgacccccaggagctggtcacgccggtcaagtttgcccgtctctggactgagatccccacagccatcaccatcaaggactatgattccaacctcaacgcgtcccgagatgacaagaagaacaagtttgccaacaccatggagttcgtggaggactacctcaacaatgtagtcagcgaggccgtgccctttgccaacgaggagaagaacaagctcacttttgaggtggtcagcctggcgcacaatctcatctacttcggcttctacagcttcagcgagctgctgcggctcactcgcacactgctgggcatcatcgactgtgtgcaggggcccccggccatgctgcaggcctatgaggaccccggtggcaagaatgtgcggcggtccatccagggcgtggggcacatgatgtccaccatggtgctgagccgcaagcagtccgtcttcagtgcccccagcctgtctgctggggccagtgctgctgagccgctggacagaagcaagtttgaggagaatgaggacattgtggtgatggagaccaagctgaagatcctggaaatccttcagttcatcctcaacgtccgcctggattaccgcatatcctacctgctgtctgtcttcaagaaggagtttgtggaggtgtttcccatgcaggacagtggggctgatggcacagcccctgccttcgactctaccactgccaacatgaacctggatcgcatcggggagcaggcggaggccatgtttggagtggggaagacaagcagcatgctggaggtggatgacgagggcggccgcatgttcctgcgcgtgctcatccacctcaccatgcacgactatgcgccnctggtctcgggtgccctgcagctgctcttcaagcacttcagccagcgccaggaggccatgcacaccttcaagcaggttcagctgctgatctcagcgcaggacgtggagaactacaaggtgatcaagtcggagctggaccggctgcggaccatggtggagaagtcagagctgtgggtggacaagaagggcagtggcaagggtgaggaggtggaggcaggcgccgccaaggacaagaaagagcgtcccacggacgaggagggctttctgcacccaccaggggagaaaagcagtgagaactaccagatcgtcaagggcatcctggaaaggctgaacaagatgtgcggggttggggagcaaatgaggaagaagcagcaacggctgctgaagaacatggatgcccacaaggtcatgctggacctgctgcagatcccctatgacaagggtgatgccaagatgatggagatcctgcgctacacgcaccagttcctgcagaagttctgtgcagggaaccccggcaaccaggccctgctgcacaaacacctgcacctcttcctcacgccagggctcctggaggcagagaccatgcagcacatcttcctgaacaactatcagctctgctccgagatcagcgagcctgtgttgcagcacttcgtgcacctgctggccacgcacgggcgccatgtgcagtacctggacttcctgcacaccgtcattaaggccgagggcaagtacgtcaagaagtgccaggacatgatcatgactgagctgaccaatgcaggtgacgatgtggtcgtgttctacaatgataaggcatcgctggcccacctgctggacatgatgaaggccgcccgcgacggcgtggaggaccacagccccctcatgtaccacatttccctggtggacctgctggccgcctgtgccgagggcaaaaacgtctacactgagatcaagtgcacctccctgctgccgctggaggacgtggtgtctgtggtgacgcatgaggactgcatcactgaggtgaaaatggcctatgtgaacttcgtgaaccactgctacgtggacacggaggtggagatgaaggagatctacaccagcaaccacatctggacgctctttgagaacttcaccctggacatggctcgggtctgcagcaagcgtgagaagcgcgtggctgaccccaccttggagaagtacgtgctgagcgttgtgctggacaccatcaacgccttcttcagctccccattctctgagaacagcacttccctgcagacacaccagacgattgtggtgcagctgctgcagtctaccacacgcctcctcgagtgtccgtggctacagcagcagcacaagggctccgtggaggcctgcatccggaccctcgccatggtggccaagggccgggccatcttgctgcccatggacctggatgcccacatcagctcgatgctcagcagtggagccagctgtgcagctgccgcccagcggaacgcctccagctacaaggcaaccacgcgggccttcccccgcgtcacccccaccgccaaccagtgggactacaagaacatcattgagaagctgcaggacatcatcacagccctggaggagcggctgaagcccctggtacaggctgagctgtccgtgctggtggatgtcctgcactggcctgagctgctcttcctggagggcagtgaggcctaccagcgctgcgagagtgggggcttcctgtccaagctgatccagcacaccaaggacctcatggagtcggaggagaagctgtgcatcaaggtgctgcggaccctgcagcagatgctgctcaagaagaccaagtacggggaccggggcaaccagctgcgcaagatgctgctgcaaaactacctccagaaccggaagtccacctcgcggggggaccttcccgaccccataggcactggcctggacccagactggtcggcaatcgcagccacccagtgccggctggacaaggagggggccaccaagttggtatgcgacctcatcaccagcaccaagaacgagaagatcttccaggagagcatcggcctggccatccacctgctggatggtggcaacacagagatccagaaatccttccacaacctgatgatgagtgacaagaagtcagagcgcttcttcaaggtgctgcacgaccgcatgaagcgggcccagcaggagaccaagtccacggtggcagtcaacatgaatgacctgggcagccagccacatgaggaccgcgagccagtcgaccccaccaccaaaggccgcgtggcctccttctcgatacctggctcctcatcccgctactcgctgggccccagcctgcgccgggggcacgaggtgagcgaacgtgtgcagagcagtgagatgggcacatccgtgctcatcatgcagcccatcctgcgctttctgcagctgctgtgtgagaaccacaaccgggacctgcagaacttcctgcgctgtcagaacaacaaaaccaactacaacttggtatgcgagacgctgcagttcctggacatcatgtgcggcagcaccacgggcggcctggggctgctggggctctacatcaatgaggacaacgtgggcctcgtcatccagaccttggagaccctcactgagtactgccagggcccctgccatgagaaccagacttgcattgtgactcacgagtccaatggcatagacatcatcaccgcactgatcctcaatgacatcagccccctgtgcaagtaccgcatggatctggtgctgcagctcaaggacaatgcctccaagctgctcctggctctgatggagagccggcatgacagtgaaaatgctgagcgaatcctcatcagcctgcggccccaggagctggtggacgtcatcaagaaggcctacctgcaggaggaagagcgtgagaactcggaggtgagcccacgtgaagtgggccataacatctatatcctggcgctgcagctctccaggcacaataaacagctgcagcacctgctgaagccggtgaagcgcattcaagaggaggaggccgagggtatctcttccatgctcagcctcaacaacaagcagctgtcacagatgctcaagtcctcagcgccagcacaggaggaggaggaagaccccctggcctactatgagaaccacacgtcccagatcgagattgtgcggcaggaccgcagcatggagcagatcgtgttcccagtgcccggcatctgccagttcctgacggaggaaaccaagcaccggctcttcaccactactgagcaggacgagcagggcagcaaagtgagcgacttcttcgaccagtcctccttcctgcacaacgagatggagtggcagcgcaagctccgcagcatgccgctgatctactggttctcccgccgcatgaccctgtggggcagcatctccttcaacctggccgtgtttatcaacatcatcattgccttcttctacccttacatggagggcgcgtccacaggcgtgctggactcccctctcatctcattgctcttctggatcctcatctgcttctccatcgcggccctgttcaccaagcgctacagcatccgccccctcatcgtggcgctcatcctgcgctccatctactatctgggcatcgggcccacactcaacatcctgggtgccctcaatctgaccaacaagatcgtgtttgtggtgagcttcgtgggcaaccgtggcaccttcatccggggctataaggccatggtcatggacatggaattcctctaccacgtgggctacatcctgaccagtgtcctgggcctctttgctcatgagctgttctacagcatcctgctctttgacctcatctaccgcgaggagacgctgttcaacgtcatcaagagtgtgacccgcaatggccgctccatcctgctgacagccctgctggccctcatcctggtctacctcttctccatcgtcggcttcctcttcctcaaggatgacttcattctcgaggtcgaccggctgcccaacaaccactccacagccagccccctggggatgccacatggagctgctgcatttgtggacacctgcagtggggacaagatggactgtgtctcagggctctcggtgcctgaggtcctggaagaggacagggagctggacagcacagagcgggcctgtgacactctgttgatgtgcatcgtcactgtcatgaaccatgggctacgcaacggtggtggcgtgggcgacattctccgcaagccctccaaagatgagtctctcttcccagcccgagtggtctatgacctcctgttcttcttcatcgtcatcatcattgtgctgaacctcatctttggggtaatcatcgacaccttcgctgacctgcgtagtgagaagcagaagaaggaggagattcttaagacgacatgcttcatctgtggtctggagagggacaagtttgataacaagacagtgtcatttgaggaacacatcaagctggagcacaacatgtggaactacttgtacttcattgtgctggtccgcgtgaagaacaagaccgactacacgggccctgagagctacgtggcccagatgatcaagaacaagaacctggactggttcccccggatgcgggccatgtcccttgtcagcaatgagggcgagggggagcagaatgagattcggattctccaggacaagctaaagcctagcgttgcctggtttccgctgctccgtcatctgctccttgagctcgttgagctgggcaccgaggtgggacaccagcttcatggtggaggtgc

SEQ ID NO: 313451 - DNA, 1399 bp, Homo sapiens
gagggctgcagctgcggcagggcaggatctccactaagtggctgctgctttaaatagaagtgacccaaatagcccagagcgagctgttggaagcgctcatcccgagaacaaatgcctccaacccccggaagctgggtcccctccagcaggtgaccctgcagtggctcttgaaggctgatggtttcattcccgccctctgcaccctcaggtctggagagggacaagtttgataacaagacagtgtcatttgaggaacacatcaagctggagcacaacatgtggaactacttgtacttcattgtgctggtccgcgtgaagaacaagaccgactacacgggccctgagagctacgtggcccagatgatcaagaacaagaacctggactggttcccccggatgcgggccatgtcccttgtcagcaatgagggcgagggggagcagaatgagattcggattctccaggacaagctcaactccaccatgaagctggtgtcccacctcactgcccagctcaacgagctcaaggagcagatgacggagcagcggaaacgcaggcaacgcctaggctttgtggatgtccagaactgcattagccgctgaggagagccaccgaaggccccaacaggggatgctcatcactggagactgcgactgggaagaacactgccccctccctcgggttgggtggcccagccagctggccagcctccactcccactctgccagacaccctgacacccacccaggctttgaagagcatggagggggagcctcagagctgacagtcctgcttagagcccttaaaaagacttgaaagttcactgggactcagtttaccttaatgccttagcagaagataaatcctacctagagacctttgttccttaaagcaataactgacaactctttgtagtcctccttgtgggtagttaagagtggggtcacccctttaactccaagcactacattttggcggctgccggcctctgggggaggtggcagttatgctgttactagtgattttagggctttgttatttaacttatttcaagggtgctgtgctcagccctgcccatggctgtgcagctccctccgtgcctcagatctgctgtagccagtgcagacctcactgtcgtgtccatgccacccccggcatggctccaggtggcctggtgactccatgatggacgatcttgctcccaggacctgcctcttcccaggcttcctggggaagagttgtacgcccaggcaacaagggctgagctgcgcttgcgtggctgtttcatgaccgcttgtttttctccttttggtgtaatgttttacaaatcctttggcctgagaactaatatgttaattgccttaaataaattaatagaaatctagtccgttaaaaaaaaaa

SEQ ID NO: 313452 - DNA, 8210 bp, Homo sapiens
  misc_feature (4486)..(4486): n is a, c, g, or t
ttatttatttatttatttatttttttgtctatttgttgtgtaggggctatttcttgggctaatgcaagggcagggaccgaacccgcaacctcatggttcctagtcggattcgttaaccactgcgccacgacaggaactcccctgtgtctgacagttttaaagaaagcttttaagtggtgactcgacatcccgaggtgttgcggtcctattatcgcaatgggcactctatcttaggcgttcaaataaaggactaggaagcaaacacccaagcaccggggaacagaacagaaagaaagacggaaggagccaagagttttggagccaactcctggagagggagcggctgaactgattcggaagttggatctctttgtacacaggaatgcggagagaaaaaaaacaaaacccaccccattgcttcatttcccctccaagcctgagcactttctattgtgcaatgaaaaggcttttcacgttgagaaaaatgaatcccgaatttgctctgcaaagggatgagcgcgcctctgggcgccagcctgctctcagctgggcgcggagaccgcgcggtggccgcagggcggccgcggccagggcgctccagggcgcgccctccgcgagcggctccggggtgacgcccgccggagagctggactcccccttccgcgggcgcctgcactggctcttagccagccgagggcccgggtgcagatagtccgggaaccccgagggcggagagctccccactacgcctgggcctcccagggatggcagctccgagagccccctagacccggtgccttgcaggacgcctctggagatcaggagggctggcggcgcattcggcgtccgggaggccgggccccggacgcgcgaggagcgcggggcgcgggaaggcaggcgggtgcacatgggtgccggcgggcgagctgcggggggagggggggcggggtgtggcctccccgcctcccgggcgggatttgcatgtgtgtggtggccccagacttcctgctccttctacgctgcaggtacgcgcgggccgggcggggcgggcgggcggcgggcgcgccaagacgtgggcacctcctcacccggaccccgggccccgccgagccgcctcctggctcccgtggccgccagcccgccccggccgcaccgagcgtcgggatccgaggtgggagcgtacccctccccgctccccggacgcctcagtcctccgcactgagcttggccacgcgcccctaggcgccccccacgccctgggccccggagggccgcagccatgagtgaaatgtccagctttcttcacatcggggacatcgtctccctgtacgccgagggctccgtcaatggcttcatcagcactttggggctggtggatgaccgctgtgtggtggagcccgcggccggggacctggacaacccccctaagaagttccgtgactgcctcttcaaggtgtgccccatgaaccgctactcggcccagaagcagtactggaaggccaagcagactaagcaggacaaggagaagatcgctgatgtggtgttgctgcagaagctgcagcatgcggcgcagatggagcagaagcaaaatgacacggagaacaagaaggtgcatggggatgtcgtgaagtatggcagtgtgatccagctcctgcacatgaagagcaacaagtacctgacagtgaacaagcggcttccggccttgctggagaagaacgccatgcgggtgactctggatgccacaggcaacgagggttcctggctcttcatccagcccttctggaagctgcggagcaacggggacaacgtggtcgtgggggacaaggtgatcctgaatcctgtcaatgccgggcagcctctgcatgccagcaattacgagctcagcgacaacgccggctgcaaggaggtcaattctgtgaactgcaacaccagctggaagatcaacctgtttatgcagtttcgggaccacctggaggaggtgttgaaagggggagacgtggtgcggctgttccatgcggagcaggagaagttcctgacgtgtgacgagtacaagggcaagctgcaggtgttcctgcgaactacactgcgccagtctgccacctcggccaccagctccaatgctctctgggaggtggaggtggtccaccacgacccctgccgtggaggagctgggcactggaatggcttgtaccgcttcaagcacctggctacaggcaactacctggctgctgaggagaaccccagttacaaaggtgatgcctcagatcccaaggcagcaggaatgggggcacagggccgcacaggccgcaggaatgctggggagaagatcaagtactgcctggtggctgtgcctcatggcaatgacatcgcctctctctttgagctggaccccaccaccttgcagaaaaccgactctttcgtgccccggaactcgtacgtccggctgcggcacctctgcaccaacacgtggattcagagcaccaatgtgcccattgacatcgaggaggagcggcccatccggctcatgctgggcacctgccccaccaaggaggacaaggaggcctttgccatcgtgtcagtgcccgtgtctgagatccgagacctggactttgccaatgacgccagctccatgctggccagtgccgtggagaaactcaacgagggcttcatcagccagaatgaccgcaggtttgtcatccagctgctggaagacctggtgttctttgtcagcgatgtccccaacaatgggcagaatgtcctggacatcatggtcactaagcccaaccgggaacggcagaagctgatgagggagcagaacatcctcaaacaggtctttggcattctgaaggccccgttccgtgagaaggggggtgaaggtcccctggtgcggctggaggagctgtcagaccagaagaacgccccctaccagcacatgttccgcctgtgctaccgcgtgttgcggcattcccaggaggactaccgcaagaaccaggagcacattgccaagcagtttgggatgatgcagtcccagattggctacgacatcctggccgaggacaccatcactgccctgctgcacaacaaccgcaagctcctggaaaagcacatcaccaagaccgaggtggagaccttcgtcagccttgtgcgcaagaaccgggagcccaggttcctggactacctctctgacctgtgtgtgtccaaccacatcgccatccccgtcacccaagagctcatctgcaagtgtgtgctggaccccaagaacagtgacattctcatccggaccgagcttcggcccgtgaaggagatggcccaatcccacgagtacctgagcatcgagtactcagaagaggaagtgtggctcacgtggactgacaagaataacgagcatcatgagaagagtgtgaggcagctggcccaggaggcgcgggccggcaacgcccacgacgagaatgtgctcagctactacaggtaccagctgaagctctttgcccgcatgtgcttggaccgccagtacttggccatcgacgagatctcccagcagctgggcgtggacctgattttcctgtgcatggcagacgagatgctgccctttgacctgcgcgcctccttctgccacctgatgctgcacgtgcacgtggaccgtgacccccaggagctggtcacgccggtcaagtttgcccgtctctggactgagatccccacagccatcaccatcaaggactatgattccaacctcaacgcgtcccgagatgacaagaagaacaagtttgccaacaccatggagttcgtggaggactacctcaacaatgtagtcagcgaggccgtgccctttgccaacgaggagaagaacaagctcacttttgaggtggtcagcctggcgcacaatctcatctacttcggcttctacagcttcagcgagctgctgcggctcactcgcacactgctgggcatcatcgactgtgtgcaggggcccccggccatgctgcaggcctatgaggaccccggtggcaagaatgtgcggcggtccatccagggcgtggggcacatgatgtccaccatggtgctgagccgcaagcagtccgtcttcagtgcccccagcctgtctgctggggccagtgctgctgagccgctggacagaagcaagtttgaggagaatgaggacattgtggtgatggagaccaagctgaagatcctggaaatccttcagttcatcctcaacgtccgcctggattaccgcatatcctacctgctgtctgtcttcaagaaggagtttgtggaggtgtttcccatgcaggacagtggggctgatggcacagcccctgccttcgactctaccactgccaacatgaacctggatcgcatcggggagcaggcggaggccatgtttggagtggggaagacaagcagcatgctggaggtggatgacgagggcggccgcatgttcctgcgcgtgctcatccacctcaccatgcacgactatgcgccnctggtctcgggtgccctgcagctgctcttcaagcacttcagccagcgccaggaggccatgcacaccttcaagcaggttcagctgctgatctcagcgcaggacgtggagaactacaaggtgatcaagtcggagctggaccggctgcggaccatggtggagaagtcagagctgtgggtggacaagaagggcagtggcaagggtgaggaggtggaggcaggcgccgccaaggacaagaaagagcgtcccacggacgaggagggctttctgcacccaccaggggagaaaagcagtgagaactaccagatcgtcaagggcatcctggaaaggctgaacaagatgtgcggggttggggagcaaatgaggaagaagcagcaacggctgctgaagaacatggatgcccacaaggtcatgctggacctgctgcagatcccctatgacaagggtgatgccaagatgatggagatcctgcgctacacgcaccagttcctgcagaagttctgtgcagggaaccccggcaaccaggccctgctgcacaaacacctgcacctcttcctcacgccagggctcctggaggcagagaccatgcagcacatcttcctgaacaactatcagctctgctccgagatcagcgagcctgtgttgcagcacttcgtgcacctgctggccacgcacgggcgccatgtgcagtacctggacttcctgcacaccgtcattaaggccgagggcaagtacgtcaagaagtgccaggacatgatcatgactgagctgaccaatgcaggtgacgatgtggtcgtgttctacaatgataaggcatcgctggcccacctgctggacatgatgaaggccgcccgcgacggcgtggaggaccacagccccctcatgtaccacatttccctggtggacctgctggccgcctgtgccgagggcaaaaacgtctacactgagatcaagtgcacctccctgctgccgctggaggacgtggtgtctgtggtgacgcatgaggactgcatcactgaggtgaaaatggcctatgtgaacttcgtgaaccactgctacgtggacacggaggtggagatgaaggagatctacaccagcaaccacatctggacgctctttgagaacttcaccctggacatggctcgggtctgcagcaagcgtgagaagcgcgtggctgaccccaccttggagaagtacgtgctgagcgttgtgctggacaccatcaacgccttcttcagctccccattctctgagaacagcacttccctgcagacacaccagacgattgtggtgcagctgctgcagtctaccacacgcctcctcgagtgtccgtggctacagcagcagcacaagggctccgtggaggcctgcatccggaccctcgccatggtggccaagggccgggccatcttgctgcccatggacctggatgcccacatcagctcgatgctcagcagtggagccagctgtgcagctgccgcccagcggaacgcctccagctacaaggcaaccacgcgggccttcccccgcgtcacccccaccgccaaccagtgggactacaagaacatcattgagaagctgcaggacatcatcacagccctggaggagcggctgaagcccctggtacaggctgagctgtccgtgctggtggatgtcctgcactggcctgagctgctcttcctggagggcagtgaggcctaccagcgctgcgagagtgggggcttcctgtccaagctgatccagcacaccaaggacctcatggagtcggaggagaagctgtgcatcaaggtgctgcggaccctgcagcagatgctgctcaagaagaccaagtacggggaccggggcaaccagctgcgcaagatgctgctgcaaaactacctccagaaccggaagtccacctcgcggggggaccttcccgaccccataggcactggcctggacccagactggtcggcaatcgcagccacccagtgccggctggacaaggagggggccaccaagttggtatgcgacctcatcaccagcaccaagaacgagaagatcttccaggagagcatcggcctggccatccacctgctggatggtggcaacacagagatccagaaatccttccacaacctgatgatgagtgacaagaagtcagagcgcttcttcaaggtgctgcacgaccgcatgaagcgggcccagcaggagaccaagtccacggtggcagtcaacatgaatgacctgggcagccagccacatgaggaccgcgagccagtcgaccccaccaccaaaggccgcgtggcctccttctcgatacctggctcctcatcccgctactcgctgggccccagcctgcgccgggggcacgaggtgagcgaacgtgtgcagagcagtgagatgggcacatccgtgctcatcatgcagcccatcctgcgctttctgcagctgctgtgtgagaaccacaaccgggacctgcagaacttcctgcgctgtcagaacaacaaaaccaactacaacttggtatgcgagacgctgcagttcctggacatcatgtgcggcagcaccacgggcggcctggggctgctggggctctacatcaatgaggacaacgtgggcctcgtcatccagaccttggagaccctcactgagtactgccagggcccctgccatgagaaccagacttgcattgtgactcacgagtccaatggcatagacatcatcaccgcactgatcctcaatgacatcagccccctgtgcaagtaccgcatggatctggtgctgcagctcaaggacaatgcctccaagctgctcctggctctgatggagagccggcatgacagtgaaaatgctgagcgaatcctcatcagcctgcggccccaggagctggtggacgtcatcaagaaggcctacctgcaggaggaagagcgtgagaactcggaggtgagcccacgtgaagtgggccataacatctatatcctggcgctgcagctctccaggcacaataaacagctgcagcacctgctgaagccggtgaagcgcattcaagaggaggaggccgagggtatctcttccatgctcagcctcaacaacaagcagctgtcacagatgctcaagtcctcagcgccagcacaggaggaggaggaagaccccctggcctactatgagaaccacacgtcccagatcgagattgtgcggcaggaccgcagcatggagcagatcgtgttcccagtgcccggcatctgccagttcctgacggaggaaaccaagcaccggctcttcaccactactgagcaggacgagcagggcagcaaagtgagcgacttcttcgaccagtcctccttcctgcacaacgagatggagtggcagcgcaagctccgcagcatgccgctgatctactggttctcccgccgcatgaccctgtggggcagcatctccttcaacctggccgtgtttatcaacatcatcattgccttcttctacccttacatggagggcgcgtccacaggcgtgctggactcccctctcatctcattgctcttctggatcctcatctgcttctccatcgcggccctgttcaccaagcgctacagcatccgccccctcatcgtggcgctcatcctgcgctccatctactatctgggcatcgggcccacactcaacatcctgggtgccctcaatccaacaagatcgtgtttgtggtgagcttgagggcacccaggatgttgagtgtgggcccgatgga

SEQ ID NO: 313453 - DNA, 6975 bp, Homo sapiens
  misc_feature (4486)..(4486): n is a, c, g, or t
ttatttatttatttatttatttttttgtctatttgttgtgtaggggctatttcttgggctaatgcaagggcagggaccgaacccgcaacctcatggttcctagtcggattcgttaaccactgcgccacgacaggaactcccctgtgtctgacagttttaaagaaagcttttaagtggtgactcgacatcccgaggtgttgcggtcctattatcgcaatgggcactctatcttaggcgttcaaataaaggactaggaagcaaacacccaagcaccggggaacagaacagaaagaaagacggaaggagccaagagttttggagccaactcctggagagggagcggctgaactgattcggaagttggatctctttgtacacaggaatgcggagagaaaaaaaacaaaacccaccccattgcttcatttcccctccaagcctgagcactttctattgtgcaatgaaaaggcttttcacgttgagaaaaatgaatcccgaatttgctctgcaaagggatgagcgcgcctctgggcgccagcctgctctcagctgggcgcggagaccgcgcggtggccgcagggcggccgcggccagggcgctccagggcgcgccctccgcgagcggctccggggtgacgcccgccggagagctggactcccccttccgcgggcgcctgcactggctcttagccagccgagggcccgggtgcagatagtccgggaaccccgagggcggagagctccccactacgcctgggcctcccagggatggcagctccgagagccccctagacccggtgccttgcaggacgcctctggagatcaggagggctggcggcgcattcggcgtccgggaggccgggccccggacgcgcgaggagcgcggggcgcgggaaggcaggcgggtgcacatgggtgccggcgggcgagctgcggggggagggggggcggggtgtggcctccccgcctcccgggcgggatttgcatgtgtgtggtggccccagacttcctgctccttctacgctgcaggtacgcgcgggccgggcggggcgggcgggcggcgggcgcgccaagacgtgggcacctcctcacccggaccccgggccccgccgagccgcctcctggctcccgtggccgccagcccgccccggccgcaccgagcgtcgggatccgaggtgggagcgtacccctccccgctccccggacgcctcagtcctccgcactgagcttggccacgcgcccctaggcgccccccacgccctgggccccggagggccgcagccatgagtgaaatgtccagctttcttcacatcggggacatcgtctccctgtacgccgagggctccgtcaatggcttcatcagcactttggggctggtggatgaccgctgtgtggtggagcccgcggccggggacctggacaacccccctaagaagttccgtgactgcctcttcaaggtgtgccccatgaaccgctactcggcccagaagcagtactggaaggccaagcagactaagcaggacaaggagaagatcgctgatgtggtgttgctgcagaagctgcagcatgcggcgcagatggagcagaagcaaaatgacacggagaacaagaaggtgcatggggatgtcgtgaagtatggcagtgtgatccagctcctgcacatgaagagcaacaagtacctgacagtgaacaagcggcttccggccttgctggagaagaacgccatgcgggtgactctggatgccacaggcaacgagggttcctggctcttcatccagcccttctggaagctgcggagcaacggggacaacgtggtcgtgggggacaaggtgatcctgaatcctgtcaatgccgggcagcctctgcatgccagcaattacgagctcagcgacaacgccggctgcaaggaggtcaattctgtgaactgcaacaccagctggaagatcaacctgtttatgcagtttcgggaccacctggaggaggtgttgaaagggggagacgtggtgcggctgttccatgcggagcaggagaagttcctgacgtgtgacgagtacaagggcaagctgcaggtgttcctgcgaactacactgcgccagtctgccacctcggccaccagctccaatgctctctgggaggtggaggtggtccaccacgacccctgccgtggaggagctgggcactggaatggcttgtaccgcttcaagcacctggctacaggcaactacctggctgctgaggagaaccccagttacaaaggtgatgcctcagatcccaaggcagcaggaatgggggcacagggccgcacaggccgcaggaatgctggggagaagatcaagtactgcctggtggctgtgcctcatggcaatgacatcgcctctctctttgagctggaccccaccaccttgcagaaaaccgactctttcgtgccccggaactcgtacgtccggctgcggcacctctgcaccaacacgtggattcagagcaccaatgtgcccattgacatcgaggaggagcggcccatccggctcatgctgggcacctgccccaccaaggaggacaaggaggcctttgccatcgtgtcagtgcccgtgtctgagatccgagacctggactttgccaatgacgccagctccatgctggccagtgccgtggagaaactcaacgagggcttcatcagccagaatgaccgcaggtttgtcatccagctgctggaagacctggtgttctttgtcagcgatgtccccaacaatgggcagaatgtcctggacatcatggtcactaagcccaaccgggaacggcagaagctgatgagggagcagaacatcctcaaacaggtctttggcattctgaaggccccgttccgtgagaaggggggtgaaggtcccctggtgcggctggaggagctgtcagaccagaagaacgccccctaccagcacatgttccgcctgtgctaccgcgtgttgcggcattcccaggaggactaccgcaagaaccaggagcacattgccaagcagtttgggatgatgcagtcccagattggctacgacatcctggccgaggacaccatcactgccctgctgcacaacaaccgcaagctcctggaaaagcacatcaccaagaccgaggtggagaccttcgtcagccttgtgcgcaagaaccgggagcccaggttcctggactacctctctgacctgtgtgtgtccaaccacatcgccatccccgtcacccaagagctcatctgcaagtgtgtgctggaccccaagaacagtgacattctcatccggaccgagcttcggcccgtgaaggagatggcccaatcccacgagtacctgagcatcgagtactcagaagaggaagtgtggctcacgtggactgacaagaataacgagcatcatgagaagagtgtgaggcagctggcccaggaggcgcgggccggcaacgcccacgacgagaatgtgctcagctactacaggtaccagctgaagctctttgcccgcatgtgcttggaccgccagtacttggccatcgacgagatctcccagcagctgggcgtggacctgattttcctgtgcatggcagacgagatgctgccctttgacctgcgcgcctccttctgccacctgatgctgcacgtgcacgtggaccgtgacccccaggagctggtcacgccggtcaagtttgcccgtctctggactgagatccccacagccatcaccatcaaggactatgattccaacctcaacgcgtcccgagatgacaagaagaacaagtttgccaacaccatggagttcgtggaggactacctcaacaatgtagtcagcgaggccgtgccctttgccaacgaggagaagaacaagctcacttttgaggtggtcagcctggcgcacaatctcatctacttcggcttctacagcttcagcgagctgctgcggctcactcgcacactgctgggcatcatcgactgtgtgcaggggcccccggccatgctgcaggcctatgaggaccccggtggcaagaatgtgcggcggtccatccagggcgtggggcacatgatgtccaccatggtgctgagccgcaagcagtccgtcttcagtgcccccagcctgtctgctggggccagtgctgctgagccgctggacagaagcaagtttgaggagaatgaggacattgtggtgatggagaccaagctgaagatcctggaaatccttcagttcatcctcaacgtccgcctggattaccgcatatcctacctgctgtctgtcttcaagaaggagtttgtggaggtgtttcccatgcaggacagtggggctgatggcacagcccctgccttcgactctaccactgccaacatgaacctggatcgcatcggggagcaggcggaggccatgtttggagtggggaagacaagcagcatgctggaggtggatgacgagggcggccgcatgttcctgcgcgtgctcatccacctcaccatgcacgactatgcgccnctggtctcgggtgccctgcagctgctcttcaagcacttcagccagcgccaggaggccatgcacaccttcaagcaggttcagctgctgatctcagcgcaggacgtggagaactacaaggtgatcaagtcggagctggaccggctgcggaccatggtggagaagtcagagctgtgggtggacaagaagggcagtggcaagggtgaggaggtggaggcaggcgccgccaaggacaagaaagagcgtcccacggacgaggagggctttctgcacccaccaggggagaaaagcagtgagaactaccagatcgtcaagggcatcctggaaaggctgaacaagatgtgcggggttggggagcaaatgaggaagaagcagcaacggctgctgaagaacatggatgcccacaaggtcatgctggacctgctgcagatcccctatgacaagggtgatgccaagatgatggagatcctgcgctacacgcaccagttcctgcagaagttctgtgcagggaaccccggcaaccaggccctgctgcacaaacacctgcacctcttcctcacgccagggctcctggaggcagagaccatgcagcacatcttcctgaacaactatcagctctgctccgagatcagcgagcctgtgttgcagcacttcgtgcacctgctggccacgcacgggcgccatgtgcagtacctggacttcctgcacaccgtcattaaggccgagggcaagtacgtcaagaagtgccaggacatgatcatgactgagctgaccaatgcaggtgacgatgtggtcgtgttctacaatgataaggcatcgctggcccacctgctggacatgatgaaggccgcccgcgacggcgtggaggaccacagccccctcatgtaccacatttccctggtggacctgctggccgcctgtgccgagggcaaaaacgtctacactgagatcaagtgcacctccctgctgccgctggaggacgtggtgtctgtggtgacgcatgaggactgcatcactgaggtgaaaatggcctatgtgaacttcgtgaaccactgctacgtggacacggaggtggagatgaaggagatctacaccagcaaccacatctggacgctctttgagaacttcaccctggacatggctcgggtctgcagcaagcgtgagaagcgcgtggctgaccccaccttggagaagtacgtgctgagcgttgtgctggacaccatcaacgccttcttcagctccccattctctgagaacagcacttccctgcagacacaccagacgattgtggtgcagctgctgcagtctaccacacgcctcctcgagtgtccgtggctacagcagcagcacaagggctccgtggaggcctgcatccggaccctcgccatggtggccaagggccgggccatcttgctgcccatggacctggatgcccacatcagctcgatgctcagcagtggagccagctgtgcagctgccgcccagcggaacgcctccagctacaaggcaaccacgcgggccttcccccgcgtcacccccaccgccaaccagtgggactacaagaacatcattgagaagctgcaggacatcatcacagccctggaggagcggctgaagcccctggtacaggctgagctgtccgtgctggtggatgtcctgcactggcctgagctgctcttcctggagggcagtgaggcctaccagcgctgcgagagtgggggcttcctgtccaagctgatccagcacaccaaggacctcatggagtcggaggagaagctgtgcatcaaggtgctgcggaccctgcagcagatgctgctcaagaagaccaagtacggggaccggggcaaccagctgcgcaagatgctgctgcaaaactacctccagaaccggaagtccacctcgcggggggaccttcccgaccccataggcactggcctggacccagactggtcggcaatcgcagccacccagtgccggctggacaaggagggggccaccaagttggtatgcgacctcatcaccagcaccaagaacgagaagatcttccaggagagcatcggcctggccatccacctgctggatggtggcaacacagagatccaggtgtggggggcctggggcctggacatgccctcctttgcctccctccctttttggaggaggtgggccttgagttgggcactgaaggccgaggagggtgtgaaagaggagaggcctgagcagtggctgagagaaatccttccacaacctgatgatgagtgacaagaagtcagagcgcttcttcaaggtgctgcacgaccgcatgaagcgggcccagcaggagaccaagtccacggtggcagtcaacatgaatgacctgggcagccagccacatgaggaccgcgagccagtcgaccccaccaccaaagcttcaccggcgcagtcactctcataatcgcccacggacttacatcctcattactattctgcctagaaactcaactacgacgggc

SEQ ID NO: 313454 - DNA, 4874 bp, Homo sapiens
  misc_feature (4486)..(4486): n is a, c, g, or t
  misc_feature (4808)..(4808): n is a, c, g, or t
  misc_feature (4810)..(4810): n is a, c, g, or t
ttatttatttatttatttatttttttgtctatttgttgtgtaggggctatttcttgggctaatgcaagggcagggaccgaacccgcaacctcatggttcctagtcggattcgttaaccactgcgccacgacaggaactcccctgtgtctgacagttttaaagaaagcttttaagtggtgactcgacatcccgaggtgttgcggtcctattatcgcaatgggcactctatcttaggcgttcaaataaaggactaggaagcaaacacccaagcaccggggaacagaacagaaagaaagacggaaggagccaagagttttggagccaactcctggagagggagcggctgaactgattcggaagttggatctctttgtacacaggaatgcggagagaaaaaaaacaaaacccaccccattgcttcatttcccctccaagcctgagcactttctattgtgcaatgaaaaggcttttcacgttgagaaaaatgaatcccgaatttgctctgcaaagggatgagcgcgcctctgggcgccagcctgctctcagctgggcgcggagaccgcgcggtggccgcagggcggccgcggccagggcgctccagggcgcgccctccgcgagcggctccggggtgacgcccgccggagagctggactcccccttccgcgggcgcctgcactggctcttagccagccgagggcccgggtgcagatagtccgggaaccccgagggcggagagctccccactacgcctgggcctcccagggatggcagctccgagagccccctagacccggtgccttgcaggacgcctctggagatcaggagggctggcggcgcattcggcgtccgggaggccgggccccggacgcgcgaggagcgcggggcgcgggaaggcaggcgggtgcacatgggtgccggcgggcgagctgcggggggagggggggcggggtgtggcctccccgcctcccgggcgggatttgcatgtgtgtggtggccccagacttcctgctccttctacgctgcaggtacgcgcgggccgggcggggcgggcgggcggcgggcgcgccaagacgtgggcacctcctcacccggaccccgggccccgccgagccgcctcctggctcccgtggccgccagcccgccccggccgcaccgagcgtcgggatccgaggtgggagcgtacccctccccgctccccggacgcctcagtcctccgcactgagcttggccacgcgcccctaggcgccccccacgccctgggccccggagggccgcagccatgagtgaaatgtccagctttcttcacatcggggacatcgtctccctgtacgccgagggctccgtcaatggcttcatcagcactttggggctggtggatgaccgctgtgtggtggagcccgcggccggggacctggacaacccccctaagaagttccgtgactgcctcttcaaggtgtgccccatgaaccgctactcggcccagaagcagtactggaaggccaagcagactaagcaggacaaggagaagatcgctgatgtggtgttgctgcagaagctgcagcatgcggcgcagatggagcagaagcaaaatgacacggagaacaagaaggtgcatggggatgtcgtgaagtatggcagtgtgatccagctcctgcacatgaagagcaacaagtacctgacagtgaacaagcggcttccggccttgctggagaagaacgccatgcgggtgactctggatgccacaggcaacgagggttcctggctcttcatccagcccttctggaagctgcggagcaacggggacaacgtggtcgtgggggacaaggtgatcctgaatcctgtcaatgccgggcagcctctgcatgccagcaattacgagctcagcgacaacgccggctgcaaggaggtcaattctgtgaactgcaacaccagctggaagatcaacctgtttatgcagtttcgggaccacctggaggaggtgttgaaagggggagacgtggtgcggctgttccatgcggagcaggagaagttcctgacgtgtgacgagtacaagggcaagctgcaggtgttcctgcgaactacactgcgccagtctgccacctcggccaccagctccaatgctctctgggaggtggaggtggtccaccacgacccctgccgtggaggagctgggcactggaatggcttgtaccgcttcaagcacctggctacaggcaactacctggctgctgaggagaaccccagttacaaaggtgatgcctcagatcccaaggcagcaggaatgggggcacagggccgcacaggccgcaggaatgctggggagaagatcaagtactgcctggtggctgtgcctcatggcaatgacatcgcctctctctttgagctggaccccaccaccttgcagaaaaccgactctttcgtgccccggaactcgtacgtccggctgcggcacctctgcaccaacacgtggattcagagcaccaatgtgcccattgacatcgaggaggagcggcccatccggctcatgctgggcacctgccccaccaaggaggacaaggaggcctttgccatcgtgtcagtgcccgtgtctgagatccgagacctggactttgccaatgacgccagctccatgctggccagtgccgtggagaaactcaacgagggcttcatcagccagaatgaccgcaggtttgtcatccagctgctggaagacctggtgttctttgtcagcgatgtccccaacaatgggcagaatgtcctggacatcatggtcactaagcccaaccgggaacggcagaagctgatgagggagcagaacatcctcaaacaggtctttggcattctgaaggccccgttccgtgagaaggggggtgaaggtcccctggtgcggctggaggagctgtcagaccagaagaacgccccctaccagcacatgttccgcctgtgctaccgcgtgttgcggcattcccaggaggactaccgcaagaaccaggagcacattgccaagcagtttgggatgatgcagtcccagattggctacgacatcctggccgaggacaccatcactgccctgctgcacaacaaccgcaagctcctggaaaagcacatcaccaagaccgaggtggagaccttcgtcagccttgtgcgcaagaaccgggagcccaggttcctggactacctctctgacctgtgtgtgtccaaccacatcgccatccccgtcacccaagagctcatctgcaagtgtgtgctggaccccaagaacagtgacattctcatccggaccgagcttcggcccgtgaaggagatggcccaatcccacgagtacctgagcatcgagtactcagaagaggaagtgtggctcacgtggactgacaagaataacgagcatcatgagaagagtgtgaggcagctggcccaggaggcgcgggccggcaacgcccacgacgagaatgtgctcagctactacaggtaccagctgaagctctttgcccgcatgtgcttggaccgccagtacttggccatcgacgagatctcccagcagctgggcgtggacctgattttcctgtgcatggcagacgagatgctgccctttgacctgcgcgcctccttctgccacctgatgctgcacgtgcacgtggaccgtgacccccaggagctggtcacgccggtcaagtttgcccgtctctggactgagatccccacagccatcaccatcaaggactatgattccaacctcaacgcgtcccgagatgacaagaagaacaagtttgccaacaccatggagttcgtggaggactacctcaacaatgtagtcagcgaggccgtgccctttgccaacgaggagaagaacaagctcacttttgaggtggtcagcctggcgcacaatctcatctacttcggcttctacagcttcagcgagctgctgcggctcactcgcacactgctgggcatcatcgactgtgtgcaggggcccccggccatgctgcaggcctatgaggaccccggtggcaagaatgtgcggcggtccatccagggcgtggggcacatgatgtccaccatggtgctgagccgcaagcagtccgtcttcagtgcccccagcctgtctgctggggccagtgctgctgagccgctggacagaagcaagtttgaggagaatgaggacattgtggtgatggagaccaagctgaagatcctggaaatccttcagttcatcctcaacgtccgcctggattaccgcatatcctacctgctgtctgtcttcaagaaggagtttgtggaggtgtttcccatgcaggacagtggggctgatggcacagcccctgccttcgactctaccactgccaacatgaacctggatcgcatcggggagcaggcggaggccatgtttggagtggggaagacaagcagcatgctggaggtggatgacgagggcggccgcatgttcctgcgcgtgctcatccacctcaccatgcacgactatgcgccnctggtctcgggtgccctgcagctgctcttcaagcacttcagccagcgccaggaggccatgcacaccttcaagcaggttcagctgctgatctcagcgcaggacgtggagaactacaaggtgatcaagtcggagctggaccggctgcggaccatggtggagaagtcagagctgtgggtggacaagaagggcagtggcaagggtgaggaggtggaggcaggcgccgccaaggacaagaaagagcgtcccacggacgaggagggctttctgcacccaccaggggagaaaagcagtgagaactaccagatcgtcaagggcatcctgnanaggctgtactagacgtccagtgtgttggggagacaatgaggaagttgacagcgaccgatcattg

SEQ ID NO: 313455 - DNA, 2477 bp, Homo sapiens
ttatttatttatttatttatttttttgtctatttgttgtgtaggggctatttcttgggctaatgcaagggcagggaccgaacccgcaacctcatggttcctagtcggattcgttaaccactgcgccacgacaggaactcccctgtgtctgacagttttaaagaaagcttttaagtggtgactcgacatcccgaggtgttgcggtcctattatcgcaatgggcactctatcttaggcgttcaaataaaggactaggaagcaaacacccaagcaccggggaacagaacagaaagaaagacggaaggagccaagagttttggagccaactcctggagagggagcggctgaactgattcggaagttggatctctttgtacacaggaatgcggagagaaaaaaaacaaaacccaccccattgcttcatttcccctccaagcctgagcactttctattgtgcaatgaaaaggcttttcacgttgagaaaaatgaatcccgaatttgctctgcaaagggatgagcgcgcctctgggcgccagcctgctctcagctgggcgcggagaccgcgcggtggccgcagggcggccgcggccagggcgctccagggcgcgccctccgcgagcggctccggggtgacgcccgccggagagctggactcccccttccgcgggcgcctgcactggctcttagccagccgagggcccgggtgcagatagtccgggaaccccgagggcggagagctccccactacgcctgggcctcccagggatggcagctccgagagccccctagacccggtgccttgcaggacgcctctggagatcaggagggctggcggcgcattcggcgtccgggaggccgggccccggacgcgcgaggagcgcggggcgcgggaaggcaggcgggtgcacatgggtgccggcgggcgagctgcggggggagggggggcggggtgtggcctccccgcctcccgggcgggatttgcatgtgtgtggtggccccagacttcctgctccttctacgctgcaggtacgcgcgggccgggcggggcgggcgggcggcgggcgcgccaagacgtgggcacctcctcacccggaccccgggccccgccgagccgcctcctggctcccgtggccgccagcccgccccggccgcaccgagcgtcgggatccgaggtgggagcgtacccctccccgctccccggacgcctcagtcctccgcactgagcttggccacgcgcccctaggcgccccccacgccctgggccccggagggccgcagccatgagtgaaatgtccagctttcttcacatcggggacatcgtctccctgtacgccgagggctccgtcaatggcttcatcagcactttggggctggtggatgaccgctgtgtggtggagcccgcggccggggacctggacaacccccctaagaagttccgtgactgcctcttcaaggtgtgccccatgaaccgctactcggcccagaagcagtactggaaggccaagcagactaagcaggacaaggagaagatcgctgatgtggtgttgctgcagaagctgcagcatgcggcgcagatggagcagaagcaaaatgacacggagaacaagaaggtgcatggggatgtcgtgaagtatggcagtgtgatccagctcctgcacatgaagagcaacaagtacctgacagtgaacaagcggcttccggccttgctggagaagaacgccatgcgggtgactctggatgccacaggcaacgagggttcctggctcttcatccagcccttctggaagctgcggagcaacggggacaacgtggtcgtgggggacaaggtgatcctgaatcctgtcaatgccgggcagcctctgcatgccagcaattacgagctcagcgacaacgccggctgcaaggaggtcaattctgtgaactgcaacaccagctggaagatcaacctgtttatgcagtttcgggaccacctggaggaggtgttgaaagggggagacgtggtgcggctgttccatgcggagcaggagaagttcctgacgtgtgacgagtacaagggcaagctgcaggtgttcctgcgaactacactgcgccagtctgccacctcggccaccagctccaatgctctctgggaggtggaggtggaaaacgtgatggtgtggactgtgggggtctgcagacacagtgttgagaggaaaggggaggtcctgctgattcctcagaatggcttctggaccctggagatgttttggaaacccataccgggccctgtcctcccctgagaggattctccctttgaaggagtccctttgccgggtgggcgtcttcctggactatgaagctggagatgtctccttctacaacatgagggacagatcgcacatctacacatgtccccgttcagcctttactgtgcctgtgaggcccttcttcaggttagggtctgatgacagccccatcttcatctgtcctgcactcaca

SEQ ID NO: 313456 - DNA, 513 bp, Homo sapiens
ataaccttttggtttttcaaccatgtaaatccatcacctttttatgacattaatttttttaaacattttttaaaagggtcagcaacatggctatgagcccacggccttggtgagttacagggctgccgtgtacagttgggcaggtcgtgcactgctgaagggaatacaagtacctttttccaactggcacagaggcacatggtggctagtgaaggctccgtctctccacccatgcccattctgattgggccctggttcctggacctggggttgcccagggtgggggcctgggctgcagcagcgggctctgtgacttcttgcagacacaccagacgattgtggtgcagctgctgcagtctaccacacgcctcctcgagtgtccgtggctacagcagcagcacaagggctccgtggaggcctgcatccggaccctcgccatggtgggtgagtgtgccggggcactggccagccccaaaccactcctcctgccgctcacagtggggacgcctgccc

SEQ ID NO: 313457 - DNA, 5440 bp, Homo sapiens
  misc_feature (3772)..(3772): n is a, c, g, or t
  misc_feature (4262)..(4262): n is a, c, g, or t
  misc_feature (4671)..(4671): n is a, c, g, or t
ccgggaagccaccccgcctctccgaggcctccctgccccgccccgtcacgcccctttcccggcgggacgctttgagccgccccgaactaagcagggcggtcgggggagtcatactccatgggtttatgtgataaatgatcttggcatagaagagaatttaaagagtgatggaaaacctaaatgtcaaactggtggaaaatctaagaggaccattcaaggcactcataaaactactaaacagagtactgcagtggactgtaaaataacatcgtctacgactggagataaacactttgataaaagtcccactaaaacaaggcaccctcggaaaattgatctaagagctcgatactgggcatttctttttgataatcttcgccgagcagtagatgaaatctatgtaacttgcgaatcagatcagagtgtggtcgaatgtaaggaggtgctaatgatgctggataactatgtaagagatttcaaagcattgattgactggattcagcttcaggaaaagctagagaagacagatgctcaaagcagaccaacatcattggcatgggaagtaaagaagatgtctccgggacgccatgtgattccaagtccatcaacagatagaataaatgtaacatcaaatgctcgacgaagcttaaattttggaggttcaactggcacagtgccagctcctcgtctggctcccacaggtgtcagttgggctgacaaggtaaaggctcatcatacaggctctactgcttcttcagaaataacacccgcccagtcttgcccaccaatgacagtgcagaaggcctcacgcaaaaatgaacggaaagatgctgaaggatgggagaccgttcagagaggaaggcctattcgttctcgatcaacagcagtgatgccaaaagtttcattggcaacagaagccacaagatcaaaggatgacagtgataaagaaaatgtatgtcttttacctgatgaaagcatacagaaaggtcaatttgttggagatggaacttctaatactatagaatctcatcccaaagactcattacactcttgtgaccatcctcttgccgaaaaaacccagttcacagtgagtacattggatgatgtgaagaattctggcagtattcgagacaattatgttcgaacttctgaaatatctgctgtccacattgatacagagtgtgtttcagttatgctgcaagctggtacacctcctttacaagtaaatgaagaaaaatttccagcagagaaagcaaggatagaaaatgaaatggacccttcagatatttcaaatgtgagtgctgctaacttgtccatggcagaagtccttgctaaaaaagaagagctagcagatcgtctagaaaaggccaatgaagaagccattgctagtgctattgctgaagaagaacagttaactagagaaattgaagctgaagaaaacaatgatattaacattgaaactgacaacgacagtgatttttctgccagcatgggcagtgggagtgtttctttctgtggtatgtccatggactggaacgatgtccttgcagattatgaagctcgtgagtcttggcgccaaaatacatcctggggggacattgtagaagaagaacctgctagacctccagggcatggaattcacatgcatgaaaaactttcttcaccctctcgtaaaagaacaattgcagaatctaagaagaaacatgaagaaaaacaaatgaaagcacagcagctaagggaaaagttacgcgaagagaaaacattgaagcttcagaaattgttagaaagggagaaggatgtccggaagtggaaggaagaattgctagatcaacgacgcaggatgatggaagaaaaattacttcatgctgagtttaagcgagaagtgcagttacaagcaattgtgaaaaaagcacaagaagaagaagctaaggtaaatgaaattgcctttataaatacccttgaagcccagaataaacgtcatgatgttttatcaaaattgaaggaatatgaacagaggcttaatgagctacaggaagagcgtcagagaagacaggaagaaaagcaagcacgtgatgaagctgtgcaggaacgcaagagagctctagaggcagagcggcaggcccgtgtagaagaattgttaatgaagaggaaagaacaagaagcccgaattgaacaacagaggcaagaaaaggaaaaagcccgtgaggatgcagcccgggaaagagctagagacagggaagaacgattggcagcactcacagctgctcaacaagaagctatggaagagttacagaaaaaaattcagctcaagcatgatgaaagtattcgaaggcacatggaacagattgaacaaagaaaagaaaaagctgctgagctaagcagtgggcgacatgcaaatactgattatgcccccaaactgaccccttatgaaagaaagaagcagtgttctctctgcaatgtcctgatctcttcagaggtatatctttttagccatgttaaagggagaaaacaccagcaagccgtgagagagaataccagcatccaggggcgtgaactgtcagatgaagaagtggagcatctttccttgaagaagtacattattgacattgtggttgaaagtacagctccagcagaagctttgaaagatggagaagagcggcaaaaaaataaaaaaaaagccaaaaagataaaagcccggatgaacttcagggctaaggaatatgagagtttaatggaaaccaaaaattctggctctgattcaccttataaagcaaagcttcagcgattagccaaagatcttctaaaacaagtacaagttcaagacagtggctcatgggcaaacaataaagtgtctgctttggatcggaccctaggagagatcactagaatactggaaaaagagaatgtggcagatcagattgcatttcaagctgctggtggattaacagcccttgaacacatccttcaagcagtagtcccagccacaaatgtgaacacagttttaagaattcctcctaagtctctctgcaatgcaatcaatgtttacaacctcacctgcaataactgttcagaaaactgcagtgatgttctgtttagtaacaagattaccttcttaatggacctcctgatacaccagttgacggtttatgttccagatgaaaataatactattttggggagaaatacaaataaacaagtttttgaaggcttgacaactggacttctcaaagtcagtgctgtggttttgggctgcctgattgccaatcgaccagatggaaactgccagccagctaccccaaaaataccaacacaggaaatgaaaaacaaaccctcacaaggtgatccttttaacaatcgagttcaggaccttatcagctacgtggtgaacatgggtctgattgacaaactgtgtgcctgcttcctctcggtgcaaggcccagtggatgagaatcccaagatggccatatttctgcagcatgccgcaggactcttacatgcaatgtgtacactgtgctttgctgtcactggaaggtcatacagcatatttgacaataatcgccaggatcccacagggctgacagctgctcttcaggcaaccgacctggctggagttcttcatatgctctactgtgtcctcttccatggcaccatcttggaccccagcactgccagtcccaaggagaattacactcaaaataccatccaagtggccattcagagtttacgtttcttcaacagctttgcagctcttcatctgcctgcttttcaggtnccaagtattggtttatatcgatgttaaccaatcaagagttagtattttagtgtagataggatgtcagattcttctcctgaattggggcataaggaataaactacaataaatggaattataatatatattataatttattaaactactattttctgggaactgtattagatgctctataacatctagcattctcatttattctcatagctaccatgcaaagtattattatacccattttacagatagagaagctgacagttaagtaatgtgcccaaggttacatgtttgtgaaccaggactagtaaccatgactctcccaccccaaagcctatgttcatcctttgccatgctgctatttataaatcttttgtctggaattctttatatcaggacattatcatctcatcaacttttaaatattaaggaaagtaatggtttcttacgtaaatagaaccaaaattagataaattgattgatatgactttctacngatggtttagctgattttgtgtccaatgtaaagtgtataactagctttacagggatttgcatctttagctatgaagtttttatagctaaagaaagaagaattgctttatgctataacaccagactgtcagcctggaaacagattttttttttcatgtaggaaatttaattttcaaaaacactgaacctttggaacagagcaagccccaaggaatagactttctctttcagtttattaactgtcaagtgatttcattaaaaaaggaacaaatttggcagatgatgaacccataatttagatgaattgctttgctctgagggaaaaaggttatagagaaacaaatgtatgaaaatagtggactttgccattctgagatgagaagaatacttctatattgtagctgatgacnaatgtgccattctttaattgatgtcttcctgtcattttgttcaaaaaaggaaacttgtgactaagttgtatcattggatctagtatctttcaactttgtagaattagtttatctgtcacaagaacagaaatcccttcctttgggttaatgcttttctgtctccagagcagttgaactagccttaggaggtaactgactgcacaatacgtagagttctgggaggttacagccacatataaatgagagatatctgctccaaaaaatgtcagtagttcttgcctcagggttgaacataacatctgtgttttatgaagacgtaagcccaccgtattctgtctggaaacagtttggaaatcagggaaccttaactttacatgctcaggatatggagtccaccagtctacccatcagctgcgtcgaaagggagtgatttcttttgttaacagattatggaatagcaaatatctaaaaactgtctcttagcttcctgtttcacgggtcttcttggccaacatttatactgctacaggggactccatatcataaacaagcatctaggataagtcagctgttcggtcagtcactccatcagggagccctaggtccctgctccctgcccctctcctcctgtgaacttgtggcctgtgcaggctcactcacaaaggcgcaccactgaacttcaccagacctgctccctagtgcctttaagcctaaagggcttaataatgggcgataatgtcaagtgatttcattaaaaaaggaaaaagaa

SEQ ID NO: 313458 - DNA, 257 bp, Homo sapiens
aaacaagtatctctaacattaggaacgcaagagagctctagaggcagagcggcaggcccgtgtagaagaattgttaatgaagaggaaagaacaagaagcccgaattgaacaacagaggcaagaaaaggaaaaagcccgtgaggatgcagcccgggaaagagctaggtatctcatttgctatcttgatgaacattttgcactgagtgaatattcaagttgaggtcttaaagccatttactgtaatgttagagtttttt

SEQ ID NO: 313459 - DNA, 467 bp, Homo sapiens
ggagctggttctcactacagtccctcctatattctatttggtgaaaataagtagcttcaaaagtttaaaaaagagattacttgcagcattaacacttctttgttgattaaccagtttcctatggagttttaaagctcatactttgttcttgtccttgtggacacaaattttctaactgccaatgggacctttgtgtcccacattcaaatcctctctagtaatttctgcaaaggttgagaaggctggcatgctaactagttacgcgaagagaaaacattgaagcttcagaaattgttagaaagggagaaggatgtccggaagtggaaggaagaattgctagatcaacgacgcaggatgatggaagaaaaattacttcatgctgagtttaagcgagaagtgcagttacaagcaattgtgaaaaaagcacaagaagaagaagctaaggtatatcataagagctttaaatg

SEQ ID NO: 313460 - DNA, 4359 bp, Homo sapiens
agtcataggtaagagattagggtcctctcaaatatttcctaggtatgcacacaacctgcatatgtgtgtggccttcttgattttcaggaatttgctagaacttttcaaagcctcccatggatgtctcattcttgagcttttccttttaagttttttggtcagctctttgtttgcttcaaatggtatttcaatctctggtagttgtattattttaaaaaattgtcacatttgtttcgcacaaacaaaaaaattgtttttaagactaagttgttttggactctacttctttagagtgaatgttaacatctgatgtttaatggaagggttgaggttcaactggcacagtgccagctcctcgtctggctcccacaggtgtcagttgggctgacaaggtaaaggctcatcatacaggctctactgcttcttcagaaataacacccgcccagtcttgcccaccaatgacagtgcagaaggcctcacgcaaaaatgaacggaaagatgctgaaggatgggagaccgttcagagaggaaggcctattcgttctcgatcaacagcagtgatgccaaaagtttcattggcaacagaagccacaagatcaaaggatgacagtgataaagaaaatgtatgtcttttacctgatgaaagcatacagaaaggtcaatttgttggagatggaacttctaatactatagaatctcatcccaaagactcattacactcttgtgaccatcctcttgccgaaaaaacccagttcacagtgagtacattggatgatgtgaagaattctggcagtattcgagacaattatgttcgaacttctgaaatatctgctgtccacattgatacagagtgtgtttcagttatgctgcaagctggtacacctcctttacaagtaaatgaagaaaaatttccagcagagaaagcaaggatagaaaatgaaatggacccttcagatatttcaaattccatggcagaagtccttgctaaaaaagaagagctagcagatcgtctagaaaaggccaatgaagaagccattgctagtgctattgctgaagaagaacagttaactagagaaattgaagctgaagaaaacaatgatattaacattgaaactgacaacgacagtgatttttctgccagcatgggcagtgggagtgtttctttctgtggtatgtccatggactggaacgatgtccttgcagattatgaagctcgtgagtcttggcgccaaaatacatcctggggggacattgtagaagaagaacctgctagacctccagggcatggaattcacatgcatgaaaaactttcttcaccctctcgtaaaagaacaattgcagaatctaagaagaaacatgaagaaaaacaaatgaaagcacagcagctaagggaaaagttacgcgaagagaaaacattgaagcttcagaaattgttagaaagggagaaggatgtccggaagtggaaggaagaattgctagatcaacgacgcaggatgatggaagaaaaattacttcatgctgagtttaagcgagaagtgcagttacaagcaattgtgaaaaaagcacaagaagaagaagctaaggtaaatgaaattgcctttataaatacccttgaagcccagaataaacgtcatgatgttttatcaaaattgaaggaatatgaacagaggcttaatgagctacaggaagagcgtcagagaagacaggaagaaaagcaagcacgtgatgaagctgtgcaggaacgcaagagagctctagaggcagagcggcaggcccgtgtagaagaattgttaatgaagaggaaagaacaagaagcccgaattgaacaacagaggcaagaaaaggaaaaagcccgtgaggatgcagcccgggaaagagctagagacagggaagaacgattggcagcactcacagctgctcaacaagaagctatggaagagttacagaaaaaaattcagctcaagcatgatgaaagtattcgaaggcacatggaacagattgaacaaagaaaagaaaaagctgctgagctaagcagtgggcgacatgcaaatactgattatgcccccaaactgaccccttatgaaagaaagaagcagtgttctctctgcaatgtcctgatctcttcagaggtatatctttttagccatgttaaagggagaaaacaccagcaagccgtgagagagaataccagcatccaggggcgtgaactgtcagatgaagaagtggagcatctttccttgaagaagtacattattgacattgtggttgaaagtacagctccagcagaagctttgaaagatggagaagagcggcaaaaaaataaaaaaaaagccaaaaagataaaagcccggatgaacttcagggctaaggaatatgagagtttaatggaaaccaaaaattctggctctgattcaccttataaagcaaagcttcagcgattagccaaagatcttctaaaacaagtacaagttcaagacagtggctcatgggcaaacaataaagtgtctgctttggatcggaccctaggagagatcactagaatactggaaaaagagaatgtggcagatcagattgcatttcaagctgctggtggattaacagcccttgaacacatccttcaagcagtagtcccagccacaaatgtgaacacagttttaagaattcctcctaagtctctctgcaatgcaatcaatgtttacaacctcacctgcaataactgttcagaaaactgcagtgatgttctgtttagtaacaagattaccttcttaatggacctcctgatacaccagttgacggtttatgttccagatgaaaataatactattttggggagaaatacaaataaacaagtttttgaaggcttgacaactggacttctcaaagtcagtgctgtggttttgggctgcctgattgccaatcgaccagatggaaactgccagccagctaccccaaaaataccaacacaggaaatgaaaaacaaaccctcacaaggtgatccttttaacaatcgagttcaggaccttatcagctacgtggtgaacatgggtctgattgacaaactgtgtgcctgcttcctctcggtgcaaggcccagtggatgagaatcccaagatggccatatttctgcagcatgccgcaggactcttacatgcaatgtgtacactgtgctttgctgtcactggaaggtcatacagcatatttgacaataatcgccaggatcccacagggctgacagctgctcttcaggcaaccgacctggctggagttcttcatatgctctactgtgtcctcttccatggcaccatcttggaccccagcactgccagtcccaaggagaattacactcaaaataccatccaagtggccattcagagtttacgtttcttcaacagctttgcagctcttcatctgcctgcttttcagtctattgtaggggcagagggcttgtcccttgcattccggcacatggccagctccctgctgggccactgcagccaagtctcctgtgaaagcctccttcatgaggtcatcgtctgtgtgggctacttcactgtcaaccacccagataaccaggtgatcgtgcagtccggccgccaccccacagtgctgcagaagctctgccagttgcccttccagtatttcagtgacccacggctgatcaaagtactgttcccttcacttatcgctgcttgttacaacaaccatcagaacaagatcattctggagcaagagatgagctgtgttttactggccactttcattcaggatttggcacagactccaggtcaagcggaaaaccagccttaccaacccaaagggaaatgccttggttcccaagactatcttgagctggctaacagatttcctcagcaggcctgggaagaagctcgacagtttttcttgaaaaaagagaaaaaataaatgttttggttgattctgtatttgagtacccttgttaatattttaaattgtccaaacaaacattctaattgttccttaagaactcattttcccatgtttatactcttcccacactgtagatatggcatgtactttacactatttataatgactgtagatacttgaatgttctacttgctaattttgcaagttgagtttatttcatttatgcagagtatcttggagtttggtaatttccatcttatgataatatatactttgcatttgtgatatgggtgaaaggagacataaaattagcaagtctgttttgttcttgtaataaagtaacttattctgttttcattgttgacttttcatgttaaggaaatacgaatctgaaagaaaaatgttaactccagctcttgaagtatcttaaataaagacttaattaaagtttacc

SEQ ID NO: 313461 - DNA, 4752 bp, Homo sapiens
ccgggaagccaccccgcctctccgaggcctccctgccccgccccgtcacgcccctttcccggcgggacgctttgagccgccccgaactaagcagggcggtcgggggagtcatactccatgggtttatgtgataaatgatcttggcatagaagagaatttaaagagtgatggcttcattccagcgctccaatagtcatgacaaagtaaggagaatagttgcagaggagggtcgtacagcaagaaacctaatagcttggagtgttccactagaaagcaaagatgatgatggaaaacctaaatgtcaaactggtggaaaatctaagaggaccattcaaggcactcataaaactactaaacagagtactgcagtggactgtaaaataacatcgtctacgactggagataaacactttgataaaagtcccactaaaacaaggcaccctcggaaaattgatctaagagctcgatactgggcatttctttttgataatcttcgccgagcagtagatgaaatctatgtaacttgcgaatcagatcagagtgtggtcgaatgtaaggaggtgctaatgatgctggataactatgtaagagatttcaaagcattgattgactggattcagcttcaggaaaagctagagaagacagatgctcaaagcagaccaacatcattggcatgggaagtaaagaagatgtctccgggacgccatgtgattccaagtccatcaacagatagaataaatgtaacatcaaatgctcgacgaagcttaaattttggaggttcaactggcacagtgccagctcctcgtctggctcccacaggtgtcagttgggctgacaaggtaaaggctcatcatacaggctctactgcttcttcagaaataacacccgcccagtcttgcccaccaatgacagtgcagaaggcctcacgcaaaaatgaacggaaagatgctgaaggatgggagaccgttcagagaggaaggcctattcgttctcgatcaacagcagtgatgccaaaagtttcattggcaacagaagccacaagatcaaaggatgacagtgataaagaaaatgtatgtcttttacctgatgaaagcatacagaaaggtcaatttgttggagatggaacttctaatactatagaatctcatcccaaagactcattacactcttgtgaccatcctcttgccgaaaaaacccagttcacagtgagtacattggatgatgtgaagaattctggcagtattcgagacaattatgttcgaacttctgaaatatctgctgtccacattgatacagagtgtgtttcagttatgctgcaagctggtacacctcctttacaagtaaatgaagaaaaatttccagcagagaaagcaaggatagaaaatgaaatggacccttcagatatttcaaattccatggcagaagtccttgctaaaaaagaagagctagcagatcgtctagaaaaggccaatgaagaagccattgctagtgctattgctgaagaagaacagttaactagagaaattgaagctgaagaaaacaatgatattaacattgaaactgacaacgacagtgatttttctgccagcatgggcagtgggagtgtttctttctgtggtatgtccatggactggaacgatgtccttgcagattatgaagctcgtgagtcttggcgccaaaatacatcctggggggacattgtagaagaagaacctgctagacctccagggcatggaattcacatgcatgaaaaactttcttcaccctctcgtaaaagaacaattgcagaatctaagaagaaacatgaagaaaaacaaatgaaagcacagcagctaagggaaaagttacgcgaagagaaaacattgaagcttcagaaattgttagaaagggagaaggatgtccggaagtggaaggaagaattgctagatcaacgacgcaggatgatggaagaaaaattacttcatgctgagtttaagcgagaagtgcagttacaagcaattgtgaaaaaagcacaagaagaagaagctaaggtaaatgaaattgcctttataaatacccttgaagcccagaataaacgtcatgatgttttatcaaaattgaaggaatatgaacagaggcttaatgagctacaggaagagcgtcagagaagacaggaagaaaagcaagcacgtgatgaagctgtgcaggaacgcaagagagctctagaggcagagcggcaggcccgtgtagaagaattgttaatgaagaggaaagaacaagaagcccgaattgaacaacagaggcaagaaaaggaaaaagcccgtgaggatgcagcccgggaaagagctagagacagggaagaacgattggcagcactcacagctgctcaacaagaagctatggaagagttacagaaaaaaattcagctcaagcatgatgaaagtattcgaaggcacatggaacagattgaacaaagaaaagaaaaagctgctgagctaagcagtgggcgacatgcaaatactgattatgcccccaaactgaccccttatgaaagtagccatgttaaagggagaaaacaccagcaagccgtgagagagaataccagcatccaggggcgtgaactgtcagatgaagaagtggagcatctttccttgaagaagtacattattgacattgtggttgaaagtacagctccagcagaagctttgaaagatggagaagagcggcaaaaaaataaaaaaaaagccaaaaagataaaagcccggatgaacttcagggctaaggaatatgagagtttaatggaaaccaaaaattctggctctgattcaccttataaagcaaagcttcagcgattagccaaagatcttctaaaacaagtacaagttcaagacagtggctcatgggcaaacaataaagtgtctgctttggatcggaccctaggagagatcactagaatactggaaaaagagaatgtggcagatcagattgcatttcaagctgctggtggattaacagcccttgaacacatccttcaagcagtagtcccagccacaaatgtgaacacagttttaagaattcctcctaagtctctctgcaatgcaatcaatgtttacaacctcacctgcaataactgttcagaaaactgcagtgatgttctgtttagtaacaagattaccttcttaatggacctcctgatacaccagttgacggtttatgttccagatgaaaataatactattttggggagaaatacaaataaacaagtttttgaaggcttgacaactggacttctcaaagtcagtgctgtggttttgggctgcctgattgccaatcgaccagatggaaactgccagccagctaccccaaaaataccaacacaggaaatgaaaaacaaaccctcacaaggtgatccttttaacaatcgagttcaggaccttatcagctacgtggtgaacatgggtctgattgacaaactgtgtgcctgcttcctctcggtgcaaggcccagtggatgagaatcccaagatggccatatttctgcagcatgccgcaggactcttacatgcaatgtgtacactgtgctttgctgtcactggaaggtcatacagcatatttgacaataatcgccaggatcccacagggctgacagctgctcttcaggcaaccgacctggctggagttcttcatatgctctactgtgtcctcttccatggcaccatcttggaccccagcactgccagtcccaaggagaattacactcaaaataccatccaagtggccattcagagtttacgtttcttcaacagctttgcagctcttcatctgcctgcttttcagtctattgtaggggcagagggcttgtcccttgcattccggcacatggccagctccctgctgggccactgcagccaagtctcctgtgaaagcctccttcatgaggtcatcgtctgtgtgggctacttcactgtcaaccacccagataaccaggtgatcgtgcagtccggccgccaccccacagtgctgcagaagctctgccagttgcccttccagtatttcagtgacccacggctgatcaaagtactgttcccttcacttatcgctgcttgttacaacaaccatcagaacaagatcattctggagcaagagatgagctgtgttttactggccactttcattcaggatttggcacagactccaggtcaagcggaaaaccagccttaccaacccaaagggaaatgccttggttcccaagactatcttgagctggctaacagatttcctcagcaggcctgggaagaagctcgacagtttttcttgaaaaaagagaaaaaataaatgttttggttgattctgtatttgagtacccttgttaatattttaaattgtccaaacaaacattctaattgttccttaagaactcattttcccatgtttatactcttcccacactgtagatatggcatgtactttacactatttataatgactgtagatacttgaatgttctacttgctaattttgcaagttgagtttatttcatttatgcagagtatcttggagtttggtaatttccatcttatgataatatatactttgcatttgtgatatgggtgaaaggagacataaaattagcaagtctgttttgttcttgtaataaagtaacttattctgttttcattgttgacttttcatgttaaggaaatacgaatctgaaagaaaaatgttaactccagctcttgaagtatcttaaataaagacttaattaaagtttacc

SEQ ID NO: 313462 - DNA, 4386 bp, Homo sapiens
ccgggaagccaccccgcctctccgaggcctccctgccccgccccgtcacgcccctttcccggcgggacgctttgagccgccccgaactaagcagggcggtcgggggagtcatactccatgggtttatgtgataaatgatcttggcatagaagagaatttaaagagtgatggcttcattccagcgctccaatagtcatgacaaagtaaggagaatagttgcagaggagggtcgtacagcaagaaacctaatagcttggagtgttccactagaaagcaaagatgatgatggaaaacctaaatgtcaaactggtggaaaatctaagaggaccattcaaggcactcataaaactactaaacagagtactgcagtggactgtaaaataacatcgtctacgactggagataaacactttgataaaagtcccactaaaacaaggcaccctcggaaaattgatctaagagctcgatactgggcatttctttttgataatcttcgccgagcagtagatgaaatctatgtaacttgcgaatcagatcagagtgtggtcgaatgtaaggaggtgctaatgatgctggataactatgtaagagatttcaaagcattgattgactggattcagcttcaggaaaagctagagaagacagatgctcaaagcagaccaacatcattggcatgggaagtaaagaagatgtctccgggacgccatgtgattccaagtccatcaacagatagaataaatgtaacatcaaatgctcgacgaagcttaaattttggaggttcaactggcacagtgccagctcctcgtctggctcccacaggtgtcagttgggctgacaaggtaaaggctcatcatacaggctctactgcttcttcagaaataacacccgcccagtcttgcccaccaatgacagtgcagaaggcctcacgcaaaaatgaacggaaagatgctgaaggatgggagaccgttcagagaggaaggcctattcgttctcgatcaacagcagtgatgccaaaagtttcattggcaacagaagccacaagatcaaaggatgacagtgataaagaaaatgtatgtcttttacctgatgaaagcatacagaaaggtcaatttgttggagatggaacttctaatactatagaatctcatcccaaagactcattacactcttgtgaccatcctcttgccgaaaaaacccagttcacagtgagtacattggatgatgtgaagaattctggcagtattcgagacaattatgttcgaacttctgaaatatctgctgtccacattgatacagagtgtgtttcagttatgctgcaagctggtacacctcctttacaagtaaatgaagaaaaatttccagcagagaaagcaaggatagaaaatgaaatggacccttcagatatttcaaattccatggcagaagtccttgctaaaaaagaagagctagcagatcgtctagaaaaggccaatgaagaagccattgctagtgctattgctgaagaagaacagttaactagagaaattgaagctgaagaaaacaatgatattaacattgaaactgacaacgacagtgatttttctgccagcatgggcagtgggagtgtttctttctgtggtatgtccatggactggaacgatgtccttgcagattatgaagctcgtgagtcttggcgccaaaatacatcctggggggacattgtagaagaagaacctgctagacctccagggcatggaattcacatgcatgaaaaactttcttcaccctctcgtaaaagaacaattgcagaatctaagaagaaacatgaagaaaaacaaatgaaagcacagcagctaagggaaaagttacgcgaagagaaaacattgaagcttcagaaattgttagaaagggagaaggatgtccggaagtggaaggaagaattgctagatcaacgacgcaggatgatggaagaaaaattacttcatgctgagtttaagcgagaagtgcagttacaagcaattgtgaaaaaagcacaagaagaagaagctaaggtaaatgaaattgcctttataaatacccttgaagcccagaataaacgtcatgatgttttatcaaaattgaaggaatatgaacagaggcttaatgagctacaggaagagcgtcagagaagacaggaagaaaagcaagcacgtgatgaagctgtgcaggaacgcaagagagctctagaggcagagcggcaggcccgtgtagaagaattgttaatgaagaggaaagaacaagaagcccgaattgaacaacagaggcaagaaaaggaaaaagcccgtgaggatgcagcccgggaaagagctagagacagggaagaacgattggcagcactcacagctgctcaacaagaagctatggaagagttacagaaaaaaattcagctcaagcatgatgaaagtattcgaaggcacatggaacagattgaacaaagaaaagaaaaagctgctgagctaagcagtgggcgacatgcaaatactgattatgcccccaaactgaccccttatgaaagaaagaagcagtgttctctctgcaatgtcctgatctcttcagaggtatatctttttagccatgttaaagggagaaaacaccagcaagccgtgagagagaataccagcatccaggggcgtgaactgtcagatgaagaagtggagcatctttccttgaagaagtacattattgacattgtggttgaaagtacagctccagcagaagctttgaaagatggagaagagcggcaaaaaaataaaaaaaaagccaaaaagataaaagcccggatgaacttcagggctaaggaatatgagagtttaatggaaaccaaaaattctggctctgattcaccttataaagcaaagcttcagcgattagccaaagatcttctaaaacaagtacaagttcaagacagtggctcatgggcaaacaataaagtgtctgctttggatcggaccctaggagagatcactagaatactggaaaaagagaatgtggcagatcagattgcatttcaagctgctggtggattaacagcccttgaacacatccttcaagcagtagtcccagccacaaatgtgaacacagttttaagaattcctcctaagtctctctgcaatgcaatcaatgtttacaacctcacctgcaataactgttcagaaaactgcagtgatgttctgtttagtaacaagattaccttcttaatggacctcctgatacaccagttgacggtttatgttccagatgaaaataatactattttggggagaaatacaaataaacaagtttttgaaggcttgacaactggacttctcaaagtcagtgctgtggttttgggctgcctgattgccaatcgaccagatggaaactgccagccagctaccccaaaaataccaacacaggaaatgaaaaacaaaccctcacaaggtgatccttttaacaatcgagttcaggaccttatcagctacgtggtgaacatgggtctgattgacaaactgtgtgcctgcttcctctcggtgcaaggcccagtggatgagaatcccaagatggccatatttctgcagcatgccgcaggactcttacatgcaatgtgtacactgtgctttgctgtcactggaaggtcatacagcatatttgacaataatcgccaggatcccacagggctgacagctgctcttcaggcaaccgacctggctggagttcttcatatgctctactgtgtcctcttccatggcaccatcttggaccccagcactgccagtcccaaggagaattacactcaaaataccatccaagtggccattcagagtttacgtttcttcaacagctttgcagctcttcatctgcctgcttttcagtctattgtaggggcagagggcttgtcccttgcattccggcacatggccagctccctgctgggccactgcagccaagtctcctgtgaaagcctccttcatgaggtcatcgtctgtgtgggctacttcactgtcaaccacccagataaccaggtgatcgtgcagtccggccgccaccccacagtgctgcagaagctctgccagttgcccttccagtatttcagtgacccacggctgatcaaagtactgttcccttcacttatcgctgcttgttacaacaaccatcagaacaagatcattctggagcaagagatgagctgtgttttactggccactttcattcaggatttggcacagactccaggtcaagcggaaaaccagccttaccaacccaaagggaaatgccttggttcccaagactatcttgagctggctaacagatttcctcagcaggcctgggaagaagctcgacagtttttcttgaaaaaagagaaaaaataaatgttttggttgattctgt

SEQ ID NO: 313463 - DNA, 4736 bp, Homo sapiens
ccgggaagccaccccgcctctccgaggcctccctgccccgccccgtcacgcccctttcccggcgggacgctttgagccgccccgaactaagcagggcggtcgggggagtcatactccatgggtttatgtgataaatgatcttggcatagaagagaatttaaagagtgatggcttcattccagcgctccaatagtcatgacaaagtaaggagaatagttgcagaggagggtcgtacagcaagaaacctaatagcttggagtgttccactagaaagcaaagatgatgatggaaaacctaaatgtcaaactggtggaaaatctaagaggaccattcaaggcactcataaaactactaaacagagtactgcagtggactgtaaaataacatcgtctacgactggagataaacactttgataaaagtcccactaaaacaaggcaccctcggaaaattgatctaagagctcgatactgggcatttctttttgataatcttcgccgagcagtagatgaaatctatgtaacttgcgaatcagatcagagtgtggtcgaatgtaaggaggtgctaatgatgctggataactatgtaagagatttcaaagcattgattgactggattcagcttcaggaaaagctagagaagacagatgctcaaagcagaccaacatcattggcatgggaagtaaagaagatgtctccgggacgccatgtgattccaagtccatcaacagatagaataaatgtaacatcaaatgctcgacgaagcttaaattttggaggttcaactggcacagtgccagctcctcgtctggctcccacaggtgtcagttgggctgacaaggtaaaggctcatcatacaggctctactgcttcttcagaaataacacccgcccagtcttgcccaccaatgacagtgcagaaggcctcacgcaaaaatgaacggaaagatgctgaaggatgggagaccgttcagagaggaaggcctattcgttctcgatcaacagcagtgatgccaaaagtttcattggcaacagaagccacaagatcaaaggatgacagtgataaagaaaatgtatgtcttttacctgatgaaagcatacagaaaggtcaatttgttggagatggaacttctaatactatagaatctcatcccaaagactcattacactcttgtgaccatcctcttgccgaaaaaacccagttcacagtgagtacattggatgatgtgaagaattctggcagtattcgagacaattatgttcgaacttctgaaatatctgctgtccacattgatacagagtgtgtttcagttatgctgcaagctggtacacctcctttacaagtaaatgaagaaaaatttccagcagagaaagcaaggatagaaaatgaaatggacccttcagatatttcaaattccatggcagaagtccttgctaaaaaagaagagctagcagatcgtctagaaaaggccaatgaagaagccattgctagtgctattgctgaagaagaacagttaactagagaaattgaagctgaagaaaacaatgatattaacattgaaactgacaacgacagtgatttttctgccagcatgggcagtgggagtgtttctttctgtggtatgtccatggactggaacgatgtccttgcagattatgaagctcgtgagtcttggcgccaaaatacatcctggggggacattgtagaagaagaacctgctagacctccagggcatggaattcacatgcatgaaaaactttcttcaccctctcgtaaaagaacaattgcagaatctaagaagaaacatgaagaaaaacaaatgaaagcacagcagctaagggaaaagttacgcgaagagaaaacattgaagcttcagaaattgttagaaagggagaaggatgtccggaagtggaaggaagaattgctagatcaacgacgcaggatgatggaagaaaaattacttcatgctgagtttaagcgagaagtgcagttacaagcaattgtgaaaaaagcacaagaagaagaagctaaggtaaatgaaattgcctttataaatacccttgaagcccagaataaacgtcatgatgttttatcaaaattgaaggaatatgaacagaggcttaatgagctacaggaagagcgtcagagaagacaggaagaaaagcaagcacgtgatgaagctgtgcaggaacgcaagagagctctagaggcagagcggcaggcccgtgtagaagaattgttaatgaagaggaaagaacaagaagcccgaattgaacaacagaggcaagaaaaggaaaaagcccgtgaggatgcagcccgggaaagagctagagacagggaagaacgattggcagcactcacagctgctcaacaagaagctatggaagagttacagaaaaaaattcagctcaagcatgatgaaagtattcgaaggcacatggaacagattgaacaaagaaaagaaaaagctgctgagctaagcagtgggcgacatgcaaatactgattatgcccccaaactgaccccttatgaaagaaagaagcagtgttctctctgcaatgtcctgatctcttcagaggtatatctttttagccatgttaaagggagaaaacaccagcaagccgtgagagagaataccagcatccaggggcgtgaactgtcagatgaagaagtggagcatctttccttgaagaagtacattattgacattgtggttgaaagtacagctccagcagaagctttgaaagatggagaagagcggcaaaaaaataaaaaaaaagccaaaaagataaaagcccggatgaacttcagggctaaggaatatgagagtttaatggaaaccaaaaattctggctctgattcaccttataaagcaaagcttcagcgattagccaaagatcttctaaaacaagtacaagttcaagacagtggctcatgggcaaacaataaagtgtctgctttggatcggaccctaggagagatcactagaatactggaaaaagagaatgtggcagatcagattgcatttcaagctgctggtggattaacagcccttgaacacatccttcaagcagtagtcccagccacaaatgtgaacacagttttaagaattcctcctaagtctctctgcaatgcaatcaatgtttacaacctcacctgcaataactgttcagaaaactgcagtgatgttctgtttagtaacaagattaccttcttaatggacctcctgatacaccagttgacggtttatgttccagatgaaaataatactattttggggagaaatacaaataaacaagtttttgaaggcttgacaactggacttctcaaagtcagtgctgtggttttgggctgcctgattgccaatcgaccagatggaaactgccagccagctaccccaaaaataccaacacaggaaatgaaaaacaaaccctcacaaggtgatccttttaacaatcgagttcaggaccttatcagctacgtggtgaacatgggtctgattgacaaactgtgtgcctgcttcctctcggtgcaaggcccagtggatgagaatcccaagatggccatatttctgcagcatgccgcaggactcttacatgcaatgtgtacactgtgctttgctgtcactggaaggtcatacagcatatttgacaataatcgccaggatcccacagggctgacagctgctcttcaggcaaccgacctggctggagttcttcatatgctctactgtgtcctcttccatggcaccatcttggaccccagcactgccagtcccaaggagaattacactcaaaataccatccaagtggccattcagagtttacgtttcttcaacagctttgcagctcttcatctgcctgcttttcagtctattgtaggggcagagggcttgtcccttgcattccggcacatggccagctccctgctgggccactgcagccaagtctcctgtgaaagcctccttcatgaggtcatcgtctgtgtgggctacttcactgtcaaccacccagataaccaggtgatcgtgcagtccggccgccaccccacagtgctgcagaagctctgccagttgcccttccagtatttcagtgacccacggctgatcaaagtactgttcccttcacttatcgctgcttgttacaacaaccatcagaacaagatcattctggagcaagagatgagctgtgttttactggccactttcattcaggatttggcacagactccaggtcaagcggaaaaccagccttaccaacccaaagggaaatgccttggttcccaagactatcttgagctggctaacagatttcctcagcaggcctgggaagaagctcgacagtttttcttgaaaaaagagaaaaaataaatgttttggttgattctgtatttgagtacccttgttaatattttaaattgtccaaacaaacattctaattgttccttaagaactcattttcccatgtttatactcttcccacactgtagatatggcatgtactttacactatttataatgactgtagatacttgaatgttctacttgctaattttgcaagttgagtttatttcatttatgcagagtatcttggagtttggtaatttccatcttatgataatatatactttgcatttgtgatatgggtgaaaggagacataaaattagcaagtctgttttgttcttgtaataaagtaacttattctgtaaaaaaaaataaaatggccttcttggcctcat

SEQ ID NO: 313464 - DNA, 3566 bp, Homo sapiens
ccgggaagccaccccgcctctccgaggcctccctgccccgccccgtcacgcccctttcccggcgggacgctttgagccgccccgaactaagcagggcggtcgggggagtcatactccatgggtttatgtgataaatgatcttggcatagaagagaatttaaagagtgatggcttcattccagcgctccaatagtcatgacaaagtaaggagaatagttgcagaggagggtcgtacagcaagaaacctaatagcttggagtgttccactagaaagcaaagatgatgatggaaaacctaaatgtcaaactggtggaaaatctaagaggaccattcaaggcactcataaaactactaaacagagtactgcagtggactgtaaaataacatcgtctacgactggagataaacactttgataaaagtcccactaaaacaaggcaccctcggaaaattgatctaagagctcgatactgggcatttctttttgataatcttcgccgagcagtagatgaaatctatgtaacttgcgaatcagatcagagtgtggtcgaatgtaaggaggtgctaatgatgctggataactatgtaagagatttcaaagcattgattgactggattcagcttcaggaaaagctagagaagacagatgctcaaagcagaccaacatcattggcatgggaagtaaagaagatgtctccgggacgccatgtgattccaagtccatcaacagatagaataaatgtaacatcaaatgctcgacgaagcttaaattttggaggttcaactggcacagtgccagctcctcgtctggctcccacaggtgtcagttgggctgacaaggtaaaggctcatcatacaggctctactgcttcttcagaaataacacccgcccagtcttgcccaccaatgacagtgcagaaggcctcacgcaaaaatgaacggaaagatgctgaaggatgggagaccgttcagagaggaaggcctattcgttctcgatcaacagcagtgatgccaaaagtttcattggcaacagaagccacaagatcaaaggatgacagtgataaagaaaatgtatgtcttttacctgatgaaagcatacagaaaggtcaatttgttggagatggaacttctaatactatagaatctcatcccaaagactcattacactcttgtgaccatcctcttgccgaaaaaacccagttcacagtgagtacattggatgatgtgaagaattctggcagtattcgagacaattatgttcgaacttctgaaatatctgctgtccacattgatacagagtgtgtttcagttatgctgcaagctggtacacctcctttacaagtaaatgaagaaaaatttccagcagagaaagcaaggatagaaaatgaaatggacccttcagatatttcaaattccatggcagaagtccttgctaaaaaagaagagctagcagatcgtctagaaaaggccaatgaagaagccattgctagtgctattgctgaagaagaacagttaactagagaaattgaagctgaagaaaacaatgatattaacattgaaactgacaacgacagtgatttttctgccagcatgggcagtgggagtgtttctttctgtggtatgtccatggactggaacgatgtccttgcagattatgaagctcgtgagtcttggcgccaaaatacatcctggggggacattgtagaagaagaacctgctagacctccagggcatggaattcacatgcatgaaaaactttcttcaccctctcgtaaaagaacaattgcagaatctaagaagaaacatgaagaaaaacaaatgaaagcacagcagctaagggaaaagttacgcgaagagaaaacattgaagcttcagaaattgttagaaagggagaaggatgtccggaagtggaaggaagaattgctagatcaacgacgcaggatgatggaagaaaaattacttcatgctgagtttaagcgagaagtgcagttacaagcaattgtgaaaaaagcacaagaagaagaagctaaggtaaatgaaattgcctttataaatacccttgaagcccagaataaacgtcatgatgttttatcaaaattgaaggaatatgaacagaggcttaatgagctacaggaagagcgtcagagaagacaggaagaaaagcaagcacgtgatgaagctgtgcaggaacgcaagagagctctagaggcagagcggcaggcccgtgtagaagaattgttaatgaagaggaaagaacaagaagcccgaattgaacaacagaggcaagaaaaggaaaaagcccgtgaggatgcagcccgggaaagagctagagacagggaagaacgattggcagcactcacagctgctcaacaagaagctatggaagagttacagaaaaaaattcagctcaagcatgatgaaagtattcgaaggcacatggaacagattgaacaaagaaaagaaaaagctgctgagctaagcagtgggcgacatgcaaatactgattatgcccccaaactgaccccttatgaaagaaagaagcagtgttctctctgcaatgtcctgatctcttcagaggtatatctttttagccatgttaaagggagaaaacaccagcaagccgtgagagagaataccagcatccaggggcgtgaactgtcagatgaagaagtggagcatctttccttgaagaagtacattattgacattgtggttgaaagtacagctccagcagaagctttgaaagatggagaagagcggcaaaaaaataaaaaaaaagccaaaaagataaaagcccggatgaacttcagggctaaggaatatgagagtttaatggaaaccaaaaattctggctctgattcaccttataaagcaaagcttcagcgattagccaaagatcttctaaaacaagtacaagttcaagacagtggctcatgggcaaacaataaagtgtctgctttggatcggaccctaggagagatcactagaatactggaaaaagagaatgtggcagatcagattgcatttcaagctgctggtggattaacagcccttgaacacatccttcaagcagtagtcccagccacaaatgtgaacacagttttaagaattcctcctaagtctctctgcaatgcaatcaatgtttacaacctcacctgcaataactgttcagaaaactgcagtgatgttctgtttagtaacaagattaccttcttaatggacctcctgatacaccagttgacgcagaggccagaagacagtgaccatctttagagtgcttaaagaagaaacaaacatcaatctggaattctatatccatcaaaatatccttcaagaataaatgtgaaataaatacattttcatattaaatatatatacacctccgagaatttgttgacaacagacctgcactactagaaatgctaaaggaagttcttcaggctgaagggaaatgatacccagtgaaaatttctatcttcaggaaatgataaagagcagtggaaacagactctgtatttattttaaaattttaaaaaatacatgtgatggttaaattttactttaaaa

SEQ ID NO: 313465 - DNA, 1256 bp, Homo sapiens
gtggtttatgaagatggaatggatggcacttcatgcccacacaaatcatgctgtttttgcccagctgtactctcctttaaggtcatacagcatatttgacaataatcgccaggatcccacagggctgacagctgctcttcaggcaaccgacctggctggagttcttcatatgctctactgtgtcctcttccatggcaccatcttggaccccagcactgccagtcccaaggagaattacactcaaaataccatccaagtggccattcagagtttacgtttcttcaacagctttgcagctcttcatctgcctgcttttcagtctattgtaggggcagagggcttgtcccttgcattccggcacatggccagctccctgctgggccactgcagccaagtctcctgtgaaagcctccttcatgaggtcatcgtctgtgtgggctacttcactgtcaaccacccagataaccaggtgatcgtgcagtccggccgccaccccacagtgctgcagaagctctgccagttgcccttccagtatttcagtgacccacggctgatcaaagtactgttcccttcacttatcgctgcttgttacaacaaccatcagaacaagatcattctggagcaagagatgagctgtgttttactggccactttcattcaggatttggcacagactccaggtcaagcggaaaaccagccttaccaacccaaagggaaatgccttggttcccaagactatcttgagctggctaacagatttcctcagcaggcctgggaagaagctcgacagtttttcttgaaaaaagagaaaaaataaatgttttggttgattctgtatttgagtacccttgttaatattttaaattgtccaaacaaacattctaattgttccttaagaactcattttcccatgtttatactcttcccacactgtagatatggcatgtactttacactatttataatgactgtagatacttgaatgttctacttgctaattttgcaagttgagtttatttcatttatgcagagtatcttggagtttggtaatttccatcttatgataatatatactttgcatttgtgatatgggtgaaaggagacataaaattagcaagtctgttttgttcttgtaataaagtaacttattctgttttcattgttgacttttcatgttaaggaaatacgaatctgaaagaaaaatgttaactccagctcttgaagtatcttaaataaagacttaattaaagtttacc

SEQ ID NO: 313466 - DNA, 1990 bp, Homo sapiens
ccgggaagccaccccgcctctccgaggcctccctgccccgccccgtcacgcccctttcccggcgggacgctttgagccgccccgaactaagcagggcggtcgggggagtcatactccatgggtttatgtgataaatgatcttggcatagaagagaatttaaagagtgatggcttcattccagcgctccaatagtcatgacaaagtaaggagaatagttgcagaggagggtcgtacagcaagaaacctaatagcttggagtgttccactagaaagcaaagatgatgatggaaaacctaaatgtcaaactggtggaaaatctaagaggaccattcaaggcactcataaaactactaaacagagtactgcagtggactgtaaaataacatcgtctacgactggagataaacactttgataaaagtcccactaaaacaaggcaccctcggaaaattgatctaagagctcgatactgggcatttctttttgataatcttcgccgagcagtagatgaaatctatgtaacttgcgaatcagatcagagtgtggtcgaatgtaaggaggtgctaatgatgctggataactatgtaagagatttcaaagcattgattgactggattcagcttcaggaaaagctagagaagacagatgctcaaagcagaccaacatcattggcatgggaagtaaagaagatgtctccgggacgccatgtgattccaagtccatcaacagatagaataaatgtaacatcaaatgctcgacgaagcttaaattttggaggttcaactggcacagtgccagctcctcgtctggctcccacaggtgtcagttgggctgacaaggtaaaggctcatcatacaggctctactgcttcttcagaaataacacccgcccagtcttgcccaccaatgacagtgcagaaggcctcacgcaaaaatgaacggaaagatgctgaaggatgggagaccgttcagagaggaaggcctattcgttctcgatcaacagcagtgatgccaaaagtttcattggcaacagaagccacaagatcaaaggatgacagtgataaagaaaatgtatgtcttttacctgatgaaagcatacagaaaggtcaatttgttggagatggaacttctaatactatagaatctcatcccaaagactcattacactcttgtgaccatcctcttgccgaaaaaacccagttcacagtgagtacattggatgatgtgaagaattctggcagtattcgagacaattatgttcgaacttctgaaatatctgctgtccacattgatacagagtgtgtttcagttatgctgcaagctggtacacctcctttacaagtaaatgaagaaaaatttccagcagagaaagcaaggatagaaaatgaaatggacccttcagatatttcaaattccatggcagaagtccttgctaaaaaagaagagctagcagatcgtctagaaaaggccaatgaagaagccattgctagtgctattgctgaagaagaacagttaactagagaaattgaagctgaagaaaacaatgatattaacattgaaactgacaacgacagtgatttttctgccagcatgggcagtgggagtgtttctttctgtggtatgtccatggactggaacgatgtccttgcagattatgaagctcgtgagtcttggcgccaaaatacatcctggggggacattgtagaagaagaacctgctagacctccagggcatggaattcacatgcatgaaaaactttcttcaccctctcgtaaaagaacaattgcagaatctaagaagaaacatgaagaaaaacaaatgaaagcacagcagctaagggaaaagttacgcgaagagaaaacattgaagcttcagaaattgttagaaaggggttgatttagtaagaagaaccttatcagatgccaccaccttgatattggacttccagtctccagaactattatacgataaataaagttctttttttaata

SEQ ID NO: 313467 - DNA, 427 bp, Homo sapiens
tttaagactaatatgtaaatactaggtggatctcaactcacatatcatatactggactgaatgtgtagtgtttaaaattcatataatgttatattgattacattgctttgattttgtgctttcagatctcttcagaggtatatctttttagccatgttaaagggagaaaacaccagcaagccgtgagagagaataccagcatccaggggcgtgaactgtcagatgaagaagtggtaaactttatttttgttcatttacaattgtttattgagtacccaatatgtgctgttttattataaagaattccgtgtttgtatttatttctatgattatttaaaactatatttagcacttaatagctactacaatatagtgtacaaatgtgtcattattttagtgtatatattaatttaacaagaaagataga

SEQ ID NO: 313468 - DNA, 4806 bp, Homo sapiens
ccgggaagccaccccgcctctccgaggcctccctgccccgccccgtcacgcccctttcccggcgggacgctttgagccgccccgaactaagcagggcggtcgggggagtcatactccatgggtttatgtgataaatgatcttggcatagaagagaatttaaagagtgatggcttcattccagcgctccaatagtcatgacaaagtaaggagaatagttgcagaggagggtcgtacagcaagaaacctaatagcttggagtgttccactagaaagcaaagatgatgatggaaaacctaaatgtcaaactggtggaaaatctaagaggaccattcaaggcactcataaaactactaaacagagtactgcagtggactgtaaaataacatcgtctacgactggagataaacactttgataaaagtcccactaaaacaaggcaccctcggaaaattgatctaagagctcgatactgggcatttctttttgataatcttcgccgagcagtagatgaaatctatgtaacttgcgaatcagatcagagtgtggtcgaatgtaaggaggtgctaatgatgctggataactatgtaagagatttcaaagcattgattgactggattcagcttcaggaaaagctagagaagacagatgctcaaagcagaccaacatcattggcatgggaagtaaagaagatgtctccgggacgccatgtgattccaagtccatcaacagatagaataaatgtaacatcaaatgctcgacgaagcttaaattttggaggttcaactggcacagtgccagctcctcgtctggctcccacaggtgtcagttgggctgacaaggtaaaggctcatcatacaggctctactgcttcttcagaaataacacccgcccagtcttgcccaccaatgacagtgcagaaggcctcacgcaaaaatgaacggaaagatgctgaaggatgggagaccgttcagagaggaaggcctattcgttctcgatcaacagcagtgatgccaaaagtttcattggcaacagaagccacaagatcaaaggatgacagtgataaagaaaatgtatgtcttttacctgatgaaagcatacagaaaggtcaatttgttggagatggaacttctaatactatagaatctcatcccaaagactcattacactcttgtgaccatcctcttgccgaaaaaacccagttcacagtgagtacattggatgatgtgaagaattctggcagtattcgagacaattatgttcgaacttctgaaatatctgctgtccacattgatacagagtgtgtttcagttatgctgcaagctggtacacctcctttacaagtaaatgaagaaaaatttccagcagagaaagcaaggatagaaaatgaaatggacccttcagatatttcaaattccatggcagaagtccttgctaaaaaagaagagctagcagatcgtctagaaaaggccaatgaagaagccattgctagtgctattgctgaagaagaacagttaactagagaaattgaagctgaagaaaacaatgatattaacattgaaactgacaacgacagtgatttttctgccagcatgggcagtgggagtgtttctttctgtggtatgtccatggactggaacgatgtccttgcagattatgaagctcgtgagtcttggcgccaaaatacatcctggggggacattgtagaagaagaacctgctagacctccagggcatggaattcacatgcatgaaaaactttcttcaccctctcgtaaaagaacaattgcagaatctaagaagaaacatgaagaaaaacaaatgaaagcacagcagctaagggaaaagttacgcgaagagaaaacattgaagcttcagaaattgttagaaagggagaaggatgtccggaagtggaaggaagaattgctagatcaacgacgcaggatgatggaagaaaaattacttcatgctgagtttaagcgagaagtgcagttacaagcaattgtgaaaaaagcacaagaagaagaagctaaggtaaatgaaattgcctttataaatacccttgaagcccagaataaacgtcatgatgttttatcaaaattgaaggaatatgaacagaggcttaatgagctacaggaagagcgtcagagaagacaggaagaaaagcaagcacgtgatgaagctgtgcaggaacgcaagagagctctagaggcagagcggcaggcccgtgtagaagaattgttaatgaagaggaaagaacaagaagcccgaattgaacaacagaggcaagaaaaggaaaaagcccgtgaggatgcagcccgggaaagagctagagacagggaagaacgattggcagcactcacagctgctcaacaagaagctatggaagagttacagaaaaaaattcagctcaagcatgatgaaagtattcgaaggcacatggaacagattgaacaaagaaaagaaaaagctgctgagctaagcagtgggcgacatgcaaatactgattatgcccccaaactgaccccttatgaaagaaagaagcagtgttctctctgcaatgtcctgatctcttcagaggtatatctttttagccatgttaaagggagaaaacaccagcaagccgtgagagagaataccagcatccaggggcgtgaactgtcagatgaagaagtggagcatctttccttgaagaagtacattattgacattgtggttgaaagtacagctccagcagaagctttgaaagatggagaagagcggcaaaaaaataaaaaaaaagccaaaaagataaaagcccggatgaacttcagggctaaggaatatgagagtttaatggaaaccaaaaattctggctctgattcaccttataaagcaaagcttcagcgattagccaaagatcttctaaaacaagtacaagttcaagacagtggctcatgggcaaacaataaagtgtctgctttggatcggaccctaggagagatcactagaatactggaaaaagagaatgtggcagatcagattgcatttcaagctgctggtggattaacagcccttgaacacatccttcaagcagtagtcccagccacaaatgtgaacacagttttaagaattcctcctaagtctctctgcaatgcaatcaatgtttacaacctcacctgcaataactgttcagaaaactgcagtgatgttctgtttagtaacaagattaccttcttaatggacctcctgatacaccagttgacggtttatgttccagatgaaaataatactattttggggagaaatacaaataaacaagtttttgaaggcttgacaactggacttctcaaagtcagtgctgtggttttgggctgcctgattgccaatcgaccagatggaaactgccagccagctaccccaaaaataccaacacaggaaatgaaaaacaaaccctcacaaggtgatccttttaacaatcgagttcaggaccttatcagctacgtggtgaacatgggtctgattgacaaactgtgtgcctgcttcctctcggtgcaaggcccagtggatgagaatcccaagatggccatatttctgcagcatgccgcaggactcttacatgcaatgtgtacactgtgctttgctgtcactggaaggtcatacagcatatttgacaataatcgccaggatcccacagggctgacagctgctcttcaggcaaccgacctggctggagttcttcatatgctctactgtgtcctcttccatggcaccatcttggaccccagcactgccagtcccaaggagaattacactcaaaataccatccaagtggccattcagagtttacgtttcttcaacagctttgcagctcttcatctgcctgcttttcagtctattgtaggggcagagggcttgtcccttgcattccggcacatggccagctccctgctgggccactgcagccaagtctcctgtgaaagcctccttcatgaggtcatcgtctgtgtgggctacttcactgtcaaccacccagataaccaggtgatcgtgcagtccggccgccaccccacagtgctgcagaagctctgccagttgcccttccagtatttcagtgacccacggctgatcaaagtactgttcccttcacttatcgctgcttgttacaacaaccatcagaacaagatcattctggagcaagagatgagctgtgttttactggccactttcattcaggatttggcacagactccaggtcaagcggaaaaccagccttaccaacccaaagggaaatgccttggttcccaagactatcttgagctggctaacagatttcctcagcaggcctgggaagaagctcgacagtttttcttgaaaaaagagaaaaaataaatgttttggttgattctgtatttgagtacccttgttaatattttaaattgtccaaacaaacattctaattgttccttaagaactcattttcccatgtttatactcttcccacactgtagatatggcatgtactttacactatttataatgactgtagatacttgaatgttctacttgctaattttgcaagttgagtttatttcatttatgcagagtatcttggagtttggtaatttccatcttatgataatatatactttgcatttgtgatatgggtgaaaggagacataaaattagcaagtctgttttgttcttgtaataaagtaacttattctgttttcattgttgacttttcatgttaaggaaatacgaatctgaaagaaaaatgttaactccagctcttgaagtatcttaaataaagacttaattaaagtttacc

SEQ ID NO: 313469 - DNA, 4656 bp, Homo sapiens
ccgggaagccaccccgcctctccgaggcctccctgccccgccccgtcacgcccctttcccggcgggacgctttgagccgccccgaactaagcagggcggtcgggggagtcatactccatgggtttatgtgataaatgatcttggcatagaagagaatttaaagagtgatggcttcattccagcgctccaatagtcatgacaaagtaaggagaatagttgcagaggagggtcgtacagcaagaaacctaatagcttggagtgttccactagaaagcaaagatgatgatggaaaacctaaatgtcaaactggtggaaaatctaagaggaccattcaaggcactcataaaactactaaacagagtactgcagtggactgtaaaataacatcgtctacgactggagataaacactttgataaaagtcccactaaaacaaggcaccctcggaaaattgatctaagagctcgatactgggcatttctttttgataatcttcgccgagcagtagatgaaatctatgtaacttgcgaatcagatcagagtgtggtcgaatgtaaggaggtgctaatgatgctggataactatgtaagagatttcaaagcattgattgactggattcagcttcaggaaaagctagagaagacagatgctcaaagcagaccaacatcattggcatgggaagtaaagaagatgtctccgggacgccatgtgattccaagtccatcaacagatagaataaatgtaacatcaaatgctcgacgaagcttaaattttggaggttcaactggcacagtgccagctcctcgtctggctcccacaggtgtcagttgggctgacaaggtaaaggctcatcatacaggctctactgcttcttcagaaataacacccgcccagtcttgcccaccaatgacagtgcagaaggcctcacgcaaaaatgaacggaaagatgctgaaggatgggagaccgttcagagaggaaggcctattcgttctcgatcaacagcagtgatgccaaaagtttcattggcaacagaagccacaagatcaaaggatgacagtgataaagaaaatgtatgtcttttacctgatgaaagcatacagaaaggtcaatttgttggagatggaacttctaatactatagaatctcatcccaaagactcattacactcttgtgaccatcctcttgccgaaaaaacccagttcacagtgagtacattggatgatgtgaagaattctggcagtattcgagacaattatgttcgaacttctgaaatatctgctgtccacattgatacagagtgtgtttcagttatgctgcaagctggtacacctcctttacaagtaaatgaagaaaaatttccagcagagaaagcaaggatagaaaatgaaatggacccttcagatatttcaaattccatggcagaagtccttgctaaaaaagaagagctagcagatcgtctagaaaaggccaatgaagaagccattgctagtgctattgctgaagaagaacagttaactagagaaattgaagctgaagaaaacaatgatattaacattgaaactgacaacgacagtgatttttctgccagcatgggcagtgggagtgtttctttctgtggtatgtccatggactggaacgatgtccttgcagattatgaagctcgtgagtcttggcgccaaaatacatcctggggggacattgtagaagaagaacctgctagacctccagggcatggaattcacatgcatgaaaaactttcttcaccctctcgtaaaagaacaattgcagaatctaagaagaaacatgaagaaaaacaaatgaaagcacagcagctaagggaaaagttacgcgaagagaaaacattgaagcttcagaaattgttagaaagggagaaggatgtccggaagtggaaggaagaattgctagatcaacgacgcaggatgatggaagaaaaattacttcatgctgagtttaagcgagaagtgcagttacaagcaattgtgaaaaaagcacaagaagaagaagctaaggtaaatgaaattgcctttataaatacccttgaagcccagaataaacgtcatgatgttttatcaaaattgaaggaatatgaacagaggcttaatgagctacaggaagagcgtcagagaagacaggaagaaaagcaagcacgtgatgaagctgtgcaggaacgcaagagagctctagaggcagagcggcaggcccgtgtagaagaattgttaatgaagaggaaagaacaagaagcccgaattgaacaacagaggcaagaaaaggaaaaagcccgtgaggatgcagcccgggaaagagctagagacagggaagaacgattggcagcactcacagctgctcaacaagaagctatggaagagttacagaaaaaaattcagctcaagcatgatgaaagtattcgaaggcacatggaacagattgaacaaagaaaagaaaaagctgctgagctaagcagtgggcgacatgcaaatactgattatgcccccaaactgaccccttatgaaagaaagaagcagtgttctctctgcaatgtcctgatctcttcagaggtatatctttttagccatgttaaagggagaaaacaccagcaagccgtgagagagaataccagcatccaggggcgtgaactgtcagatgaagaagtggagcatctttccttgaagaagtacattattgacattgtggttgaaagtacagctccagcagaagctttgaaagatggagaagagcggcaaaaaaataaaaaaaaagccaaaaagataaaagcccggatgaacttcagggctaaggaatatgagagtttaatggaaaccaaaaattctggctctgattcaccttataaagcaaagcttcagcgattagccaaagatcttctaaaacaagtacaagttcaagacagtggctcatgggcaaacaataaagtgtctgctttggatcggaccctaggagagatcactagaatactggaaaaagagaatgtggcagatcagattgcatttcaagctgctggtggattaacagcccttgaacacatccttcaagcagtagtcccagccacaaatgtgaacacagttttaagaattcctcctaagtctctctgcaatgcaatcaatgtttacaacctcacctgcaataactgttcagaaaactgcagtgatgttctgtttagtaacaagattaccttcttaatggacctcctgatacaccagttgacggtttatgttccagatgaaaataatactattttggggagaaatacaaataaacaagtttttgaaggcttgacaactggacttctcaaagtcagtgctgtggttttgggctgcctgattgccaatcgaccagatggaaactgccagccagctaccccaaaaataccaacacaggaaatgaaaaacaaaccctcacaaggtgatccttttaacaatcgagttcaggaccttatcagctacgtggtgaacatgggtctgattgacaaactgtgtgcctgcttcctctcggtgcaaggcccagtggatgagaatcccaagatggccatatttctgcagcatgccgcaggactcttacatgcaatgtgtacactgtgctttgctgtcactggaaggtcatacagcatatttgacaataatcgccaggatcccacagggctgacagctgctcttcaggcaaccgacctggctggagttcttcatatgctctactgtgtcctcttccatggcaccatcttggaccccagcactgccagtcccaaggagaattacactcaaaataccatccaagtggccattcagagtttacgtttcttcaacagctttgcagctcttcatctgcctgcttttcaggtgatcgtgcagtccggccgccaccccacagtgctgcagaagctctgccagttgcccttccagtatttcagtgacccacggctgatcaaagtactgttcccttcacttatcgctgcttgttacaacaaccatcagaacaagatcattctggagcaagagatgagctgtgttttactggccactttcattcaggatttggcacagactccaggtcaagcggaaaaccagccttaccaacccaaagggaaatgccttggttcccaagactatcttgagctggctaacagatttcctcagcaggcctgggaagaagctcgacagtttttcttgaaaaaagagaaaaaataaatgttttggttgattctgtatttgagtacccttgttaatattttaaattgtccaaacaaacattctaattgttccttaagaactcattttcccatgtttatactcttcccacactgtagatatggcatgtactttacactatttataatgactgtagatacttgaatgttctacttgctaattttgcaagttgagtttatttcatttatgcagagtatcttggagtttggtaatttccatcttatgataatatatactttgcatttgtgatatgggtgaaaggagacataaaattagcaagtctgttttgttcttgtaataaagtaacttattctgttttcattgttgacttttcatgttaaggaaatacgaatctgaaagaaaaatgttaactccagctcttgaagtatcttaaataaagacttaattaaagtttacc

SEQ ID NO: 313470 - DNA, 2140 bp, Homo sapiens
gcttgaatccgggaggcagaggttgcattgagccgagatcgtgccatcgcactctagcctgggcaacagagtgagactccatctcaaaataaacaaaaaaataaaaaaaaagccaaaaagataaaagcccggatgaacttcagggctaaggaatatgagagtttaatggaaaccaaaaattctggctctgattcaccttataaagcaaagcttcagcgattagccaaagatcttctaaaacaagtacaagttcaagacagtggctcatgggcaaacaataaagtgtctgctttggatcggaccctaggagagatcactagaatactggaaaaagagaatgtggcagatcagattgcatttcaagctgctggtggattaacagcccttgaacacatccttcaagcagtagtcccagccacaaatgtgaacacagttttaagaattcctcctaagtctctctgcaatgcaatcaatgtttacaacctcacctgcaataactgttcagaaaactgcagtgatgttctgtttagtaacaagattaccttcttaatggacctcctgatacaccagttgacggtttatgttccagatgaaaataatactattttggggagaaatacaaataaacaagtttttgaaggcttgacaactggacttctcaaagtcagtgctgtggttttgggctgcctgattgccaatcgaccagatggaaactgccagccagctaccccaaaaataccaacacaggaaatgaaaaacaaaccctcacaaggtgatccttttaacaatcgagttcaggaccttatcagctacgtggtgaacatgggtctgattgacaaactgtgtgcctgcttcctctcggtgcaaggcccagtggatgagaatcccaagatggccatatttctgcagcatgccgcaggactcttacatgcaatgtgtacactgtgctttgctgtcactggaaggtcatacagcatatttgacaataatcgccaggatcccacagggctgacagctgctcttcaggcaaccgacctggctggagttcttcatatgctctactgtgtcctcttccatggcaccatcttggaccccagcactgccagtcccaaggagaattacactcaaaataccatccaagtggccattcagagtttacgtttcttcaacagctttgcagctcttcatctgcctgcttttcagtctattgtaggggcagagggcttgtcccttgcattccggcacatggccagctccctgctgggccactgcagccaagtctcctgtgaaagcctccttcatgaggtcatcgtctgtgtgggctacttcactgtcaaccacccagataaccaggtgatcgtgcagtccggccgccaccccacagtgctgcagaagctctgccagttgcccttccagtatttcagtgacccacggctgatcaaagtactgttcccttcacttatcgctgcttgttacaacaaccatcagaacaagatcattctggagcaagagatgagctgtgttttactggccactttcattcaggatttggcacagactccaggtcaagcggaaaaccagccttaccaacccaaagggaaatgccttggttcccaagactatcttgagctggctaacagatttcctcagcaggcctgggaagaagctcgacagtttttcttgaaaaaagagaaaaaataaatgttttggttgattctgtatttgagtacccttgttaatattttaaattgtccaaacaaacattctaattgttccttaagaactcattttcccatgtttatactcttcccacactgtagatatggcatgtactttacactatttataatgactgtagatacttgaatgttctacttgctaattttgcaagttgagtttatttcatttatgcagagtatcttggagtttggtaatttccatcttatgataatatatactttgcatttgtgatatgggtgaaaggagacataaaattagcaagtctgttttgttcttgtaataaagtaacttattctgttttcattgttgacttttcatgttaaggaaatacgaatctgaaagaaaaatgttaactccagctcttgaagtatcttaaataaagacttaattaaagtttacc

SEQ ID NO: 313471 - DNA, 4754 bp, Homo sapiens
ccgggaagccaccccgcctctccgaggcctccctgccccgccccgtcacgcccctttcccggcgggacgctttgagccgccccgaactaagcagggcggtcgggggagtcatactccatgggtttatgtgataaatgatcttggcatagaagagaatttaaagagtgatggcttcattccagcgctccaatagtcatgacaaagtaaggagaatagttgcagaggagggtcgtacagcaagaaacctaatagcttggagtgttccactagaaagcaaagatgatgatggaaaacctaaatgtcaaactggtggaaaatctaagaggaccattcaaggcactcataaaactactaaacagagtactgcagtggactgtaaaataacatcgtctacgactggagataaacactttgataaaagtcccactaaaacaaggcaccctcggaaaattgatctaagagctcgatactgggcatttctttttgataatcttcgccgagcagtagatgaaatctatgtaacttgcgaatcagatcagagtgtggtcgaatgtaaggaggtgctaatgatgctggataactatgtaagagatttcaaagcattgattgactggattcagcttcaggaaaagctagagaagacagatgctcaaagcagaccaacatcattggcatgggaagtaaagaagatgtctccgggacgccatgtgattccaagtccatcaacagatagaataaatgtaacatcaaatgctcgacgaagcttaaattttggaggttcaactggcacagtgccagctcctcgtctggctcccacaggtgtcagttgggctgacaaggtaaaggctcatcatacaggctctactgcttcttcagaaataacacccgcccagtcttgcccaccaatgacagtgcagaaggcctcacgcaaaaatgaacggaaagatgctgaaggatgggagaccgttcagagaggaaggcctattcgttctcgatcaacagcagtgatgccaaaagtttcattggcaacagaagccacaagatcaaaggatgacagtgataaagaaaatgtatgtcttttacctgatgaaagcatacagaaaggtcaatttgttggagatggaacttctaatactatagaatctcatcccaaagactcattacactcttgtgaccatcctcttgccgaaaaaacccagttcacagtgagtacattggatgatgtgaagaattctggcagtattcgagacaattatgttcgaacttctgaaatatctgctgtccacattgatacagagtgtgtttcagttatgctgcaagctggtacacctcctttacaagtaaatgaagaaaaatttccagcagagaaagcaaggatagaaaatgaaatggacccttcagatatttcaaattccatggcagaagtccttgctaaaaaagaagagctagcagatcgtctagaaaaggccaatgaagaagccattgctagtgctattgctgaagaagaacagttaactagagaaattgaagctgaagaaaacaatgatattaacattgaaactgacaacgacagtgatttttctgccagcatgggcagtgggagtgtttctttctgtggtatgtccatggactggaacgatgtccttgcagattatgaagctcgtgagtcttggcgccaaaatacatcctggggggacattgtagaagaagaacctgctagacctccagggcatggaattcacatgcatgaaaaactttcttcaccctctcgtaaaagaacaattgcagaatctaagaagaaacatgaagaaaaacaaatgaaagcacagcagctaagggaaaagttacgcgaagagaaaacattgaagcttcagaaattgttagaaagggagaaggatgtccggaagtggaaggaagaattgctagatcaacgacgcaggatgatggaagaaaaattacttcatgctgagtttaagcgagaagtgcagttacaagcaattgtgaaaaaagcacaagaagaagaagctaaggtaaatgaaattgcctttataaatacccttgaagcccagaataaacgtcatgatgttttatcaaaattgaaggaatatgaacagaggcttaatgagctacaggaagagcgtcagagaagacaggaagaaaagcaagcacgtgatgaagctgtgcaggaacgcaagagagctctagaggcagagcggcaggcccgtgtagaagaattgttaatgaagaggaaagaacaagaagcccgaattgaacaacagaggcaagaaaaggaaaaagcccgtgaggatgcagcccgggaaagagctagagacagggaagaacgattggcagcactcacagctgctcaacaagaagctatggaagagttacagaaaaaaattcagctcaagcatgatgaaagtattcgaaggcacatggaacagattgaacaaagaaaagaaaaagctgctgagctaagcagtgggcgacatgcaaatactgattatgcccccaaactgaccccttatgaaagaaagaagcagtgttctctctgcaatgtcctgatctcttcagaggtatatctttttagccatgttaaagggagaaaacaccagcaagccgtgagagagaataccagcatccaggggcgtgaactgtcagatgaagaagtggagcatctttccttgaagaagtacattattgacattgtggttgaaagtacagctccagcagaagctttgaaagatggagaagagcggcaaaaaaataaaaaaaaagccaaaaagataaaagcccggatgaacttcagggctaaggaatatgagagtttaatggaaaccaaaaattctggctctgattcaccttataaagcaaagcttcagcgattagccaaagatcttctaaaacaagtacaagttcaagacagtggctcatgggcaaacaataaagtgtctgctttggatcggaccctaggagagatcactagaatactggaaaaagagaatgtggcagatcagattgcatttcaagctgctggtggattaacagcccttgaacacatccttcaagcagtagtcccagccacaaatgtgaacacagttttaagaattcctcctaagtctctctgcaatgcaatcaatgtttacaacctcacctgcaataactgttcagaaaactgcagtgatgttctgtttagtaacaagattaccttcttaatggacctcctgatacaccagttgacggtttatgttccagatgaaaataatactattttggggagaaatacaaataaacaagtttttgaaggcttgacaactggacttctcaaagtcagtgctgtggttttgggctgcctgattgccaatcgaccagatggaaactgccagccagctaccccaaaaataccaacacaggaaatgaaaaacaaaccctcacaaggtgatccttttaacaatcgagttcaggaccttatcagctacgtggtgaacatgggtctgattgacaaactgtgtgcctgcttcctctcggtgcaaggcccagtggatgagaatcccaagatggccatatttctgcagcatgccgcaggactcttacatgcaatgtgtacactgtgctttgctgtcactggaaggtcatacagcatatttgacaataatcgccaggatcccacagggctgacagctgctcttcaggcaaccgacctggctggagttcttcatatgctctactgtgtcctcttccatggcaccatcttggaccccagcactgccagtcccaaggagaattacactcaaaataccatccaagtggccattcagagtttacgtttcttcaacagctttgcagctcttcatctgcctgcttttcagtctattgtaggggcagagggcttgtcccttgcattccggcacatggccagctccctgctgggccactgcagccaagtctcctgtgaaagcctccttcatgaggtcatcgtctgtgtgggctacttcactgtcaaccacccagataaccaggtgatcgtgcagtccggccgccaccccacagtgctgcagaagctctgccagttgcccttccagtatttcagtgacccacggctgatcaaagtactgttcccttcacttatcgctgcttgttacaacaaccatcagaacaagatcattctggagcaagagatgagctgtgttttactggccactttcattcaggatttggcacagactccaggtcaagcggaaaaccagccttaccaacccaaagggaaatgccttggttcccaagactatcttgagctggctaacagatttcctcagcaggcctgggaagaagctcgacagtttttcttgaaaaaagagaaaaaataaatgttttggttgattctgtatttgagtacccttgttaatattttaaattgtccaaacaaacattctaattgttccttaagaactcattttcccatgtttatactcttcccacactgtagatatggcatgtactttacactatttataatgactgtagatacttgaatgttctacttgctaattttgcaagttgagtttatttcatttatgcagagtatcttggagtttggtaatttccatcttatgataatatatactttgcatttgtgatatgggtgaaaggagacataaaattagcaagtctgttttgttcttgtaataaagtaacttattctgttttctttcagattcgtatttccttaacatgaaaagtcaacaatgaaaaca

SEQ ID NO: 313472 - DNA, 3346 bp, Homo sapiens
ccgggaagccaccccgcctctccgaggcctccctgccccgccccgtcacgcccctttcccggcgggacgctttgagccgccccgaactaagcagggcggtcgggggagtcatactccatgggtttatgtgataaatgatcttggcatagaagagaatttaaagagtgatggcttcattccagcgctccaatagtcatgacaaagtaaggagaatagttgcagaggagggtcgtacagcaagaaacctaatagcttggagtgttccactagaaagcaaagatgatgatggaaaacctaaatgtcaaactggtggaaaatctaagaggaccattcaaggcactcataaaactactaaacagagtactgcagtggactgtaaaataacatcgtctacgactggagataaacactttgataaaagtcccactaaaacaaggcaccctcggaaaattgatctaagagctcgatactgggcatttctttttgataatcttcgccgagcagtagatgaaatctatgtaacttgcgaatcagatcagagtgtggtcgaatgtaaggaggtgctaatgatgctggataactatgtaagagatttcaaagcattgattgactggattcagcttcaggaaaagctagagaagacagatgctcaaagcagaccaacatcattggcatgggaagtaaagaagatgtctccgggacgccatgtgattccaagtccatcaacagatagaataaatgtaacatcaaatgctcgacgaagcttaaattttggaggttcaactggcacagtgccagctcctcgtctggctcccacaggtgtcagttgggctgacaaggtaaaggctcatcatacaggctctactgcttcttcagaaataacacccgcccagtcttgcccaccaatgacagtgcagaaggcctcacgcaaaaatgaacggaaagatgctgaaggatgggagaccgttcagagaggaaggcctattcgttctcgatcaacagcagtgatgccaaaagtttcattggcaacagaagccacaagatcaaaggatgacagtgataaagaaaatgtatgtcttttacctgatgaaagcatacagaaaggtcaatttgttggagatggaacttctaatactatagaatctcatcccaaagactcattacactcttgtgaccatcctcttgccgaaaaaacccagttcacagtgagtacattggatgatgtgaagaattctggcagtattcgagacaattatgttcgaacttctgaaatatctgctgtccacattgatacagagtgtgtttcagttatgctgcaagctggtacacctcctttacaagtaaatgaagaaaaatttccagcagagaaagcaaggatagaaaatgaaatggacccttcagatatttcaaattccatggcagaagtccttgctaaaaaagaagagctagcagatcgtctagaaaaggccaatgaagaagccattgctagtgctattgctgaagaagaacagttaactagagaaattgaagctgaagaaaacaatgatattaacattgaaactgacaacgacagtgatttttctgccagcatgggcagtgggagtgtttctttctgtggtatgtccatggactggaacgatgtccttgcagattatgaagctcgtgagtcttggcgccaaaatacatcctggggggacattgtagaagaagaacctgctagacctccagggcatggaattcacatgcatgaaaaactttcttcaccctctcgtaaaagaacaattgcagaatctaagaagaaacatgaagaaaaacaaatgaaagcacagcagctaagggaaaagttacgcgaagagaaaacattgaagcttcagaaattgttagaaagggagaaggatgtccggaagtggaaggaagaattgctagatcaacgacgcaggatgatggaagaaaaattacttcatgctgagtttaagcgagaagtgcagttacaagcaattgtgaaaaaagcacaagaagaagaagctaaggtaaatgaaattgcctttataaatacccttgaagcccagaataaacgtcatgatgttttatcaaaattgaaggaatatgaacagaggcttaatgagctacaggaagagcgtcagagaagacaggaagaaaagcaagcacgtgatgaagctgtgcaggaacgcaagagagctctagaggcagagcggcaggcccgtgtagaagaattgttaatgaagaggaaagaacaagaagcccgaattgaacaacagaggcaagaaaaggaaaaagcccgtgaggatgcagcccgggaaagagctagagacagggaagaacgattggcagcactcacagctgctcaacaagaagctatggaagagttacagaaaaaaattcagctcaagcatgatgaaagtattcgaaggcacatggaacagattgaacaaagaaaagaaaaagctgctgagctaagcagtgggcgacatgcaaatactgattatgcccccaaactgaccccttatgaaagaaagaagcagtgttctctctgcaatgtcctgatctcttcagaggtatatctttttagccatgttaaagggagaaaacaccagcaagccgtgagagagaataccagcatccaggggcgtgaactgtcagatgaagaagtggagcatctttccttgaagaagtacattattgacattgtggttgaaagtacagctccagcagaagctttgaaagatggagaagagcggcaaaaaaataaaaaaaaagccaaaaagataaaagcccggatgaacttcagggctaaggaatatgagagtttaatggaaaccaaaaattctggctctgattcaccttataaagcaaagcttcagcgattagccaaagatcttctaaaacaagtacaagttcaagacagtggctcatgggcaaacaataaagtgtctgctttggatcggaccctaggagagatcactagaatactggaaaaagagaatgtggcagatcagattgcatttcaagctgctggtggattaacagcccttgaacacatccttcaagcagtagtcccagccacaaatgtgaacacagttttaagaattcctcctaagtctctctgcaatgcaatcaatgtttacaacctcacctgcaataactgttcagaaaactgcagtgatgttctgtttagtaacaagattaccttcttaatggacctcctgatacaccagttgacggtatgtaatattattgctttgagttagaagcagttaaggtttgagaaatagtccctgtggagaaaactaaaagaattcaacttagttactctccagatgaaaaa

SEQ ID NO: 313473 - DNA, 1210 bp, Homo sapiens
agctaagggaagactgcagtgggcagggccttactttcttgtgagtgaactctttgcaggttttaaggaatatgactactctgctttaagggggtgtggggagcactttgttaaagcaatgtgcattctgaatccatttcataggcgtccttactccgtggcagctacacctttaatcgtggattataataacttttaaatgagtgcaaaactttcaggatcttttccttaagttgggaaatgagattttttttttctgctcttttcaagtatcacttaaattaagctctggtacggagtcaggagtctttttctttacactccttcagcatgttttccatggtactagccgacactgtgcaggtgggtgagggacaggctggggcgtttcggcagctgacctgggctgctcttccatttcaggtgatcgtgcagtccggccgccaccccacagtgctgcagaagctctgccagttgcccttccagtatttcagtgacccacggctgatcaaagtactgttcccttcacttatcgctgcttgttacaacaaccatcagaacaagatcattctggagcaagagatgagctgtgttttactggccactttcattcaggatttggcacagactccaggtcaagcggaaaaccagccttaccaacccaaagggaaatgccttggttcccaagactatcttgagctggctaacagatttcctcagcaggcctgggaagaagctcgacagtttttcttgaaaaaagagaaaaaataaatgttttggttgattctgtatttgagtacccttgttaatattttaaattgtccaaacaaacattctaattgttccttaagaactcattttcccatgtttatactcttcccacactgtagatatggcatgtactttacactatttataatgactgtagatacttgaatgttctacttgctaattttgcaagttgagtttatttcatttatgcagagtatcttggagtttggtaatttccatcttatgataatatatactttgcatttgtgatatgggtgaaaggagacataaaattagcaagtctgttttgttcttgtaataaagtaacttattctgttttcattgttgacttttcatgttaaggaaatacgaatctgaaagaaaaatgttaactccagctcttgaagtatcttaaataaagacttaattaaagtttacc

SEQ ID NO: 313474 - DNA, 1924 bp, Homo sapiens
ggcacgaggctggagtttgcggagggccgagccgggtgcgcacggggaggcggaggcagcggcggcggcggcggcggcggcggcggcggagcagatgaagaaactgaggccctgtgatgtgaagtgacttgccccccagccacacagctggaccattctggctgctgtctggacaagaagtcgtagggggtgagggtggaagctgggaaacccacaggaggcaaccacactagtttagatcttctggtgaccccacttctcgctgctcatgccgctgggactggggcggcggaaaaaggcgccccctctagtggaaaatgaggaggctgagccaggccgtggagggctgggcgtgggggagccagggcctctgggcggaggtgggtcggggggcccccaaatgggcttgcccccccctcccccagccctgcggccccgcctcgtgttccacacccagctggcccatggcagtcccactggccgcatcgagggcttcaccaacgtcaaggagctgtatggcaagatcgccgaggccttccgcctgccaactgccgaggtgatgttctgcaccctgaacacccacaaagtggacatggacaagctcctggggggccagatcgggctggaggacttcatcttcgcccacgtgaaggggcagcgcaaggaggtggaggtgttcaagtcggaggatgcactcgggctcaccatcacggacaacggggctggctacgccttcatcaagcgcatcaaggagggcagcgtgatcgaccacatccacctcatcagcgtgggcgacatgatcgaggccattaacgggcagagcctgctgggctgccggcactacgaggtggcccggctgctcaaggagctgccccgaggccgtaccttcacgctgaagctcacggagcctcgcaaggccttcgacatgatcagccagcgttcagcgggtggccgccctggctctggcccacaactgggcactggccgagggaccctgcggctccgatcccggggccccgccacggtggaggatctgccctctgcctttgaagagaaggccattgagaaggtggatgacctgctggagagttacatgggtatcagggacacggagctggcggccaccatggtggagctgggaaaggacaaaaggaacccggatgagctggccgaggccctggacgaacggctgggtgactttgccttccctgacgagttcgtctttgacgtctggggcgccattggggacgccaaggtcggccgctactaggactgcccccggaccctgcgatgatgacccgggcgcaacctggtgggggcccccagcagggacactgacgtcaggacccgagcctccagcctgagcctagctcagcagcccaaggacgatggtgaggggaggtggggccaggccccctgccccgctccaatcggtaccatcccctccctggttcccagtctggccggggtccccggcccccctgtgccctgttccccacctacctcagctgggtcaggcacagggaggggagggatcagccaaattgggcggccacccccgcctccaccactttccaccatcagctgccaaactggtccctctgtctccctggggccttgggttctgtttgggggtcatgaccttcctagtttcctgacgcagggaatacaggggagagggttgtccttccccccagcaaatgcaataatgccctcacccctcctgagaggagccccctccctgtggagcctgttacctccgcatttgacacgagtctgctgtgaaccccgcaacctcctccccacctcccatctctccttccaggcccatccctggcccagagcaggagggagggagggacgatggcggtgggtttttgtatctgaatttgctgtcttgaacataaagaatctatctgctgtt

SEQ ID NO: 313475 - DNA, 485 bp, Homo sapiens
agtggctgaattcagcaaagatttgctttttcttcctgctacacttccattgcggctcagcagggggcaccattcaccgtagtcattcagggcccggcctcatagagtcgccaccatatcaaatgtggctcatcaccctgcctgggaaagatagatgtccctctgtctccctggggccttgggttctgtttgggggtcatgaccttcctagtttcctgacgcagggaatacaggggagagggttgtccttccccccagcaaatgcaataatgccctcacccctcctgagaggagccccctccctgtggagcctgttacctccgcatttgacacgagtctgctgtgaaccccgcaacctcctccccacctcccatctctccttccaggcccatccctggcccagagcaggagggagggagggacgatggcggtgggtttttgtatctgaatttgctgtcttgaacataaagaatctatctgctgtt

SEQ ID NO: 313476 - DNA, 596 bp, Homo sapiens
ggcacgaggctggagtttgcggagggccgagccgggtgcgcacggggaggcggaggcagcggcggcggcggcggcggcggcggcggcggagcagatgaagaaactgaggccctgtgatgtgaagtgacttgccccccagccacacagctggaccattctggctgctgtctggacaagaagtcgtagggggtgagggtggaagctgggaaacccacaggaggcaaccacactagtttagatcttctggtgaccccacttctcgctgctcatgccgctgggactggggcggcggaaaaaggcgccccctctagtggaaaatgaggaggctgagccaggccgtggagggctgggcgtgggggagccagggcctctgggcggaggtgggtcggggggccgcgggaatgggcatgccaggggctcgggagcatattgggacccggcacggcacggcgcccgccggcggcggagaccaggcggccatcggcaacatgactgggtggtcccccgggacaggcaccagcggaaacaccagggtcgcgtaggacgcaactggcaccacgggctcgcgcaacgcgggacgatgtactaccgggcgg

SEQ ID NO: 313477 - DNA, 889 bp, Homo sapiens
tacatcatagtaaaacaggccctatggagagaggacatgggtttctctgctgaacagccattatttatactcattccaaggcttctaacatgatgatactatttcctcgtatttccaccattccaatatttttctgttgtccactagtcgccatctccacacattcatctatcacaaggttcataaaggaatcaaatccccgcaatattccttggacatgtctgccaccatttaatttcaatgaaaacttcttgtccgtaaattttttcaactcaggagggtgagctttgctcatggtgtatactccatgggctcacagatgccttggaacagaacgcacggcttccctcacgctaccgcggtaggcccagcatcttgtgcctggcgtcatcgacctcgttagccaatcgattgttcgagcatgagtttcaatggggcaaaccttatccaaaccatagcaggctgggtgtggtagctcatgcctgtaatcccagcactttggaaggccaaggcgggaggattgcttgagcccaggagttcaggaccaatctgggcaacgtggtgagacccgtctctacaaaaaataaaaattggctgggcatggctgtgaacacctgtagtctcagctattcaggaggttgagacaggaggattgcttgagcccaggaatttgaggctgtagtgagctgtgatcacatcactccactgcagcctggacgacagagtgagaccccattaaaaaaaaaaaatcaggaaaacatagcaacctgttacctccctgccctcatgttctcactatccccccttcactcactgttccaaccccccaggcctcctcactgttcctcaaacatgccaattgcatgcccagttcagggcttggcttttc

SEQ ID NO: 313478 - DNA, 591 bp, Homo sapiens
cagtacggatgtgggactcaatgtagcaggaagtttgcaccagagccaagaagagagcttgcagctgccagggaatggcctggcggaggaagcgcagcccgggccagtacggatgtggaggtgttcaagtcggaggatgcactcgggctcaccatcacggacaacggggctggctacgccttcatcaagcgcatcaaggagggcagcgtgatcgaccacatccacctcatcagcgtgggcgacatgatcgaggccattaacgggcagagcctgctgggctgccggcactacgaggtggcccggctgctcaaggagctgccccgaggccgtaccttcacgctgaagccggacgctgtgtgcgcacatgggctgtgctgtgaagactgccagctgaagcctgcaggaacagcgtgcagggactccagcaactcctgtgacctcccagagttctgcacaggggtcagccctcactggccagccaacgtgtacctgcacgatgggcactcatgtcaggatgttggacggatactgctacaatggcatctgccagactcacgagcagcagtagcggtccacatccgtagtgtgccg

SEQ ID NO: 313479 - DNA, 496 bp, Homo sapiens
tacatcatagtaaaacaggccctatggagagaggacatgggtttctctgctgaacagccattatttatactcattccaaggcttctaacatgatgatactatttcctcgtatttccaccattccaatatttttctgttgtccactagtcgccatctccacacattcatctatcacaaggttcataaaggaatcaaatccccgcaatattccttggacatgtctgccaccatttaatttcaatgaaaacttcttgtccgtaaattttttcaactcaggagggtgagctttgctcatggtgtatactccatgggctcacagatgccttggaacagaacgcaaaaattcctgccccgcgggacttctgccatcagcgaggctttatgttttgtcggcctccgctttccagcggggcaggaatttttgcgttttgttcattgtggtatcctagaaattcgaacagtgtctgtcttgggggatcctcagatcaaccagcac

SEQ ID NO: 313480 - DNA, 1887 bp, Homo sapiens
gggcggaggcagcggcggcgtgctgtgcgtgtgtgtgtgtggctggcggcggagcagatgaagaaactgaggccctgtgatgtgaagtgacttgccccccagccacacagctggaccattctggctgctgtctggacaagaagtcgtagggggtgagggtggaagctgggaaacccacaggaggcaaccacactagtttagatcttctggtgaccccacttctcgctgctcatgccgctgggactggggcggcggaaaaaggcgccccctctagtggaaaatgaggaggctgagccaggccgtggagggctgggcgtgggggagccagggcctctgggcggaggtgggtcggggggcccccaaatgggcttgcccccccctcccccagccctgcggccccgcctcgtgttccacacccagctggcccatggcagtcccactggccgcatcgagggcttcaccaacgtcaaggagctgtatggcaagatcgccgaggccttccgcctgccaactgccgaggtgatgttctgcaccctgaacacccacaaagtggacatggacaagctcctggggggccagatcgggctggaggacttcatcttcgcccacgtgaaggggcagcgcaaggaggtggaggtgttcaagtcggaggatgcactcgggctcaccatcacggacaacggggctggctacgccttcatcaagcgcatcaaggagggcagcgtgatcgaccacatccacctcatcagcgtgggcgacatgatcgaggccattaacgggcagagcctgctgggctgccggcactacgaggtggcccggctgctcaaggagctgccccgaggccgtaccttcacgctgaagctcacggagcctcgcaaggccttcgacatgatcagccagcgttcagcgggtggccgccctggctctggcccacaactgggcactggccgagggaccctgcggctccgatcccggggccccgccacggtggaggatctgccctctgcctttgaagagaaggccattgagaaggtggatgacctgctggagagttacatgggtatcagggacacggagctggcggccaccatggtggagctgggaaaggacaaaaggaacccggatgagctggccgaggccctggacgaacggctgggtgactttgccttccctgacgagttcgtctttgacgtctggggcgccattggggacgccaaggtcggccgctactaggactgcccccggaccctgcgatgatgacccgggcgcaacctggtgggggcccccagcagggacactgacgtcaggacccgagcctccagcctgagcctagctcagcagcccaaggacgatggtgaggggaggtggggccaggccccctgccccgctccaatcggtaccatcccctccctggttcccagtctggccggggtccccggcccccctgtgccctgttccccacctacctcagctgggtcaggcacagggaggggagggatcagccaaattgggcggccacccccgcctccaccactttccaccatcagctgccaaactggtccctctgtctccctggggccttgggttctgtttgggggtcatgaccttcctagtttcctgacgcagggaatacaggggagagggttgtccttccccccagcaaatgcaataatgccctcacccctcctgagaggagccccctccctgtggagcctgttacctccgcatttgacacgagtctgctgtgaaccccgcaacctcctccccacctcccatctctccttccaggcccatccctggcccagagcaggagggagggagggacgatggcggtgggtttttgtatctgaatttgctgtcttgaacataaagaatctatctgctgtt

SEQ ID NO: 313481 - DNA, 1836 bp, Homo sapiens
ggcacgaggctggagtttgcggagggccgagccgggtgcgcacggggaggcggaggcagcggcggcggcggcggcggcggcggcggcggagcagatgaagaaactgaggccctgtgatgtgaagtgacttgccccccagccacacagctgatcttctggtgaccccacttctcgctgctcatgccgctgggactggggcggcggaaaaaggcgccccctctagtggaaaatgaggaggctgagccaggccgtggagggctgggcgtgggggagccagggcctctgggcggaggtgggtcggggggcccccaaatgggcttgcccccccctcccccagccctgcggccccgcctcgtgttccacacccagctggcccatggcagtcccactggccgcatcgagggcttcaccaacgtcaaggagctgtatggcaagatcgccgaggccttccgcctgccaactgccgaggtgatgttctgcaccctgaacacccacaaagtggacatggacaagctcctggggggccagatcgggctggaggacttcatcttcgcccacgtgaaggggcagcgcaaggaggtggaggtgttcaagtcggaggatgcactcgggctcaccatcacggacaacggggctggctacgccttcatcaagcgcatcaaggagggcagcgtgatcgaccacatccacctcatcagcgtgggcgacatgatcgaggccattaacgggcagagcctgctgggctgccggcactacgaggtggcccggctgctcaaggagctgccccgaggccgtaccttcacgctgaagctcacggagcctcgcaaggccttcgacatgatcagccagcgttcagcgggtggccgccctggctctggcccacaactgggcactggccgagggaccctgcggctccgatcccggggccccgccacggtggaggatctgccctctgcctttgaagagaaggccattgagaaggtggatgacctgctggagagttacatgggtatcagggacacggagctggcggccaccatggtggagctgggaaaggacaaaaggaacccggatgagctggccgaggccctggacgaacggctgggtgactttgccttccctgacgagttcgtctttgacgtctggggcgccattggggacgccaaggtcggccgctactaggactgcccccggaccctgcgatgatgacccgggcgcaacctggtgggggcccccagcagggacactgacgtcaggacccgagcctccagcctgagcctagctcagcagcccaaggacgatggtgaggggaggtggggccaggccccctgccccgctccaatcggtaccatcccctccctggttcccagtctggccggggtccccggcccccctgtgccctgttccccacctacctcagctgggtcaggcacagggaggggagggatcagccaaattgggcggccacccccgcctccaccactttccaccatcagctgccaaactggtccctctgtctccctggggccttgggttctgtttgggggtcatgaccttcctagtttcctgacgcagggaatacaggggagagggttgtccttccccccagcaaatgcaataatgccctcacccctcctgagaggagccccctccctgtggagcctgttacctccgcatttgacacgagtctgctgtgaaccccgcaacctcctccccacctcccatctctccttccaggcccatccctggcccagagcaggagggagggagggacgatggcggtgggtttttgtatctgaatttgctgtcttgaacataaagaatctatctgctgtt

SEQ ID NO: 313482 - DNA, 1606 bp, Homo sapiens
ggcacgaggctggagtttgcggagggccgagccgggtgcgcacggggaggcggaggcagcggcggcggcggcggcggcggcggcggcggagcagatgaagaaactgaggccctgtgatgtgaagtgacttgccccccagccacacagctggaccattctggctgctgtctggacaagaagtcgtagggggtgagggtggaagctgggaaacccacaggaggcaaccacactagtttaggtgatgttctgcaccctgaacacccacaaagtggacatggacaagctcctggggggccagatcgggctggaggacttcatcttcgcccacgtgaaggggcagcgcaaggaggtggaggtgttcaagtcggaggatgcactcgggctcaccatcacggacaacggggctggctacgccttcatcaagcgcatcaaggagggcagcgtgatcgaccacatccacctcatcagcgtgggcgacatgatcgaggccattaacgggcagagcctgctgggctgccggcactacgaggtggcccggctgctcaaggagctgccccgaggccgtaccttcacgctgaagctcacggagcctcgcaaggccttcgacatgatcagccagcgttcagcgggtggccgccctggctctggcccacaactgggcactggccgagggaccctgcggctccgatcccggggccccgccacggtggaggatctgccctctgcctttgaagagaaggccattgagaaggtggatgacctgctggagagttacatgggtatcagggacacggagctggcggccaccatggtggagctgggaaaggacaaaaggaacccggatgagctggccgaggccctggacgaacggctgggtgactttgccttccctgacgagttcgtctttgacgtctggggcgccattggggacgccaaggtcggccgctactaggactgcccccggaccctgcgatgatgacccgggcgcaacctggtgggggcccccagcagggacactgacgtcaggacccgagcctccagcctgagcctagctcagcagcccaaggacgatggtgaggggaggtggggccaggccccctgccccgctccaatcggtaccatcccctccctggttcccagtctggccggggtccccggcccccctgtgccctgttccccacctacctcagctgggtcaggcacagggaggggagggatcagccaaattgggcggccacccccgcctccaccactttccaccatcagctgccaaactggtccctctgtctccctggggccttgggttctgtttgggggtcatgaccttcctagtttcctgacgcagggaatacaggggagagggttgtccttccccccagcaaatgcaataatgccctcacccctcctgagaggagccccctccctgtggagcctgttacctccgcatttgacacgagtctgctgtgaaccccgcaacctcctccccacctcccatctctccttccaggcccatccctggcccagagcaggagggagggagggacgatggcggtgggtttttgtatctgaatttgctgtcttgaacataaagaatctatctgctgtt

SEQ ID NO: 313483 - DNA, 1528 bp, Homo sapiens
ggcacgaggctggagtttgcggagggccgagccgggtgcgcacggggaggcggaggcagcggcggcggcggcggcggcggcggcggcggagcagatgaagaaactgaggccctgtgatgtgaagtgacttgccccccagccacacagctggaccattctggctgctgtctggacaagaagtcgtagggggtgagggtggaagctgggaaacccacaggaggcaaccacactagtttagatcttctggtgaccccacttctcgctgctcatgccgctgggactggggcggcggaaaaaggcgccccctctagtggaaaatgaggaggctgagccaggccgtggagggctgggcgtgggggagccagggcctctgggcggaggtgggtcggggggcccccaaatgggcttgcccccccctcccccagccctgcggccccgcctcgtgttccacacccagctggcccatggcagtcccactggccgcatcgagggcttcaccaacgtcaaggagctgtatggcaagatcgacatgatcagccagcgttcagcgggtggccgccctggctctggcccacaactgggcactggccgagggaccctgcggctccgatcccggggccccgccacggtggaggatctgccctctgcctttgaagagaaggccattgagaaggtggatgacctgctggagagttacatgggtatcagggacacggagctggcggccaccatggtggagctgggaaaggacaaaaggaacccggatgagctggccgaggccctggacgaacggctgggtgactttgccttccctgacgagttcgtctttgacgtctggggcgccattggggacgccaaggtcggccgctactaggactgcccccggaccctgcgatgatgacccgggcgcaacctggtgggggcccccagcagggacactgacgtcaggacccgagcctccagcctgagcctagctcagcagcccaaggacgatggtgaggggaggtggggccaggccccctgccccgctccaatcggtaccatcccctccctggttcccagtctggccggggtccccggcccccctgtgccctgttccccacctacctcagctgggtcaggcacagggaggggagggatcagccaaattgggcggccacccccgcctccaccactttccaccatcagctgccaaactggtccctctgtctccctggggccttgggttctgtttgggggtcatgaccttcctagtttcctgacgcagggaatacaggggagagggttgtccttccccccagcaaatgcaataatgccctcacccctcctgagaggagccccctccctgtggagcctgttacctccgcatttgacacgagtctgctgtgaaccccgcaacctcctccccacctcccatctctccttccaggcccatccctggcccagagcaggagggagggagggacgatggcggtgggtttttgtatctgaatttgctgtcttgaacataaagaatctatctgctgtt

SEQ ID NO: 313484 - DNA, 1041 bp, Homo sapiens
aagaggagacggactcaggcagctggagactcaggctgggacatgatcagccagcgttcagcgggtggccgccctggctctggcccacaactgggcactggccgagggaccctgcggctccgatcccggggccccgccacggtggaggatctgccctctgcctttgaagagaaggccattgagaaggtggatgacctgctggagagttacatgggtatcagggacacggagctggcggccaccatggtggagctgggaaaggacaaaaggaacccggatgagctggccgaggccctggacgaacggctgggtgactttgccttccctgacgagttcgtctttgacgtctggggcgccattggggacgccaaggtcggccgctactaggactgcccccggaccctgcgatgatgacccgggcgcaacctggtgggggcccccagcagggacactgacgtcaggacccgagcctccagcctgagcctagctcagcagcccaaggacgatggtgaggggaggtggggccaggccccctgccccgctccaatcggtaccatcccctccctggttcccagtctggccggggtccccggcccccctgtgccctgttccccacctacctcagctgggtcaggcacagggaggggagggatcagccaaattgggcggccacccccgcctccaccactttccaccatcagctgccaaactggtccctctgtctccctggggccttgggttctgtttgggggtcatgaccttcctagtttcctgacgcagggaatacaggggagagggttgtccttccccccagcaaatgcaataatgccctcacccctcctgagaggagccccctccctgtggagcctgttacctccgcatttgacacgagtctgctgtgaaccccgcaacctcctccccacctcccatctctccttccaggcccatccctggcccagagcaggagggagggagggacgatggcggtgggtttttgtatctgaatttgctgtcttgaacataaagaatctatctgctgtt

SEQ ID NO: 313485 - DNA, 603 bp, Homo sapiens
  misc_feature (3)..(3): n is a, c, g, or t
  misc_feature (75)..(75): n is a, c, g, or t
atnacttatgtctaggtacccgagcctccctactctcgccaccccaccccaccacccccaaccaccatccccacnccaccctcccaccacgccccctgccccgctccaatcggtaccatcccctccctggttcccagtctggccggggtccccggcccccctgtgccctgttccccacctacctcagctgggtcaggcacagggaggggagggatcagccaaattgggcggccacccccgcctccaccactttccaccatcagctgccaaactggtccctctgtctccctggggccttgggttctgtttgggggtcatgaccttcctagtttcctgacgcagggaatacaggggagagggttgtccttccccccagcaaatgcaataatgccctcacccctcctgagaggagccccctccctgtggagcctgttacctccgcatttgacacgagtctgctgtgaaccccgcaacctcctccccacctcccatctctccttccaggcccatccctggcccagagcaggagggagggagggacgatggcggtgggtttttgtatctgaatttgctgtcttgaacataaagaatctatctgctgtt

SEQ ID NO: 313486 - DNA, 1071 bp, Homo sapiens
ggcacgaggctggagtttgcggagggccgagccgggtgcgcacggggaggcggaggcagcggcggcggcggcggcggcggcggcggcggagcagatgaagaaactgaggccctgtgatgtgaagtgacttgccccccagccacacagctggaccattctggctgctgtctggacaagaagtcgtagggggtgagggtggaagctgggaaacccacaggaggcaaccacactagtttagatcttctggtgaccccacttctcgctgctcatgccgctgggactggggcggcggaaaaaggcgccccctctagtggaaaatgaggaggctgagccaggccgtggagggctgggcgtgggggagccagggcctctgggcggaggtgggtcggggggcccccaaatgggcttgcccccccctcccccagccctgcggccccgcctcgtgttccacacccagctggcccatggcagtcccactggccgcatcgagggcttcaccaacgtcaaggagctgtatggcaagatcgccgaggccttccgcctgccaactgccgaggtgatgttctgcaccctgaacacccacaaagtggacatggacaagctcctggggggccagatcgggctggaggacttcatcttcgcccacgtgaaggggcagcgcaaggaggtggaggtgttcaagtcggaggatgcactcgggctcaccatcacggacaacggggctggctacgccttcatcaaggtccctctgtctccctggggccttgggttctgtttgggggtcatgaccttcctagtttcctgacgcagggaatacaggggagagggttgtccttccccccagcaaatgcaataatgccctcacccctcctgagaggagccccctccctgtggagcctgttacctccgcatttgacacgagtctgctgtgaaccccgcaacctcctccccacctcccatctctccttccaggcccatccctggcccagagcaggagggagggagggacgatggcggtgggtttttgtatctgaatttgctgtcttgaacataaagaatctatctgctgtt

SEQ ID NO: 313487 - DNA, 935 bp, Homo sapiens
ggcacgaggctggagtttgcggagggccgagccgggtgcgcacggggaggcggaggcagcggcggcggcggcggcggcggcggcggcggagcagatgaagaaactgaggccctgtgatgtgaagtgacttgccccccagccacacagctggaccattctggctgctgtctggacaagaagtcgtagggggtgagggtggaagctgggaaacccacaggaggcaaccacactagtttagatcttctggtgaccccacttctcgctgctcatgccgctgggactggggcggcggaaaaaggcgccccctctagtggaaaatgaggaggctgagccaggccgtggagggctgggcgtgggggagccagggcctctgggcggaggtgggtcggggggcccccaaatgggcttgcccccccctcccccagccctgcggccccgcctcgtgttccacacccagctggcccatggcagtcccactggccgcatcgagggcttcaccaacgtcaaggagctgtatggcaagatcgccgaggccttccgcctgccaactgccgaggtgatgttctgcaccctgaacacccacaaagtggacatggacaagctcctggggggccagatcgggctggaggacttcatcttcgcccacgtgaaggggcagcgcaaggaggtggaggtgttcaagtcggaggatgcactcgggctcaccatcaaatgcaataatgccctcacccctcctgagaggagccccctccctgtggagcctgttacctccgcatttgacacgagtctgctgtgaaccccgcaacctcctccccacctcccatctctccttccaggcccatccctggcccagagcaggagggagggagggacgatggcggtgggtttttgtatctgaatttgctgtcttgaacataaagaatctatctgctgtt

SEQ ID NO: 313488 - DNA, 695 bp, Homo sapiens
ggcacgaggctggagtttgcggagggccgagccgggtgcgcacggggaggcggaggcagcggcggcggcggcggcggcggcggcggcggagcagatgaagaaactgaggccctgtgatgtgaagtgacttgccccccagccacacagctggaccattctggctgctgtctggacaagaagtcgtagggggtgagggtggaagctgggaaacccacaggaggcaaccacactagtttagatcttctggtgaccccacttctcgctgctcatgccgctgggactggggcggcggaaaaaggcgccccctctagtggaaaatgaggaggctgagccaggccgtggagggctgggcgtgggggagccagggcctctgggcggaggtgggtcggggggcccccaaatgggcttgcccccccctcccccagccctgcggccccgcctcgtgttccacacccagctggcccatggcagtcccactggccgcatcgagggctctgagaggagccccctccctgtggagcctgttacctccgcatttgacacgagtctgctgtgaaccccgcaacctcctccccacctcccatctctccttccaggcccatccctggcccagagcaggagggagggagggacgatggcggtgggtttttgtatctgaatttgctgtcttgaacataaagaatctatctgctgtt

SEQ ID NO: 313489 - DNA, 493 bp, Homo sapiens
gggcggaggcagcggcggcgtgctgtgcgtgtgtgtgtgtggctggcggcggagcagatgaagaaactgaggccctgtgatgtgaagtgacttgccccccagccacacagctggaccattctggctgctgtctggacaagaagtcgtagggggtgagggtggaagtccctctgtctccctggggccttgggttctgtttgggggtcatgaccttcctagtttcctgacgcagggaatacaggggagagggttgtccttccccccagcaaatgcaataatgccctcacccctcctgagaggagccccctccctgtggagcctgttacctccgcatttgacacgagtctgctgtgaaccccgcaacctcctccccacctcccatctctccttccaggcccatccctggcccagagcaggagggagggagggacgatggcggtgggtttttgtatctgaatttgctgtcttgaacataaagaatctatctgctgtt

SEQ ID NO: 313490 - DNA, 469 bp, Homo sapiens
agctctctctgtggggttttgggggttcagaggccccgccctcttggagggctggggtgaacaggtggcaatgaagtgtgccatctggctggcagagcaacgggtgcccctgagtgtgcaactgaaggacgctctctctggtccctctgtctccctggggccttgggttctgtttgggggtcatgaccttcctagtttcctgacgcagggaatacaggggagagggttgtccttccccccagcaaatgcaataatgccctcacccctcctgagaggagccccctccctgtggagcctgttacctccgcatttgacacgagtctgctgtgaaccccgcaacctcctccccacctcccatctctccttccaggcccatccctggcccagagcaggagggagggagggacgatggcggtgggtttttgtatctgaatttgctgtcttgaacataaagaatctatctgctgtt

SEQ ID NO: 313491 - DNA, 727 bp, Homo sapiens
gggcggaggcagcggcggcgtgctgtgcgtgtgtgtgtgtggctggcggcggagcagatgaagaaactgaggccctgtgatgtgaagtgacttgccccccagccacacagctggaccattctggctgctgtctggacaagaagtcgtagggggtgagggtggaagctgggaaacccacaggaggcaaccacactagtttaggtaagtgatcatggagatggaccaggtgagatgagagggtgtgttaggggacagacgaatggatgcatgaacaaatggatacatgagactaggtgcaggctgggtgcagtggctcacacctctaatcccggcactttggaaggccaaggcgggaggattgcttgagcccaggagttcaggaccaatctgggcaacgtggtgagacccgtctctacaaaaaataaaaattggctgggcatggctgtgaacacctgtagtctcagctattcaggaggttgagacaggaggattgcttgagcccaggaatttgaggctgtagtgagctgtgatcacatcactccactgcagcctggacgacagagtgagaccccattaaaaaaaaaaaatcaggaaaacatagcaacctgttacctccctgccctcatgttctcactatccccccttcactcactgttccaaccccccaggcctcctcactgttcctcaaacatgccaattgcatgcccagttcagggcttggcttttc

SEQ ID NO: 313492 - DNA, 1780 bp, Homo sapiens
ggcacgaggctggagtttgcggagggccgagccgggtgcgcacggggaggcggaggcagcggcggcggcggcggcggcggcggcggcggagcagatcttctggtgaccccacttctcgctgctcatgccgctgggactggggcggcggaaaaaggcgccccctctagtggaaaatgaggaggctgagccaggccgtggagggctgggcgtgggggagccagggcctctgggcggaggtgggtcggggggcccccaaatgggcttgcccccccctcccccagccctgcggccccgcctcgtgttccacacccagctggcccatggcagtcccactggccgcatcgagggcttcaccaacgtcaaggagctgtatggcaagatcgccgaggccttccgcctgccaactgccgaggtgatgttctgcaccctgaacacccacaaagtggacatggacaagctcctggggggccagatcgggctggaggacttcatcttcgcccacgtgaaggggcagcgcaaggaggtggaggtgttcaagtcggaggatgcactcgggctcaccatcacggacaacggggctggctacgccttcatcaagcgcatcaaggagggcagcgtgatcgaccacatccacctcatcagcgtgggcgacatgatcgaggccattaacgggcagagcctgctgggctgccggcactacgaggtggcccggctgctcaaggagctgccccgaggccgtaccttcacgctgaagctcacggagcctcgcaaggccttcgacatgatcagccagcgttcagcgggtggccgccctggctctggcccacaactgggcactggccgagggaccctgcggctccgatcccggggccccgccacggtggaggatctgccctctgcctttgaagagaaggccattgagaaggtggatgacctgctggagagttacatgggtatcagggacacggagctggcggccaccatggtggagctgggaaaggacaaaaggaacccggatgagctggccgaggccctggacgaacggctgggtgactttgccttccctgacgagttcgtctttgacgtctggggcgccattggggacgccaaggtcggccgctactaggactgcccccggaccctgcgatgatgacccgggcgcaacctggtgggggcccccagcagggacactgacgtcaggacccgagcctccagcctgagcctagctcagcagcccaaggacgatggtgaggggaggtggggccaggccccctgccccgctccaatcggtaccatcccctccctggttcccagtctggccggggtccccggcccccctgtgccctgttccccacctacctcagctgggtcaggcacagggaggggagggatcagccaaattgggcggccacccccgcctccaccactttccaccatcagctgccaaactggtccctctgtctccctggggccttgggttctgtttgggggtcatgaccttcctagtttcctgacgcagggaatacaggggagagggttgtccttccccccagcaaatgcaataatgccctcacccctcctgagaggagccccctccctgtggagcctgttacctccgcatttgacacgagtctgctgtgaaccccgcaacctcctccccacctcccatctctccttccaggcccatccctggcccagagcaggagggagggagggacgatggcggtgggtttttgtatctgaatttgctgtcttgaacataaagaatctatctgctgtt

SEQ ID NO: 313493 - DNA, 1868 bp, Homo sapiens
ggcacgaggctggagtttgcggagggccgagccgggtgcgcacggggaggcggaggcagcggcggcggcggcggcggcggcggcggcggagcaggaccattctggctgctgtctggacaagaagtcgtagggggtgagggtggaagctgggaaacccacaggaggcaaccacactagtttagatcttctggtgaccccacttctcgctgctcatgccgctgggactggggcggcggaaaaaggcgccccctctagtggaaaatgaggaggctgagccaggccgtggagggctgggcgtgggggagccagggcctctgggcggaggtgggtcggggggcccccaaatgggcttgcccccccctcccccagccctgcggccccgcctcgtgttccacacccagctggcccatggcagtcccactggccgcatcgagggcttcaccaacgtcaaggagctgtatggcaagatcgccgaggccttccgcctgccaactgccgaggtgatgttctgcaccctgaacacccacaaagtggacatggacaagctcctggggggccagatcgggctggaggacttcatcttcgcccacgtgaaggggcagcgcaaggaggtggaggtgttcaagtcggaggatgcactcgggctcaccatcacggacaacggggctggctacgccttcatcaagcgcatcaaggagggcagcgtgatcgaccacatccacctcatcagcgtgggcgacatgatcgaggccattaacgggcagagcctgctgggctgccggcactacgaggtggcccggctgctcaaggagctgccccgaggccgtaccttcacgctgaagctcacggagcctcgcaaggccttcgacatgatcagccagcgttcagcgggtggccgccctggctctggcccacaactgggcactggccgagggaccctgcggctccgatcccggggccccgccacggtggaggatctgccctctgcctttgaagagaaggccattgagaaggtggatgacctgctggagagttacatgggtatcagggacacggagctggcggccaccatggtggagctgggaaaggacaaaaggaacccggatgagctggccgaggccctggacgaacggctgggtgactttgccttccctgacgagttcgtctttgacgtctggggcgccattggggacgccaaggtcggccgctactaggactgcccccggaccctgcgatgatgacccgggcgcaacctggtgggggcccccagcagggacactgacgtcaggacccgagcctccagcctgagcctagctcagcagcccaaggacgatggtgaggggaggtggggccaggccccctgccccgctccaatcggtaccatcccctccctggttcccagtctggccggggtccccggcccccctgtgccctgttccccacctacctcagctgggtcaggcacagggaggggagggatcagccaaattgggcggccacccccgcctccaccactttccaccatcagctgccaaactggtccctctgtctccctggggccttgggttctgtttgggggtcatgaccttcctagtttcctgacgcagggaatacaggggagagggttgtccttccccccagcaaatgcaataatgccctcacccctcctgagaggagccccctccctgtggagcctgttacctccgcatttgacacgagtctgctgtgaaccccgcaacctcctccccacctcccatctctccttccaggcccatccctggcccagagcaggagggagggagggacgatggcggtgggtttttgtatctgaatttgctgtcttgaacataaagaatctatctgctgtt

SEQ ID NO: 313494 - DNA, 1991 bp, Homo sapiens
gctaatttttatatttttagtagaggtggggtttcaccatgttggccaagctggtttcaaagttttgacctcaagtgatccgcccacctcagccttccgtagtggtgggattacaggcgtgagccaccgcacccagccctattattacttttatataagtgtcctgtcactatacaagagatgaggatttcaaccgaggccaatttgttctctgagtatttccttgggcctgtatggttcgagtagtgtgggaggggcacccaaggcctctgcccaggccctgagccccacttcctgtcctgcagatcttctggtgaccccacttctcgctgctcatgccgctgggactggggcggcggaaaaaggcgccccctctagtggaaaatgaggaggctgagccaggccgtggagggctgggcgtgggggagccagggcctctgggcggaggtgggtcggggggcccccaaatgggcttgcccccccctcccccagccctgcggccccgcctcgtgttccacacccagctggcccatggcagtcccactggccgcatcgagggcttcaccaacgtcaaggagctgtatggcaagatcgccgaggccttccgcctgccaactgccgaggtgatgttctgcaccctgaacacccacaaagtggacatggacaagctcctggggggccagatcgggctggaggacttcatcttcgcccacgtgaaggggcagcgcaaggaggtggaggtgttcaagtcggaggatgcactcgggctcaccatcacggacaacggggctggctacgccttcatcaagcgcatcaaggagggcagcgtgatcgaccacatccacctcatcagcgtgggcgacatgatcgaggccattaacgggcagagcctgctgggctgccggcactacgaggtggcccggctgctcaaggagctgccccgaggccgtaccttcacgctgaagctcacggagcctcgcaaggccttcgacatgatcagccagcgttcagcgggtggccgccctggctctggcccacaactgggcactggccgagggaccctgcggctccgatcccggggccccgccacggtggaggatctgccctctgcctttgaagagaaggccattgagaaggtggatgacctgctggagagttacatgggtatcagggacacggagctggcggccaccatggtggagctgggaaaggacaaaaggaacccggatgagctggccgaggccctggacgaacggctgggtgactttgccttccctgacgagttcgtctttgacgtctggggcgccattggggacgccaaggtcggccgctactaggactgcccccggaccctgcgatgatgacccgggcgcaacctggtgggggcccccagcagggacactgacgtcaggacccgagcctccagcctgagcctagctcagcagcccaaggacgatggtgaggggaggtggggccaggccccctgccccgctccaatcggtaccatcccctccctggttcccagtctggccggggtccccggcccccctgtgccctgttccccacctacctcagctgggtcaggcacagggaggggagggatcagccaaattgggcggccacccccgcctccaccactttccaccatcagctgccaaactggtccctctgtctccctggggccttgggttctgtttgggggtcatgaccttcctagtttcctgacgcagggaatacaggggagagggttgtccttccccccagcaaatgcaataatgccctcacccctcctgagaggagccccctccctgtggagcctgttacctccgcatttgacacgagtctgctgtgaaccccgcaacctcctccccacctcccatctctccttccaggcccatccctggcccagagcaggagggagggagggacgatggcggtgggtttttgtatctgaatttgctgtcttgaacataaagaatctatctgctgtt

SEQ ID NO: 313495 - DNA, 3243 bp, Homo sapiens
  misc_feature (1962)..(1962): n is a, c, g, or t
ggcacgaggctggagtttgcggagggccgagccgggtgcgcacggggaggcggaggcagcggcggcggcggcggcggcggcggcggcggagcagatgaagaaactgaggccctgtgatgtgaagtgacttgccccccagccacacagctggaccattctggctgctgtctggacaagaagtcgtagggggtgagggtggaagctgggaaacccacaggaggcaaccacactagtttagatcttctggtgaccccacttctcgctgctcatgccgctgggactggggcggcggaaaaaggcgccccctctagtggaaaatgaggaggctgagccaggccgtggagggctgggcgtgggggagccagggcctctgggcggaggtgggtcggggggcccccaaatgggcttgcccccccctcccccagccctgcggccccgcctcgtgttccacacccagctggcccatggcagtcccactggccgcatcgagggcttcaccaacgtcaaggagctgtatggcaagatcgccgaggccttccgcctgccaactgccgaggtgatgttctgcaccctgaacacccacaaagtggacatggacaagctcctggggggccagatcgggctggaggacttcatcttcgcccacgtgaaggggcagcgcaaggaggtggaggtgttcaagtcggaggatgcactcgggctcaccatcacggacaacggggctggctacgccttcatcaagcgcatcaaggagggcagcgtgatcgaccacatccacctcatcagcgtgggcgacatgatcgaggccattaacgggcagagcctgctgggctgccggcactacgaggtggcccggctgctcaaggagctgccccgaggccgtaccttcacgctgaagctcacggagcctcgcaaggccttcgacatgatcagccagcgttcagcgggtggccgccctggctctggcccacaactgggcactggccgagggaccctgcggctccgatcccggggccccgccacggtggaggatctgccctctgcctttgaagagaaggccattgagaaggtggatgacctgctggagagttacatgggtatcagggacacggagctggcggccaccatggtggagctgggaaaggacaaaaggaacccggatgagctggccgaggccctggacgaacggctgggtgactttgccttccctgacgagttcgtctttgacgtctggggcgccattggggacgccaaggtcggccgctactaggactgcccccggaccctgcgatgatgacccgggcgcaacctggtgggggcccccagcagggacactgacgtcaggacccgagcctccagcctgagcctagctcagcagcccaaggacgatggtgaggggaggtggggccaggccccctgccccgctccaatcggtaccatcccctccctggttcccagtctggccggggtccccggcccccctgtgccctgttccccacctacctcagctgggtcaggcacagggaggggagggatcagccaaattgggcggccacccccgcctccaccactttccaccatcagctgccaaactggtccctctgtctccctggggccttgggttctgtttgggggtcatgaccttcctagtttcctgacgcagggaatacaggggagagggttgtccttccccccagcaaatgcaataatgccctcacccctcctgagaggagccccctccctgtggagcctgttacctccgcatttgacacgagtctgctgtgaaccccgcaacctcctccccacctcccatctctccttccaggcccatccctggcccagagcaggagggagggagggacgatggcggtgggtttttgtatctgaatttgctgtcttgaacataaagaatctatctgctgttaaaaaaaaaaaaaaaaaaaaaaaaaaaaaaaaaaaaanaaaaaaaaaaaaaaaaaaaaaaaaaaaaaaaaaaaaaaaaaaaaaaaaaagagggaggggcgcggcgcacacaaaatctctccccccggcgggggccccactaatacccgacaccacccacgcgtctttagaaagagaggggcccaccacacagagaggcgacttacatcacagcgagaggcgggacagcgggcggcattatacaacaaaatcatggtgctggcggagaaacacaagtcgctgatagtgggacaactatctggcgagaggagaagcccatccctccccctgccgcggggcggtggacaacagatgtgggagagcacacatcctcagacagagagatatatatactagtcaacaccacccatcaccacgaccaccacatatcacatcaaacctcataccacagaccaagacaatcaaaactagtcgtgtctcacccaccaacaacagctcaccacttaatcatctcacccacccccacacacaaacaaacgacaccacacacgaccgcaccacttccctcctatacacaccaacaaccttctcctaccccccgcacggcgtctatatctaattcccccatacagcttcaccgccagaccgccactgcccaacagaccactgccatacaactccaaacgtcatcgctgaccaaccatacacaccgccaacagacgacaaacaccatgcatcaatacacacacaactaacagcaccaacacactagcacgaccacaaccgaagcacaccacaacgacgaaaccaacaaccatactcgcacacgatacccatacaccggtaaagacacaggcacacacacacagacgaactataccaaccacattaaaagtacacacagctaaatacagactcaaacacacatgacaacagcaacacacaactgacataacatatcaaattcacaaaaaactacaacagacacccaaacacactaatatacaacacactccacactcacacacaaagatacatcaaaacgacaaaagaaaaacaatacaacagacaaaaagcaaagcacaactcatcaagcaccactagcccaacagcactacacacccacacacactcaccaccactccacgcacccaacccactacaaccgacatcacaacgcacatatgagtgtcagactcacacactaaccccacaaaacacacaccacaaacacacaaaacaacaaccagactacctaaacacacgcacgctcactaacagcaataacaaccataacttcatctgaccaccaccacccaa

SEQ ID NO: 313496 - DNA, 1425 bp, Homo sapiens
ggcacgaggctggagtttgcggagggccgagccgggtgcgcacggggaggcggaggcagcggcggcggcggcggcggcggcggcggcggagcagatgaagaaactgaggccctgtgatgtgaagtgacttgccccccagccacacagctggaccattctggctgctgtctggacaagaagtcgtagggggtgagggtggaagctgggaaacccacaggaggcaaccacactagtttaggtgatgttctgcaccctgaacacccacaaagtggacatggacaagctcctggggggccagatcgggctggaggacttcatcttcgcccacgtgaaggggcagcgcaaggaggtggaggtgttcaagtcggaggatgcactcgggctcaccatcacggacaacggggctggctacgccttcatcaagacatgatcagccagcgttcagcgggtggccgccctggctctggcccacaactgggcactggccgagggaccctgcggctccgatcccggggccccgccacggtggaggatctgccctctgcctttgaagagaaggccattgagaaggtggatgacctgctggagagttacatgggtatcagggacacggagctggcggccaccatggtggagctgggaaaggacaaaaggaacccggatgagctggccgaggccctggacgaacggctgggtgactttgccttccctgacgagttcgtctttgacgtctggggcgccattggggacgccaaggtcggccgctactaggactgcccccggaccctgcgatgatgacccgggcgcaacctggtgggggcccccagcagggacactgacgtcaggacccgagcctccagcctgagcctagctcagcagcccaaggacgatggtgaggggaggtggggccaggccccctgccccgctccaatcggtaccatcccctccctggttcccagtctggccggggtccccggcccccctgtgccctgttccccacctacctcagctgggtcaggcacagggaggggagggatcagccaaattgggcggccacccccgcctccaccactttccaccatcagctgccaaactggtccctctgtctccctggggccttgggttctgtttgggggtcatgaccttcctagtttcctgacgcagggaatacaggggagagggttgtccttccccccagcaaatgcaataatgccctcacccctcctgagaggagccccctccctgtggagcctgttacctccgcatttgacacgagtctgctgtgaaccccgcaacctcctccccacctcccatctctccttccaggcccatccctggcccagagcaggagggagggagggacgatggcggtgggtttttgtatctgaatttgctgtcttgaacataaagaatctatctgctgtt

SEQ ID NO: 313497 - DNA, 1346 bp, Homo sapiens
ggcacgaggctggagtttgcggagggccgagccgggtgcgcacggggaggcggaggcagcggcggcggcggcggcggcggcggcggcggagcaggaccattctggctgctgtctggacaagaagtcgtagggggtgagggtggaagctgggaaacccacaggaggcaaccacactagtttaggtgatgttctgcaccctgaacacccacaaagtggacatggacaagctcctggggggccagatcgggctggaggacttcatcttcgcccacgtgaaggggcagcgcaaggaggtggaggtgttcaagtcggaggatgcactcgggctcaccatcacggacaacggggctggctacgccttcatcaagcgcatcaaggagggcagcgtgatcgaccacatccacctcatcagcgtgggcgacatgatcgaggccattaacgggcagagcctgctgggctgccggcactacgaggtggcccggctgctcaaggagctgccccgaggccgtaccttcacgctgaagctcacggagcctcgcaaggccttcgacatgatcagccagcgttcagcgggtggccgccctggctctggcccacaactgggcactggccgagggaccctgcggctccgatcccggggccccgccacggtggaggatctgccctctgcctttgaagagaaggccattgagaaggtggatgacctgctggagagttacatgggtatcagggacacggagctggcggccaccatggtggagctgggaaaggacaaaaggaacccggatgagctggccgaggccctggacgatggtgaggggaggtggggccaggccccctgccccgctccaatcggtaccatcccctccctggttcccagtctggccggggtccccggcccccctgtgccctgttccccacctacctcagctgggtcaggcacagggaggggagggatcagccaaattgggcggccacccccgcctccaccactttccaccatcagctgccaaactggtccctctgtctccctggggccttgggttctgtttgggggtcatgaccttcctagtttcctgacgcagggaatacaggggagagggttgtccttccccccagcaaatgcaataatgccctcacccctcctgagaggagccccctccctgtggagcctgttacctccgcatttgacacgagtctgctgtgaaccccgcaacctcctccccacctcccatctctccttccaggcccatccctggcccagagcaggagggagggagggacgatggcggtgggtttttgtatctgaatttgctgtcttgaacataaagaatctatctgctgtt

SEQ ID NO: 313498 - DNA, 1784 bp, Homo sapiens
ggcacgaggctggagtttgcggagggccgagccgggtgcgcacggggaggcggaggcagcggcggcggcggcggcggcggcggcggcggagcagatgaagaaactgaggccctgtgatgtgaagtgacttgccccccagccacacagctggaccattctggctgctgtctggacaagaagtcgtagggggtgagggtggaagctgggaaacccacaggaggcaaccacactagtttagatcttctggtgaccccacttctcgctgctcatgccgctgggactggggcggcggaaaaaggcgccccctctagtggaaaatgaggaggctgagccaggccgtggagggctgggcgtgggggagccagggcctctgggcggaggtgggtcggggggcccccaaatgggcttgcccccccctcccccagccctgcggccccgcctcgtgttccacacccagctggcccatggcagtcccactggccgcatcgagggcttcaccaacgtcaaggagctgtatggcaagatcgccgaggccttccgcctgccaactgccgaggtgatgttctgcaccctgaacacccacaaagtggacatggacaagctcctggggggccagatcgggctggaggacttcatcttcgcccacgtgaaggggcagcgcaaggaggtggaggtgttcaagtcggaggatgcactcgggctcaccatcacggacaacggggctggctacgccttcatcaagcgcatcaaggagggcagcgtgatcgaccacatccacctcatcagcgtgggcgacatgatcgaggccattaacgggcagagcctgctgggctgccggcactacgaggtggcccggctgctcaaggagctgccccgaggccgtaccttcacgctgaagctcacggagcctcgcaaggccttcgacatgatcagccagcgttcagcgggtggccgccctggctctggcccacaactgggcactggccgagggaccctgcggctccgatcccggggccccgccacggtggaggatctgccctctgcctttgaagagaaggccattgagaaggtggatgacctgctggagagttacatgggtatcagggacacggagctggcggccaccatggtggagctgggaaaggacaaaaggaacccggatgagctggccgaggccctggacgatggtgaggggaggtggggccaggccccctgccccgctccaatcggtaccatcccctccctggttcccagtctggccggggtccccggcccccctgtgccctgttccccacctacctcagctgggtcaggcacagggaggggagggatcagccaaattgggcggccacccccgcctccaccactttccaccatcagctgccaaactggtccctctgtctccctggggccttgggttctgtttgggggtcatgaccttcctagtttcctgacgcagggaatacaggggagagggttgtccttccccccagcaaatgcaataatgccctcacccctcctgagaggagccccctccctgtggagcctgttacctccgcatttgacacgagtctgctgtgaaccccgcaacctcctccccacctcccatctctccttccaggcccatccctggcccagagcaggagggagggagggacgatggcggtgggtttttgtatctgaatttgctgtcttgaacataaagaatctatctgctgttaaaaaaaaaccaacccaacacaccaacaaaaacacacaaggggggccccccaaagaaattccca

SEQ ID NO: 313499 - DNA, 797 bp, Homo sapiens
ggcacgaggctggagtttgcggagggccgagccgggtgcgcacggggaggcggaggcagcggcggcggcggcggcggcggcggcggcggagcagatgaagaaactgaggccctgtgatgtgaagtgacttgccccccagccacacagctggaccattctggctgctgtctggacaagaagtcgtagggggtgagggtggaagctgggaaacccacaggaggcaaccacactagtttagatcttctggtgaccccacttctcgctgctcatgccgctgggactggggcggcggaaaaaggcgccccctctagtggaaaatgaggaggctgagccaggccgtggagggctgggcgtgggggagccagggcctctgggcggaggtgggtcggggggcccccaaatgggcttgcccccccctcccccagccctgcggccccgcctcgtgttccacacccagctggcccatggcagtcccactggccgcatcgagggcttcaccaacgtcaaggagctgtatggcaagatcgccgaggccttccgcctgccaactgccgaggtgatgttctgcaccctgaacacccacaaagtggacatggctgagaggagccccctccctgtggagcctgttacctccgcatttgacacgagtctgctgtgaaccccgcaacctcctccccacctcccatctctccttccaggcccatccctggcccagagcaggagggagggagggacgatggcggtgggtttttgtatctgaatttgctgtcttgaacataaagaatctatctgctgtt

SEQ ID NO: 313500 - DNA, 470 bp, Homo sapiens
tctccgaagccggcgaccgccccacctcctccctccctcccgcccgcttcctctgcccacagcgccggccagagcgagctagacaagggcacgcggggcctcgcctagacccgagaagactgcgggcgcgcgcaagcggcggcgtggaagctgtgagcgcccccatcccggaggtctccgccggctcccggttttttttggcctggaaaccagcagggtgcctccatttgctctctcatcctctggttcttacttgagtgtggaagtcgctccactggtggaccttgcagtggcactgagctgggtcacttcagccgtgaaaggccaactgtactactgtcaaggcttgggacagttaagcgtccgtgaaggtactggatacagcgacagcaggaagtgcagcagtgagaactgaaactaatttcacagactgtggtgttgcctgtgatgtagtctccctccctggctct

SEQ ID NO: 313501 - DNA, 352 bp, Homo sapiens
gtgaagagttgtcccagctcggcccgcgggggagccccgggagccgcacgtgtcctgggtcatgaaacttaatccacagcaagctccctcccgcccgcttcctctgcccacagcgccggccagagcgagctagacaagggcacgcggggcctcgcctagacccgagaagactgcgggcgcgcgcaagcggcggcgtggaagctgtgagcgcccccatcccggaggtctccgccggctcccggttctggagctatttgacagcgaagaccctcgggaacgggactacttaaaaacagtcttacacagaatttatggcaagtttcttggtcttagagcatttatccgaaaaacc

SEQ ID NO: 313502 - DNA, 5706 bp, Homo sapiens
gtgaagagttgtcccagctcggcccgcgggggagccccgggagccgcacgtgtcctgggtcatgaaacttaatccacagcaagctccctcccgcccgcttcctctgcccacagcgccggccagagcgagctagacaagggcacgcggggcctcgcctagacccgagaagactgcgggcgcgcgcaagcggcggcgtggaagctgtgagcgcccccatcccggaggtctccgccggctcccgggtgaatcagctcccggccgactttaggattcttctggattttaaattttttctttttaaaaaaacttggacggataaaagatgtgccatggcaggatagcaccaaagagcacctcagtgtttgccgtggcctccgtgggacatggagtgttccttccgctagtgatcctttgcaccctgcttggagacggacttgcttccgtgtgccccctaccaccggagccagagaatggtggctacatctgccacccccggccctgcagagaccccctgacagcaggcagtgtcatcgaatacctgtgtgctgaaggctacatgttgaagggcgattacaaatacctgacgtgtaagaatggcgagtggaaaccagccatggagattagctgccgtctcaacgaggataaagacacccacacatcacttggggtccccacgctgtctatagtggcttctactgccagctccgtggcgctcattctcctcctcgtggtgctgtttgtgctgctgcagccaaagctgaagtctttccatcatagcaggcgtgaccagggggtatctggggaccaggtctccatcatggtggatggagtccaggttgcactaccatcatacgaggaggctgtatatggcagttctggtcactgtgtgccacctgctgaccccagagtacagattgtgctgtcagaagggtctgggcccagtgggaggagcgtgccaagggagcaacagctgccggaccaaggggcctgctcctctgcaggtggagaagatgaggccccaggccagtctggactatgtgaagcctggggctctcgggcctcagagactgtgatggtgcatcaggcaaccacctcttcctgggtggccggctcagggaaccgccaactggcacacaaagaaactgcagattcagagaacagtgacatacaaagccttttatccctcacgtcagaggagtacacagatgatattccactgttgaaagaagcatgagggcagcggccagcctttcctctctgcgaggttctctcagcccttcctccctctccctgtgggattgagcaccctgtactctccagccaccttacctggatacctgagctgccacctgtgtatctgtgtatctctgagggccctataggcccaccttgctggaaactcaaggaagattctcgccatctgcctgttggacagctggaggagctggctctttgcctggccccgccttcccatctgtcagagacatatttgaatgtgctggatcaaaccctcccttttcctaagcctctgggtcccctccagccagctctttggcggcagcccccaccagctcctgtgggcctgagtgctgctgtgtttacttgtgcctttcccccaccctgtccagtttccctgtcatgcagacttgttgctgtccacaagccttagtggctgcactgctgccccctgccacacagggggccgggcctgggtctgtcctgtttcctttgagggttgcccctactgccctttgcaggaacagatccaggtgtgagagctcttgagtcaagagtggcagaagtggctctaattggggtgagagtgtagtccctgggcttgccctgggttgaccctggtggcatatttccttggccgaggatggaagatttggagaatcatgtccatgctggcccaggacccagccatctggcccaaaggcacaagctcctggccctgttgagttgagagtttccaagaagcatccagaagatcccaagggagagaaggaaaatggctgataatgattgtcttcctaatatgcaagttctcacttcctacttccagcatcggccttcctggccttgtcttttttttgtttccctggagtataatgggaagttgcatgctgcctcctgggttttatcccagatagctctggctttcttgctgcccacaggggcctggggcaggaaggagacttgctgagatgccatggagtgcccatctggtcactggcagtctgggcaggttgcccctttctgggtttgtggtgacggaggggaggccgagaggcacagaccaagtccccgggtggctgcaggcagctccagcccggtcctgaggatcctcctcaccatggtcacgtgccttagtaactgtgcccaggaagtggcctgctgcttgctgtgctgctgcttttcctacttctgcccttccctgccacccctcgcatgtcacagctgacaagcaattccttgtcttccctggccccctgggggaagggctgagaaacagtccatgtgcaccccaaccttaatggcctgaggtgggcagaggggtgtggagcagcctggagtacagggccctgggggaggagcccactgatgaggggcgctctcccatagccatgtgttgaatgctaactaggctggggtggacgaactctgccaactgctgtcatcttagaagatagatgcagcagtaaggaatgtttgttttgcttttttctgaaattttctgaagcactgtggctgggaaacttcgaagcggaccctgtgctgcatgtctgctcctcccctgagcctgtctgcttgggggtggtaaaaataaaaatcccagtttattttcagtaccttacctaacagggttggctccaggcgtgggtggcctagaagatgaggggagtggtcttctcccagccttttaccctcttgcctcctgcctccgcgcttacacacgcactttaccacccggtcattccctggcctcttgctgccacttgtagtcttccttccttcctctcagggtaagggcagtgcctgctgtgcctgttggccactcccacacttcccctcccccaggagccctcatctgctgtgctgagtccaggaaagcatagttaggtagggagctggttggagaaggtgctagaactagaaggcagatgagactagcatgggcccacctggagggctgtccctaatggccccagtcgccttacctcacccacagcagtgcccttgtcttcctccaaaacagaaagcagtgacaaaagggggaggggtggtaatctgaagtctcactgctgagccttcagcttttatttttcactgtttcaaaacccgcattctattctagaatggtttttaaaatggaagatcttacctttttctatcttgttactctggggttttgtccccctaagagattgcactttttgtttggggtttattcagctgcatagatgaccagcttgatccctggtgaaatgaaaagccttccttctcctgaagcctctttccgccctgccctccactaacaacactgaggagcacaagcccaggcttgcccacctggtaggaaaggaagaaattagaacaatgggagccttggctcccctctcgtctcctcccctccttcttgtcactggctttgatgaggcccacttcccagaggctcctgggcctgtgagtgcaggagctcattctcccctcactgctgaagtctgtgacagcttcttcctccagttatgtctttcttccaaagcaatttcttaaccatcagccatgtgctgctatttctagggcttctgggctttgtcccttactgagagattagggactccacagctgccttgaggtagggcctggctgagagacaagggtagcagcaggtggcaggctgttaaaagacaggctgcctgaggagcctggagcaggtggaaacaggtggaagaaaccggccacagccctgctttaccgggctcacctctagggcattccagcaagaggctgatgcaggagaatggccagcaccaaaggacatttaaaagagtttttgggtttttttgtttgtttgttgttggtgtttgtttttttttttttttttttggcacacttgagctgactcagtgcaggtttaatatcctggtgacttgcagtcacattctaatgactttcaagggccagaatatggtgaaaatcacttaaaatatccgtcccttccatgccttagtttagcaggtaggctctatcttttgccatttctgtattttatgtgctgtgttcccgtttcactgggtatgaactgtgaaatggactgaatcctggccactttatgagtttgtttggttttataaggcatttcaatgtacattctataaatacaagcactccatttgcaaacagatcttaagctaatattttctttcccattcatcttgccctccccctcctcccgccagctttaaagttcagtggagaagccagatggcaattcagacaaaggtatactcttcctgcttcatgggtggtggcacgggaatagatagcccttagccctttccctcccagtcccagctgagccctcagaccacttgcttcccacataacaatgtcgcctccatttccgaggaacatccttgcgtagagaatgaaatatgctgcaatcatttctgcatccttactcctcacccccaaagaaaaaaaaaaggcctagcagggaagcagcatgcaggcttcacagcttaatgccaaggacagcgagtgaggctgggagcttctcttgggcctgctgggtctgtcagctctcggaatagggacagtccttactggtgccccaaggtgggacttggagaatattttgcttggcatatgtttggtctgaatggtgtagttgctggttccctagagaggaaaaggtggcaggcccagctttgctgggaaatggctcttaatttccagttgaaaccctagtagaattgtgaatgaaaacctcaaggttgagcccctctgccaagcagcagagctagtagaaggggatgcaggggcaaagcactcagttgccaagcaaggaggagagatgtacgtgggctgtgtggcagtccccacaccctgccctggcttcttcaggttatcgcaccactatggaatcctttgcagaatggtactcatataatggtttaaaacaacacattcataattgactctgtgcaggatgtcactcaatcagtttgggtttgctttattttattttatatatatattttttggtatcctgtacattgcagtgggtgtgaagatagtattttaatatttgtacaaagtttaatttaattttaattgttctatgtatataactgcatttctaaataattaaaaaaaagttcttatgaaggcaaaaaaaaaaaaaaaaaaaaaaaaaaaaaaaaaaataaaaaaaaaaaaaaaaaaaaaaaaaaaaaaaaaaaaaataataaaaataaaaattaaaaaataaaaaaaaataatataaaaatggttaaaaaaaaaaaaaatatataaaaaaaaaaaatttttgggccctttgtgccacatgttctttatatctcgacaatttttttttttggcgcccaaattttgctcctctttgggaaaatcccccctatggggggggttataaaaaaataaggtggcgctttttaaacacactggggttgtgggagggcc

SEQ ID NO: 313503 - DNA, 5348 bp, Homo sapiens
tctccgaagccggcgaccgccccacctcctccctccctcccgcccgcttcctctgcccacagcgccggccagagcgagctagacaagggcacgcggggcctcgcctagacccgagaagactgcgggcgcgcgcaagcggcggcgtggaagctgtgagcgcccccatcccggaggtctccgccggctcccgggtgaatcagctcccggccgactttaggattcttctggattttaaattttttctttttaaaaaaacttggacggataaaagatgtgccatggcaggatagcaccaaagagcacctcagtgtttgccgtggcctccgtgggacatggagtgttccttccgctagtgatcctttgcaccctgcttggagacggacttgcttccgtgtgccccctaccaccggagccagagaatggtggctacatctgccacccccggccctgcagagaccccctgacagcaggcagtgtcatcgaatacctgtgtgctgaaggctacatgttgaagggcgattacaaatacctgacgtgtaagaatggcgagtggaaaccagccatggagattagctgccgtctcaacgaggataaagacacccacacatcacttggggtccccacgctgtctatagtggcttctactgccagctccgtggcgctcattctcctcctcgtggtgctgtttgtgctgctgcagccaaagctgaagtctttccatcatagcaggcgtgaccagggggtatctggggaccaggtctccatcatggtggatggagtccaggttgcactaccatcatacgaggaggctgtatatggcagttctggtcactgtgtgccacctgctgaccccagagtacagattgtgctgtcagaagggtctgggcccagtgggaggagcgtgccaagggagcaacagctgccggaccaaggggcctgctcctctgcaggtggagaagatgaggccccaggccagtctggactatgtgaagcctggggctctcgggcctcagagactgtgatggtgcatcaggcaaccacctcttcctgggtggccggctcagggaaccgccaactggcacacaaagaaactgcagattcagagaacagtgacatacaaagccttttatccctcacgtcagaggagtacacagatgatattccactgttgaaagaagcatgagggcagcggccagcctttcctctctgcgaggttctctcagcccttcctccctctccctgtgggattgagcaccctgtactctccagccaccttacctggatacctgagctgccacctgtgtatctgtgtatctctgagggccctataggcccaccttgctggaaactcaaggaagattctcgccatctgcctgttggacagctggaggagctggctctttgcctggccccgccttcccatctgtcagagacatatttgaatgtgctggatcaaaccctcccttttcctaagcctctgggtcccctccagccagctctttggcggcagcccccaccagctcctgtgggcctgagtgctgctgtgtttacttgtgcctttcccccaccctgtccagtttccctgtcatgcagacttgttgctgtccacaagccttagtggctgcactgctgccccctgccacacagggggccgggcctgggtctgtcctgtttcctttgagggttgcccctactgccctttgcaggaacagatccaggtgtgagagctcttgagtcaagagtggcagaagtggctctaattggggtgagagtgtagtccctgggcttgccctgggttgaccctggtggcatatttccttggccgaggatggaagatttggagaatcatgtccatgctggcccaggacccagccatctggcccaaaggcacaagctcctggccctgttgagttgagagtttccaagaagcatccagaagatcccaagggagagaaggaaaatggctgataatgattgtcttcctaatatgcaagttctcacttcctacttccagcatcggccttcctggccttgtcttttttttgtttccctggagtataatgggaagttgcatgctgcctcctgggttttatcccagatagctctggctttcttgctgcccacaggggcctggggcaggaaggagacttgctgagatgccatggagtgcccatctggtcactggcagtctgggcaggttgcccctttctgggtttgtggtgacggaggggaggccgagaggcacagaccaagtccccgggtggctgcaggcagctccagcccggtcctgaggatcctcctcaccatggtcacgtgccttagtaactgtgcccaggaagtggcctgctgcttgctgtgctgctgcttttcctacttctgcccttccctgccacccctcgcatgtcacagctgacaagcaattccttgtcttccctggccccctgggggaagggctgagaaacagtccatgtgcaccccaaccttaatggcctgaggtgggcagaggggtgtggagcagcctggagtacagggccctgggggaggagcccactgatgaggggcgctctcccatagccatgtgttgaatgctaactaggctggggtggacgaactctgccaactgctgtcatcttagaagatagatgcagcagtaaggaatgtttgttttgcttttttctgaaattttctgaagcactgtggctgggaaacttcgaagcggaccctgtgctgcatgtctgctcctcccctgagcctgtctgcttgggggtggtaaaaataaaaatcccagtttattttcagtaccttacctaacagggttggctccaggcgtgggtggcctagaagatgaggggagtggtcttctcccagccttttaccctcttgcctcctgcctccgcgcttacacacgcactttaccacccggtcattccctggcctcttgctgccacttgtagtcttccttccttcctctcagggtaagggcagtgcctgctgtgcctgttggccactcccacacttcccctcccccaggagccctcatctgctgtgctgagtccaggaaagcatagttaggtagggagctggttggagaaggtgctagaactagaaggcagatgagactagcatgggcccacctggagggctgtccctaatggccccagtcgccttacctcacccacagcagtgcccttgtcttcctccaaaacagaaagcagtgacaaaagggggaggggtggtaatctgaagtctcactgctgagccttcagcttttatttttcactgtttcaaaacccgcattctattctagaatggtttttaaaatggaagatcttacctttttctatcttgttactctggggttttgtccccctaagagattgcactttttgtttggggtttattcagctgcatagatgaccagcttgatccctggtgaaatgaaaagccttccttctcctgaagcctctttccgccctgccctccactaacaacactgaggagcacaagcccaggcttgcccacctggtaggaaaggaagaaattagaacaatgggagccttggctcccctctcgtctcctcccctccttcttgtcactggctttgatgaggcccacttcccagaggctcctgggcctgtgagtgcaggagctcattctcccctcactgctgaagtctgtgacagcttcttcctccagttatgtctttcttccaaagcaatttcttaaccatcagccatgtgctgctatttctagggcttctgggctttgtcccttactgagagattagggactccacagctgccttgaggtagggcctggctgagagacaagggtagcagcaggtggcaggctgttaaaagacaggctgcctgaggagcctggagcaggtggaaacaggtggaagaaaccggccacagccctgctttaccgggctcacctctagggcattccagcaagaggctgatgcaggagaatggccagcaccaaaggacatttaaaagagtttttgggtttttttgtttgtttgttgttggtgtttgtttttttttttttttttttggcacacttgagctgactcagtgcaggtttaatatcctggtgacttgcagtcacattctaatgactttcaagggccagaatatggtgaaaatcacttaaaatatccgtcccttccatgccttagtttagcaggtaggctctatcttttgccatttctgtattttatgtgctgtgttcccgtttcactgggtatgaactgtgaaatggactgaatcctggccactttatgagtttgtttggttttataaggcatttcaatgtacattctataaatacaagcactccatttgcaaacagatcttaagctaatattttctttcccattcatcttgccctccccctcctcccgccagctttaaagttcagtggagaagccagatggcaattcagacaaaggtatactcttcctgcttcatgggtggtggcacgggaatagatagcccttagccctttccctcccagtcccagctgagccctcagaccacttgcttcccacataacaatgtcgcctccatttccgaggaacatccttgcgtagagaatgaaatatgctgcaatcatttctgcatccttactcctcacccccaaagaaaaaaaaaaggcctagcagggaagcagcatgcaggcttcacagcttaatgccaaggacagcgagtgaggctgggagcttctcttgggcctgctgggtctgtcagctctcggaatagggacagtccttactggtgccccaaggtgggacttggagaatattttgcttggcatatgtttggtctgaatggtgtagttgctggttccctagagaggaaaaggtggcaggcccagctttgctgggaaatggctcttaatttccagttgaaaccctagtagaattgtgaatgaaaacctcaaggttgagcccctctgccaagcagcagagctagtagaaggggatgcaggggcaaagcactcagttgccaagcaaggaggagagatgtacgtgggctgtgtggcagtccccacaccctgccctggcttcttcaggttatcgcaccactatggaatcctttgcagaatggtactcatataatggtttaaaacaacacattcataattgactctgtgcaggatgtcactcaatcagtttgggtttgctttattttattttatatatatattttttggtatcctgtacattgcagtgggtgtgaagatagtattttaatatttgtacaaagtttaatttaattttaattgttctatgtatataactgcatttctaaataattaaaaaaaagttcttatgaaggcaa

SEQ ID NO: 313504 - DNA, 4891 bp, Homo sapiens
gtgaagagttgtcccagctcggcccgcgggggagccccgggagccgcacgtgtcctgggtcatgaaacttaatccacagcaagctccctcccgcccgcttcctctgcccacagcgccggccagagcgagctagacaagggcacgcggggcctcgcctagacccgagaagactgcgggcgcgcgcaagcggcggcgtggaagctgtgagcgcccccatcccggaggtctccgccggctcccgggtgaatcagctcccggccgactttaggattcttctggattttaaattttttctttttaaaaaaacttggacggataaaagatgtgccatggcaggatagcaccaaagagcacctcagtgtttgccgtggcctccgtgggacatggagtgttccttccgctagtgatcctttgcaccctgcttggagacggacttgcttccgtgtgccccctaccaccggagccagagaatggtggctacatctgccacccccggccctgcagagaccccctgacagcaggcagtgtcatcgaatacctgtgtgctgaaggctacatgttgaagggcgattacaaatacctgacgtgtaagaatggcgagtggaaaccagccatggagattagctgccgtctcaacgaggataaagacacccacacatcacttggggtccccacgctgtctatagtggcttctactgccagctccgtggcgctcattctcctcctcgtggtgctgtttgtgctgctgcagccaaagctgaagtctttccatcatagcaggcgtgaccagggggtatctggggaccaggtctccatcatggtggatggagtccaggttgcactaccatcatacgaggaggctgtatatggcagttctggtcactgtgtgccacctgctgaccccagagtacagattgtgctgtcagaagggtctgggcccagtgggaggagcgtgccaagggagcaacagctgccggaccaaggggcctgctcctctgcaggtggagaagatgaggccccaggccagtctggactatgtgaagcctggggctctcgggcctcagagactgtgatggtgcatcaggcaaccacctcttcctgggtggccggctcagggaaccgccaactggcacacaaagaaactgcagattcagagaacagtgacatacaaagccttttatccctcacgtcagaggagtacacagatgatattccactgttgaaagaagcatgagggcagcggccagcctttcctctctgcgaggttctctcagcccttcctccctctccctgtgggattgagcaccctgtactctccagccaccttacctggatacctgagctgccacctgtgtatctgtgtatctctgagggccctataggcccaccttgctggaaactcaaggaagattctcgccatctgcctgttggacagctggaggagctggctctttgcctggccccgccttcccatctgtcagagacatatttgaatgtgctggatcaaaccctcccttttcctaagcctctgggtcccctccagccagctctttggcggcagcccccaccagctcctgtgggcctgagtgctgctgtgtttacttgtgcctttcccccaccctgtccagtttccctgtcatgcagacttgttgctgtccacaagccttagtggctgcactgctgccccctgccacacagggggccgggcctgggtctgtcctgtttcctttgagggttgcccctactgccctttgcaggaacagatccaggtgtgagagctcttgagtcaagagtggcagaagtggctctaattggggtgagagtgtagtccctgggcttgccctgggttgaccctggtggcatatttccttggccgaggatggaagatttggagaatcatgtccatgctggcccaggacccagccatctggcccaaaggcacaagctcctggccctgttgagttgagagtttccaagaagcatccagaagatcccaagggagagaaggaaaatggctgataatgattgtcttcctaatatgcaagttctcacttcctacttccagcatcggccttcctggccttgtcttttttttgtttccctggagtataatgggaagttgcatgctgcctcctgggttttatcccagatagctctggctttcttgctgcccacaggggcctggggcaggaaggagacttgctgagatgccatggagtgcccatctggtcactggcagtctgggcaggttgcccctttctgggtttgtggtgacggaggggaggccgagaggcacagaccaagtccccgggtggctgcaggcagctccagcccggtcctgaggatcctcctcaccatggtcacgtgccttagtaactgtgcccaggaagtggcctgctgcttgctgtgctgctgcttttcctacttctgcccttccctgccacccctcgcatgtcacagctgacaagcaattccttgtcttccctggccccctgggggaagggctgagaaacagtccatgtgcaccccaaccttaatggcctgaggtgggcagaggggtgtggagcagccaggagccctcatctgctgtgctgagtccaggaaagcatagttaggtagggagctggttggagaaggtgctagaactagaaggcagatgagactagcatgggcccacctggagggctgtccctaatggccccagtcgccttacctcacccacagcagtgcccttgtcttcctccaaaacagaaagcagtgacaaaagggggaggggtggtaatctgaagtctcactgctgagccttcagcttttatttttcactgtttcaaaacccgcattctattctagaatggtttttaaaatggaagatcttacctttttctatcttgttactctggggttttgtccccctaagagattgcactttttgtttggggtttattcagctgcatagatgaccagcttgatccctggtgaaatgaaaagccttccttctcctgaagcctctttccgccctgccctccactaacaacactgaggagcacaagcccaggcttgcccacctggtaggaaaggaagaaattagaacaatgggagccttggctcccctctcgtctcctcccctccttcttgtcactggctttgatgaggcccacttcccagaggctcctgggcctgtgagtgcaggagctcattctcccctcactgctgaagtctgtgacagcttcttcctccagttatgtctttcttccaaagcaatttcttaaccatcagccatgtgctgctatttctagggcttctgggctttgtcccttactgagagattagggactccacagctgccttgaggtagggcctggctgagagacaagggtagcagcaggtggcaggctgttaaaagacaggctgcctgaggagcctggagcaggtggaaacaggtggaagaaaccggccacagccctgctttaccgggctcacctctagggcattccagcaagaggctgatgcaggagaatggccagcaccaaaggacatttaaaagagtttttgggtttttttgtttgtttgttgttggtgtttgtttttttttttttttttttggcacacttgagctgactcagtgcaggtttaatatcctggtgacttgcagtcacattctaatgactttcaagggccagaatatggtgaaaatcacttaaaatatccgtcccttccatgccttagtttagcaggtaggctctatcttttgccatttctgtattttatgtgctgtgttcccgtttcactgggtatgaactgtgaaatggactgaatcctggccactttatgagtttgtttggttttataaggcatttcaatgtacattctataaatacaagcactccatttgcaaacagatcttaagctaatattttctttcccattcatcttgccctccccctcctcccgccagctttaaagttcagtggagaagccagatggcaattcagacaaaggtatactcttcctgcttcatgggtggtggcacgggaatagatagcccttagccctttccctcccagtcccagctgagccctcagaccacttgcttcccacataacaatgtcgcctccatttccgaggaacatccttgcgtagagaatgaaatatgctgcaatcatttctgcatccttactcctcacccccaaagaaaaaaaaaaggcctagcagggaagcagcatgcaggcttcacagcttaatgccaaggacagcgagtgaggctgggagcttctcttgggcctgctgggtctgtcagctctcggaatagggacagtccttactggtgccccaaggtgggacttggagaatattttgcttggcatatgtttggtctgaatggtgtagttgctggttccctagagaggaaaaggtggcaggcccagctttgctgggaaatggctcttaatttccagttgaaaccctagtagaattgtgaatgaaaacctcaaggttgagcccctctgccaagcagcagagctagtagaaggggatgcaggggcaaagcactcagttgccaagcaaggaggagagatgtacgtgggctgtgtggcagtccccacaccctgccctggcttcttcaggttatcgcaccactatggaatcctttgcagaatggtactcatataatggtttaaaacaacacattcataattgactctgtgcaggatgtcactcaatcagtttgggtttgctttattttattttatatatatattttttggtatcctgtacattgcagtgggtgtgaagatagtattttaatatttgtacaaagtttaatttaattttaattgttctatgtatataactgcatttctaaataattaaaaaaaagttcttatgaaggcaa

SEQ ID NO: 313505 - DNA, 4134 bp, Homo sapiens
ggtgtcagtgggtcgcgggcctacggggcgggggcggggcggcagtgagctcggccggcaaccgagggacccgcgtccagatcttcagtgtctattggatttttccaagagaaagtttgtaaaattccttacactgtagatgtggatcagatacgatgattcagtagaagagcacatgtcaggggcagtggaggctggctgctgaaggatgaacggagaggaagaattctttgatgccgtcacagaggcaaatcagaaagtcacgggaatgattgacttagacaccagcaaaaataataggattgggaaaactggggagaggccctctcaagagaacggaattcagaaacacaggacatcgctgccggctcccatgttcagcagaagcgacttcagcgtgtggaccatcctgaagaagtgtgttggcctggagctgtccaagatcacgatgccaatcgccttcaacgagcctctgagcttcttgcagcggatcacggagtacatggagcacgtgtacctcatccacagggcctcctgccagccccagcccctggagaggatgcagtctgtggctgcttttgctgtttcggctgtggcttcccagtgggagaggaccggcaaaccatttaatccactcttgggagaaacgtatgaattaatcagggaagatttaggattcagatttatatcggaacaggtcagtcaccacccccccatcagtgcgttccactcggaaggtctcaaccatgacttcctgttccatggctccatctaccccaagctcaagttctggggcaaaagcgtggaggcggagccccgaggcaccatcaccctggagctgctcaaacataatgaagcctacacctggaccaaccccacctgctgcgtccacaacgtcatcatcgggaagctgtggatagagcagtatgggacagtggagattttaaaccacagaactggacataagtgtgtgcttcactttaaaccgtgtggattatttggaaaagaacttcacaaggtggaaggacacattcaagacaaaaacaaaaagaagctctttatgatctatggcaaatggacggaatgtttgtggggcatagatcctgtttcgtatgaatccttcaagaagcaggagaggagaggtgaccacctgagaaaggccaagctggatgaagactccgggaaggctgacagcgacgtggctgacgacgtgcctgtggcccaggagaccgtgcaggtcattcctggcagcaagctgctctggaggatcaacacccggccccccaactctgcccagatgtataatttcaccagtttcactgtgagcctcaacgagctggagacaggcatggagaagaccctgccacccacggactgccgcctgcgccctgacatccgcggcatggagaatggcaacatggatctggccagccaggagaaggagcggctggaggagaagcagagagaagcacggagggagcgggccaaggaggaggcagagtggcagacgaggtggttctacccaggcaataacccctacactgggacccccgactggttgtatgcaggggattactttgagcggaatttctccgactgcccagatatctactgagggcctggaggggcctggggcccgggaccggaggctgacgaggctggacttcctcgagtggccactgtgagcctcgtcacagcagaaaccaacttttctaacgactgagttcgcggagatagcatcatccctgatcaaggatgtaattctaattaactgttgattgccaaacatttcactctgctgtgccgtctcttcataaagcttcacttgggatcatcgtcttcattaaggtttcaacagggaaattcttcacggcgcccttttatgtggcagaaatcagctggggcttgtttagcttccagcacactctcagtcatagcatgtgtagctaaaggaagtaatgggaaggggttcatgttctctttataatgcagtggcaaaaggttctgaaagccttttaaactcgaaccagtgggggaaagatggatcttgaagctaatcctgcagagagttttatagaggccagggattgccttctaaattatgataaaacagaagtgaagagtttcagagcatcagattgagtgaaaagttgtcagattctgtattttttaacaatcttcaataatgtaaagattacttttaaaatatttaagttaaaactacttgaatagtattttgctgaagagcaagatatgcattaatcaccggttttatactgtccaaaatgaagcatccccgtgacaaaccagagtgggcagaagcatcgagagcgtgacaggaaatcccaagactgcttccgcctcagaggcgtcccggctgcgattcgctgccctgttgtcagtgaggcctggctgtcaccgcacaccgcgtccgtgtctccagggggttcctttcttctcacacgtcgcgtgtacccatagcactcttgtgtttctgtttttcccagtatgcatgtttaaaatagaagtgacaagaatcacatccggttgtgtcctgtgggagggtcagaggcagaatctacttacagtggtgtaattaaagttatttaaccaaaaataggtatgtgtccatctcagcattcacctttatcaagtgactgatttttttttcttttctttccttttttttttttttttgagacggagtttcactcttgttgcccaggctggagtgcaatggcatgatctcggctcaccgcaacctccgcctcccgggttcaagcgattctcctgcctcagcctcccaagtagctgggattacaggcacgcgccaccacgcctggctgattttgtatttttagtagacacgggttttcaccatgttggtcaggctggtctcaaactcccgacctcaagtagtctgcctgcctcaacctcccaaagtgctgggattacaggcgtgagccactgcgcctggccgtgactgattttttttcatgtagaattgtcaacacgagagatcacagtggagcactttgaaagaccgtcggttgtgtgcacgcacgcacacactcatgcacacgctgacacgcggttgcatggagtccaggttactcaggccggcacttctgagtgacaggtgccacctgcgtgtgtcttggcgtccacatcacacctgtgacggaagcacttctggaagtgaacactcgttttgaaagcttgattttgtagctttggaagctggaagcgatggtgtttggtgccgagtcctgtgtcatcctcggggcctatgagctccgtaccagccactcaaaagtgtctgaacagaaccgctccgtgactggtagctgggtctgaggattcaggattgtggcgttattcaaagaggagactttgaaattccccgatggctggaatgtggagcccaggtgcctctggtggagggtcatctgcttttccagactgtggttgtgaaccggctccttctccaagaaaggttgcaagctgagaacatccagaggtgagactcagacacattgaaagtgactgcatttagggaggtttaacgagttcttactgatcattccacttgttactggttaagataatttgcccacgggtttgtttccaagtcctcttctaggaccaggctcctggtatttcaggggctggttggctgcacagacagcccctcttctgctgtccttgaggacagacaccaaaccagaggtggaggaagaacggtaggaaggctgatggcaaaagcggctgtgtgtcgaggttattttaactttttactactttttgttactgtttctgcaaatgctaacacataaaccatgacctaacttttgtcaccttggatatctattgaatgttaaacatctctaataaagatggccaccacttaatgtgtggaaagtgatggccttctcgtgggccacgcgtttgggtgtgagtatggccttgaccaagggtcttggtgctttattcacttttagagatagggtcaccttgcccaggctcgagtgcagtggtgcagtcatagctcactgcagcctcgacatcctgggctcaagcagtcctccagcctcagcctcccaagtagctaggaccataggcacatgccaccaa

SEQ ID NO: 313506 - DNA, 1878 bp, Homo sapiens
ggtgtcagtgggtcgcgggcctacggggcgggggcggggcggcagtgagctcggccggcaaccgagggacccgcgtccagatcttcagtgtctattggatttttccaagagaaagtttgtaaaattccttacactgtagatgtggatcagatacgatgattcagtagaagagcacatgtcaggggcagtggaggctggctgctgaaggatgaacggagaggaagaattctttgatgccgtcacaggctttgattctgataactcttctggggaattttcagaggcaaatcagaaagtcacgggaatgattgacttagacaccagcaaaaataataggattgggaaaactggggagaggccctctcaagagaacggaattcagaaacacaggacatcgctgccggctcccatgttcagcagaagcgacttcagcgtgtggaccatcctgaagaagtgtgttggcctggagctgtccaagatcacgatgccaatcgccttcaacgagcctctgagcttcttgcagcggatcacggagtacatggagcacgtgtacctcatccacagggcctcctgccagccccagcccctggagaggatgcagtctgtggctgcttttgctgtttcggctgtggcttcccagtgggagaggaccggcaaaccatttaatccactcttgggagaaacgtatgaattaatcagggaagatttaggattcagatttatatcggaacaggtcagtcaccacccccccatcagtgcgttccactcggaaggtctcaaccatgacttcctgttccatggctccatctaccccaagctcaagttctggggcaaaagcgtggaggcggagccccgaggcaccatcaccctggagctgctcaaacataatgaagcctacacctggaccaaccccacctgctgcgtccacaacgtcatcatcgggaagctgtggatagagcagtatgggacagtggagattttaaaccacagaactggacataagtgtgtgcttcactttaaaccgtgtggattatttggaaaagaacttcacaaggtggaaggacacattcaagacaaaaacaaaaagaagctctttatgatctatggcaaatggacggaatgtttgtggggcatagatcctgtttcgtatgaatccttcaagaagcaggagaggagaggtgaccacctgagaaaggccaagctggatgaagactccgggaaggctgacagcgacgtggctgacgacgtgcctgtggcccaggagaccgtgcaggtcattcctggcagcaagctgctctggaggatcaacacccggccccccaactctgcccagatgtataatttcaccagtttcactgtgagcctcaacgagctggagacaggcatggagaagaccctgccacccacggactgccgcctgcgccctgacatccgcggcatggagaatggcaacatggatctggccagccaggagaaggagcggctggaggagaagcagagagaagcacggagggagcgggccaaggaggaggcagagtggcagacgaggtggttctacccaggcaataacccctacactgggacccccgactggttgtatgcaggggattactttgagcggaatttctccgactgcccagatatctactgagggcctggaggggcctggggcccgggaccggaggctgacgaggctggacttcctcgagtggccactgtgagcctcgtcacagcagaaaccaacttttctaacgactgagttcgcggagatagcatcatccctgatcaaggatgtaattctaattaactgttgattgccaaacatttcactctgctgtgccgtctcttcataaagcttcacttgggatcatcgtcttc

SEQ ID NO: 313507 - DNA, 373 bp, Homo sapiens
ggtgtcagtgggtcgcgggcctacggggcgggggcggggcggcagtgagctcggccggcaaccgagggacccgcgtccagatcttcagtgtctattggatttttccaagagaaagtttgtaaaattccttacactgtagatgtggatcagatacgatgattcagtagaagagcacatgtcaggggcagtggaggctggctgctgaaggatgaacggagaggaagaattctttgatgccgtcacaggtgagtcaaaagagaaccaactggggacgtactggaagggtgaacgtccctggattcagatgttggacctggcgtttggggtgtaaagatgctcagtaaagcagtgtgtgggtgagcgttcacgatcc

SEQ ID NO: 313508 - DNA, 4115 bp, Homo sapiens
ggtgtcagtgggtcgcgggcctacggggcgggggcggggcggcagtgagctcggccggcaaccgagggacccgcgtccagatcttcagtgtctattggatttttccaagagaaagtttgtaaaattccttacactgtagatgtggatcagatacgatgattcagtagaagagcacatgtcaggggcagtggaggctggctgctgaaggatgaacggagaggaagaattctttgatgccgtcacaggctttgattctgataactcttctggggaattttcagaggcaaatcagaaagtcacgggaatgattgacttagacaccagcaaaaataataggattgggaaaactggggagaggccctctcaagagaacggaattcagaaacacaggacatcgctgccggctcccatgttcagcagaagcgacttcagcgtgtggaccatcctgaagaagtgtgttggcctggagctgtccaagatcacgatgccaatcgccttcaacgagcctctgagcttcttgcagcggatcacggagtacatggagcacgtgtacctcatccacagggcctcctgccagccccagcccctggagaggatgcagtctgtggctgcttttgctgtttcggctgtggcttcccagtgggagaggaccggcaaaccatttaatccactcttgggagaaacgtatgaattaatcagggaagatttaggattcagatttatatcggaacaggtcagtcaccacccccccatcagtgcgttccactcggaaggtctcaaccatgacttcctgttccatggctccatctaccccaagctcaagttctggggcaaaagcgtggaggcggagccccgaggcaccatcaccctggagctgctcaaacataatgaagcctacacctggaccaaccccacctgctgcgtccacaacgtcatcatcgggaagctgtggatagagcagtatgggacagtggagattttaaaccacagaactggacataagtgtgtgcttcactttaaaccgtgtggattatttggaaaagaacttcacaaggtggaaggacacattcaagacaaaaacaaaaagaagctctttatgatctatggcaaatggacggaatgtttgtggggcatagatcctgtttcgtatgaatccttcaagaagcaggagaggagaggtgaccacctgagaaaggccaagctggatgaagactccgggaaggctgacagcgacgtggctgacgacgtgcctgtggcccaggagaccgtgcaggtcattcctggcagcaagctgctctggaggatcaacacccggccccccaactctgcccagatgtataatttcaccagtttcactgtgagcctcaacgagctggagacaggcatggagaagaccctgccacccacggactgccgcctgcgccctgacatccgcggcatggagaatggcaacatggatctggccagccaggagaaggagcggctggaggagaagcagagagaagcacggagggagcgggccaaggaggaggcagagtggcagacgaggtggttctacccaggcaataacccctacactgggacccccgactggttgtatgcaggggattactttgagcggaatttctccgactgcccagatatctactgagggcctggaggggcctggggcccgggaccggaggctgacgaggctggacttcctcgagtggccactgtgagcctcgtcacagcagaaaccaacttttctaacgactgagttcgcggagatagcatcatccctgatcaaggatgtaattctaattaactgttgattgccaaacatttcactctgctgtgccgtctcttcataaagcttcacttgggatcatcgtcttcattaaggtttcaacagggaaattcttcacggcgcccttttatgtggcagaaatcagctggggcttgtttagcttccagcacactctcagtcatagcatgtgtagctaaaggaagtaatgggaaggggttcatgttctctttataatgcagtggcaaaaggttctgaaagccttttaaactcgaaccagtgggggaaagatggatcttgaagctaatcctgcagagagttttatagaggccagggattgccttctaaattatgataaaacagaagtgaagagtttcagagcatcagattgagtgaaaagttgtcagattctgtattttttaacaatcttcaataatgtaaagattacttttaaaatatttaagttaaaactacttgaatagtattttgctgaagagcaagatatgcattaatcaccggttttatactgtccaaaatgaagcatccccgtgacaaaccagagtgggcagaagcatcgagagcgtgacaggaaatcccaagactgcttccgcctcagaggcgtcccggctgcgattcgctgccctgttgtcagtgaggcctggctgtcaccgcacaccgcgtccgtgtctccagggggttcctttcttctcacacgtcgcgtgtacccatagcactcttgtgtttctgtttttcccagtatgcatgtttaaaatagaagtgacaagaatcacatccggttgtgtcctgtgggagggtcagaggcagaatctacttacagtggtgtaattaaagttatttaaccaaaaataggtatgtgtccatctcagcattcacctttatcaagtgactgatttttttttcttttctttccttttttttttttttttgagacggagtttcactcttgttgcccaggctggagtgcaatggcatgatctcggctcaccgcaacctccgcctcccgggttcaagcgattctcctgcctcagcctcccaagtagctgggattacaggcacgcgccaccacgcctggctgattttgtatttttagtagacacgggttttcaccatgttggtcaggctggtctcaaactcccgacctcaagtagtctgcctgcctcaacctcccaaagtgctgggattacaggcgtgagccactgcgcctggccgtgactgattttttttcatgtagaattgtcaacacgagagatcacagtggagcactttgaaagaccgtcggttgtgtgcacgcacgcacacactcatgcacacgctgacacgcggttgcatggagtccaggttactcaggccggcacttctgagtgacaggtgccacctgcgtgtgtcttggcgtccacatcacacctgtgacggaagcacttctggaagtgaacactcgttttgaaagcttgattttgtagctttggaagctggaagcgatggtgtttggtgccgagtcctgtgtcatcctcggggcctatgagctccgtaccagccactcaaaagtgtctgaacagaaccgctccgtgactggtagctgggtctgaggattcaggattgtggcgttattcaaagaggagactttgaaattccccgactgtggttgtgaaccggctccttctccaagaaaggttgcaagctgagaacatccagaggtgagactcagacacattgaaagtgactgcatttagggaggtttaacgagttcttactgatcattccacttgttactggttaagataatttgcccacgggtttgtttccaagtcctcttctaggaccaggctcctggtatttcaggggctggttggctgcacagacagcccctcttctgctgtccttgaggacagacaccaaaccagaggtggaggaagaacggtaggaaggctgatggcaaaagcggctgtgtgtcgaggttattttaactttttactactttttgttactgtttctgcaaatgctaacacataaaccatgacctaacttttgtcaccttggatatctattgaatgttaaacatctctaataaagatggccaccacttaatgtgtggaaagtgatggccttctcgtgggccacgcgtttgggtgtgagtatggccttgaccaagggtcttggtgctttattcacttttagagatagggtcaccttgcccaggctcgagtgcagtggtgcagtcatagctcactgcagcctcgacatcctgggctcaagcagtcctccagcctcagcctcccaagtagctaggaccataggcacatgccaccaa

SEQ ID NO: 313509 - DNA, 4176 bp, Homo sapiens
ccccgttctctcttcaggagaggctcagccagctccttcctggtcccggcacgtctctagtggcgccgactgacagtggcccaccaatcttcagtgtctattggatttttccaagagaaagtttgtaaaattccttacactgtagatgtggatcagatacgatgattcagtagaagagcacatgtcaggggcagtggaggctggctgctgaaggatgaacggagaggaagaattctttgatgccgtcacaggctttgattctgataactcttctggggaattttcagaggcaaatcagaaagtcacgggaatgattgacttagacaccagcaaaaataataggattgggaaaactggggagaggccctctcaagagaacggaattcagaaacacaggacatcgctgccggctcccatgttcagcagaagcgacttcagcgtgtggaccatcctgaagaagtgtgttggcctggagctgtccaagatcacgatgccaatcgccttcaacgagcctctgagcttcttgcagcggatcacggagtacatggagcacgtgtacctcatccacagggcctcctgccagccccagcccctggagaggatgcagtctgtggctgcttttgctgtttcggctgtggcttcccagtgggagaggaccggcaaaccatttaatccactcttgggagaaacgtatgaattaatcagggaagatttaggattcagatttatatcggaacaggtcagtcaccacccccccatcagtgcgttccactcggaaggtctcaaccatgacttcctgttccatggctccatctaccccaagctcaagttctggggcaaaagcgtggaggcggagccccgaggcaccatcaccctggagctgctcaaacataatgaagcctacacctggaccaaccccacctgctgcgtccacaacgtcatcatcgggaagctgtggatagagcagtatgggacagtggagattttaaaccacagaactggacataagtgtgtgcttcactttaaaccgtgtggattatttggaaaagaacttcacaaggtggaaggacacattcaagacaaaaacaaaaagaagctctttatgatctatggcaaatggacggaatgtttgtggggcatagatcctgtttcgtatgaatccttcaagaagcaggagaggagaggtgaccacctgagaaaggccaagctggatgaagactccgggaaggctgacagcgacgtggctgacgacgtgcctgtggcccaggagaccgtgcaggtcattcctggcagcaagctgctctggaggatcaacacccggccccccaactctgcccagatgtataatttcaccagtttcactgtgagcctcaacgagctggagacaggcatggagaagaccctgccacccacggactgccgcctgcgccctgacatccgcggcatggagaatggcaacatggatctggccagccaggagaaggagcggctggaggagaagcagagagaagcacggagggagcgggccaaggaggaggcagagtggcagacgaggtggttctacccaggcaataacccctacactgggacccccgactggttgtatgcaggggattactttgagcggaatttctccgactgcccagatatctactgagggcctggaggggcctggggcccgggaccggaggctgacgaggctggacttcctcgagtggccactgtgagcctcgtcacagcagaaaccaacttttctaacgactgagttcgcggagatagcatcatccctgatcaaggatgtaattctaattaactgttgattgccaaacatttcactctgctgtgccgtctcttcataaagcttcacttgggatcatcgtcttcattaaggtttcaacagggaaattcttcacggcgcccttttatgtggcagaaatcagctggggcttgtttagcttccagcacactctcagtcatagcatgtgtagctaaaggaagtaatgggaaggggttcatgttctctttataatgcagtggcaaaaggttctgaaagccttttaaactcgaaccagtgggggaaagatggatcttgaagctaatcctgcagagagttttatagaggccagggattgccttctaaattatgataaaacagaagtgaagagtttcagagcatcagattgagtgaaaagttgtcagattctgtattttttaacaatcttcaataatgtaaagattacttttaaaatatttaagttaaaactacttgaatagtattttgctgaagagcaagatatgcattaatcaccggttttatactgtccaaaatgaagcatccccgtgacaaaccagagtgggcagaagcatcgagagcgtgacaggaaatcccaagactgcttccgcctcagaggcgtcccggctgcgattcgctgccctgttgtcagtgaggcctggctgtcaccgcacaccgcgtccgtgtctccagggggttcctttcttctcacacgtcgcgtgtacccatagcactcttgtgtttctgtttttcccagtatgcatgtttaaaatagaagtgacaagaatcacatccggttgtgtcctgtgggagggtcagaggcagaatctacttacagtggtgtaattaaagttatttaaccaaaaataggtatgtgtccatctcagcattcacctttatcaagtgactgatttttttttcttttctttccttttttttttttttttgagacggagtttcactcttgttgcccaggctggagtgcaatggcatgatctcggctcaccgcaacctccgcctcccgggttcaagcgattctcctgcctcagcctcccaagtagctgggattacaggcacgcgccaccacgcctggctgattttgtatttttagtagacacgggttttcaccatgttggtcaggctggtctcaaactcccgacctcaagtagtctgcctgcctcaacctcccaaagtgctgggattacaggcgtgagccactgcgcctggccgtgactgattttttttcatgtagaattgtcaacacgagagatcacagtggagcactttgaaagaccgtcggttgtgtgcacgcacgcacacactcatgcacacgctgacacgcggttgcatggagtccaggttactcaggccggcacttctgagtgacaggtgccacctgcgtgtgtcttggcgtccacatcacacctgtgacggaagcacttctggaagtgaacactcgttttgaaagcttgattttgtagctttggaagctggaagcgatggtgtttggtgccgagtcctgtgtcatcctcggggcctatgagctccgtaccagccactcaaaagtgtctgaacagaaccgctccgtgactggtagctgggtctgaggattcaggattgtggcgttattcaaagaggagactttgaaattccccgatggctggaatgtggagcccaggtgcctctggtggagggtcatctgcttttccagactgtggttgtgaaccggctccttctccaagaaaggttgcaagctgagaacatccagaggtgagactcagacacattgaaagtgactgcatttagggaggtttaacgagttcttactgatcattccacttgttactggttaagataatttgcccacgggtttgtttccaagtcctcttctaggaccaggctcctggtatttcaggggctggttggctgcacagacagcccctcttctgctgtccttgaggacagacaccaaaccagaggtggaggaagaacggtaggaaggctgatggcaaaagcggctgtgtgtcgaggttattttaactttttactactttttgttactgtttctgcaaatgctaacacataaaccatgacctaacttttgtcaccttggatatctattgaatgttaaacatctctaataaagatggccaccacttaatgtgtggaaagtgatggccttctcgtgggccacgcgtttgggtgtgagtatggccttgaccaagggtcttggtgctttattcacttttagagatagggtcaccttgcccaggctcgagtgcagtggtgcagtcatagctcactgcagcctcgacatcctgggctcaagcagtcctccagcctcagcctcccaagtagctaggaccataggcacatgccaccaa

SEQ ID NO: 313510 - DNA, 3389 bp, Homo sapiens
ttaagtgatttttagtaaattgaccgaatcatggagccgtccccacagcccatttcaaacacttccatcgccccaaaggcccaccacacccatttgcagtcaccccccgcctgccccaggggcctccaccgcgcttctcctgttacagagttaccctttccggctgtttgctgtcttgcagcagaaacctgtgtttgtttttctcacagaactggacataagtgtgtgcttcactttaaaccgtgtggattatttggaaaagaacttcacaaggtggaaggacacattcaagacaaaaacaaaaagaagctctttatgatctatggcaaatggacggaatgtttgtggggcatagatcctgtttcgtatgaatccttcaagaagcaggagaggagaggtgaccacctgagaaaggccaagctggatgaagactccgggaaggctgacagcgacgtggctgacgacgtgcctgtggcccaggagaccgtgcaggtcattcctggcagcaagctgctctggaggatcaacacccggccccccaactctgcccagatgtataatttcaccagtttcactgtgagcctcaacgagctggagacaggcatggagaagaccctgccacccacggactgccgcctgcgccctgacatccgcggcatggagaatggcaacatggatctggccagccaggagaaggagcggctggaggagaagcagagagaagcacggagggagcgggccaaggaggaggcagagtggcagacgaggtggttctacccaggcaataacccctacactgggacccccgactggttgtatgcaggggattactttgagcggaatttctccgactgcccagatatctactgagggcctggaggggcctggggcccgggaccggaggctgacgaggctggacttcctcgagtggccactgtgagcctcgtcacagcagaaaccaacttttctaacgactgagttcgcggagatagcatcatccctgatcaaggatgtaattctaattaactgttgattgccaaacatttcactctgctgtgccgtctcttcataaagcttcacttgggatcatcgtcttcattaaggtttcaacagggaaattcttcacggcgcccttttatgtggcagaaatcagctggggcttgtttagcttccagcacactctcagtcatagcatgtgtagctaaaggaagtaatgggaaggggttcatgttctctttataatgcagtggcaaaaggttctgaaagccttttaaactcgaaccagtgggggaaagatggatcttgaagctaatcctgcagagagttttatagaggccagggattgccttctaaattatgataaaacagaagtgaagagtttcagagcatcagattgagtgaaaagttgtcagattctgtattttttaacaatcttcaataatgtaaagattacttttaaaatatttaagttaaaactacttgaatagtattttgctgaagagcaagatatgcattaatcaccggttttatactgtccaaaatgaagcatccccgtgacaaaccagagtgggcagaagcatcgagagcgtgacaggaaatcccaagactgcttccgcctcagaggcgtcccggctgcgattcgctgccctgttgtcagtgaggcctggctgtcaccgcacaccgcgtccgtgtctccagggggttcctttcttctcacacgtcgcgtgtacccatagcactcttgtgtttctgtttttcccagtatgcatgtttaaaatagaagtgacaagaatcacatccggttgtgtcctgtgggagggtcagaggcagaatctacttacagtggtgtaattaaagttatttaaccaaaaataggtatgtgtccatctcagcattcacctttatcaagtgactgatttttttttcttttctttccttttttttttttttttgagacggagtttcactcttgttgcccaggctggagtgcaatggcatgatctcggctcaccgcaacctccgcctcccgggttcaagcgattctcctgcctcagcctcccaagtagctgggattacaggcacgcgccaccacgcctggctgattttgtatttttagtagacacgggttttcaccatgttggtcaggctggtctcaaactcccgacctcaagtagtctgcctgcctcaacctcccaaagtgctgggattacaggcgtgagccactgcgcctggccgtgactgattttttttcatgtagaattgtcaacacgagagatcacagtggagcactttgaaagaccgtcggttgtgtgcacgcacgcacacactcatgcacacgctgacacgcggttgcatggagtccaggttactcaggccggcacttctgagtgacaggtgccacctgcgtgtgtcttggcgtccacatcacacctgtgacggaagcacttctggaagtgaacactcgttttgaaagcttgattttgtagctttggaagctggaagcgatggtgtttggtgccgagtcctgtgtcatcctcggggcctatgagctccgtaccagccactcaaaagtgtctgaacagaaccgctccgtgactggtagctgggtctgaggattcaggattgtggcgttattcaaagaggagactttgaaattccccgatggctggaatgtggagcccaggtgcctctggtggagggtcatctgcttttccagactgtggttgtgaaccggctccttctccaagaaaggttgcaagctgagaacatccagaggtgagactcagacacattgaaagtgactgcatttagggaggtttaacgagttcttactgatcattccacttgttactggttaagataatttgcccacgggtttgtttccaagtcctcttctaggaccaggctcctggtatttcaggggctggttggctgcacagacagcccctcttctgctgtccttgaggacagacaccaaaccagaggtggaggaagaacggtaggaaggctgatggcaaaagcggctgtgtgtcgaggttattttaactttttactactttttgttactgtttctgcaaatgctaacacataaaccatgacctaacttttgtcaccttggatatctattgaatgttaaacatctctaataaagatggccaccacttaatgtgtggaaagtgatggccttctcgtgggccacgcgtttgggtgtgagtatggccttgaccaagggtcttggtgctttattcacttttagagatagggtcaccttgcccaggctcgagtgcagtggtgcagtcatagctcactgcagcctcgacatcctgggctcaagcagtcctccagcctcagcctcccaagtagctaggaccataggcacatgccaccaa

SEQ ID NO: 313511 - DNA, 2854 bp, Homo sapiens
tggtctcccgatcacagaacctgttgtctgtggcattccagccacagtgagacatgccaactagagatctaggtgcatagggggtggcggggtgcggttctaaggtctctgtctgacctaaactgtttgcttggatcctagatctggccagccaggagaaggagcggctggaggagaagcagagagaagcacggagggagcgggccaaggaggaggcagagtggcagacgaggtggttctacccaggcaataacccctacactgggacccccgactggttgtatgcaggggattactttgagcggaatttctccgactgcccagatatctactgagggcctggaggggcctggggcccgggaccggaggctgacgaggctggacttcctcgagtggccactgtgagcctcgtcacagcagaaaccaacttttctaacgactgagttcgcggagatagcatcatccctgatcaaggatgtaattctaattaactgttgattgccaaacatttcactctgctgtgccgtctcttcataaagcttcacttgggatcatcgtcttcattaaggtttcaacagggaaattcttcacggcgcccttttatgtggcagaaatcagctggggcttgtttagcttccagcacactctcagtcatagcatgtgtagctaaaggaagtaatgggaaggggttcatgttctctttataatgcagtggcaaaaggttctgaaagccttttaaactcgaaccagtgggggaaagatggatcttgaagctaatcctgcagagagttttatagaggccagggattgccttctaaattatgataaaacagaagtgaagagtttcagagcatcagattgagtgaaaagttgtcagattctgtattttttaacaatcttcaataatgtaaagattacttttaaaatatttaagttaaaactacttgaatagtattttgctgaagagcaagatatgcattaatcaccggttttatactgtccaaaatgaagcatccccgtgacaaaccagagtgggcagaagcatcgagagcgtgacaggaaatcccaagactgcttccgcctcagaggcgtcccggctgcgattcgctgccctgttgtcagtgaggcctggctgtcaccgcacaccgcgtccgtgtctccagggggttcctttcttctcacacgtcgcgtgtacccatagcactcttgtgtttctgtttttcccagtatgcatgtttaaaatagaagtgacaagaatcacatccggttgtgtcctgtgggagggtcagaggcagaatctacttacagtggtgtaattaaagttatttaaccaaaaataggtatgtgtccatctcagcattcacctttatcaagtgactgatttttttttcttttctttccttttttttttttttttgagacggagtttcactcttgttgcccaggctggagtgcaatggcatgatctcggctcaccgcaacctccgcctcccgggttcaagcgattctcctgcctcagcctcccaagtagctgggattacaggcacgcgccaccacgcctggctgattttgtatttttagtagacacgggttttcaccatgttggtcaggctggtctcaaactcccgacctcaagtagtctgcctgcctcaacctcccaaagtgctgggattacaggcgtgagccactgcgcctggccgtgactgattttttttcatgtagaattgtcaacacgagagatcacagtggagcactttgaaagaccgtcggttgtgtgcacgcacgcacacactcatgcacacgctgacacgcggttgcatggagtccaggttactcaggccggcacttctgagtgacaggtgccacctgcgtgtgtcttggcgtccacatcacacctgtgacggaagcacttctggaagtgaacactcgttttgaaagcttgattttgtagctttggaagctggaagcgatggtgtttggtgccgagtcctgtgtcatcctcggggcctatgagctccgtaccagccactcaaaagtgtctgaacagaaccgctccgtgactggtagctgggtctgaggattcaggattgtggcgttattcaaagaggagactttgaaattccccgatggctggaatgtggagcccaggtgcctctggtggagggtcatctgcttttccagactgtggttgtgaaccggctccttctccaagaaaggttgcaagctgagaacatccagaggtgagactcagacacattgaaagtgactgcatttagggaggtttaacgagttcttactgatcattccacttgttactggttaagataatttgcccacgggtttgtttccaagtcctcttctaggaccaggctcctggtatttcaggggctggttggctgcacagacagcccctcttctgctgtccttgaggacagacaccaaaccagaggtggaggaagaacggtaggaaggctgatggcaaaagcggctgtgtgtcgaggttattttaactttttactactttttgttactgtttctgcaaatgctaacacataaaccatgacctaacttttgtcaccttggatatctattgaatgttaaacatctctaataaagatggccaccacttaatgtgtggaaagtgatggccttctcgtgggccacgcgtttgggtgtgagtatggccttgaccaagggtcttggtgctttattcacttttagagatagggtcaccttgcccaggctcgagtgcagtggtgcagtcatagctcactgcagcctcgacatcctgggctcaagcagtcctccagcctcagcctcccaagtagctaggaccataggcacatgccaccaa

SEQ ID NO: 313512 - DNA, 2787 bp, Homo sapiens
agccgggcgtggtggcgggtgcctgtaatcccagctactcgggaggctgaggctggagaatcacttgaacctggatctggccagccaggagaaggagcggctggaggagaagcagagagaagcacggagggagcgggccaaggaggaggcagagtggcagacgaggtggttctacccaggcaataacccctacactgggacccccgactggttgtatgcaggggattactttgagcggaatttctccgactgcccagatatctactgagggcctggaggggcctggggcccgggaccggaggctgacgaggctggacttcctcgagtggccactgtgagcctcgtcacagcagaaaccaacttttctaacgactgagttcgcggagatagcatcatccctgatcaaggatgtaattctaattaactgttgattgccaaacatttcactctgctgtgccgtctcttcataaagcttcacttgggatcatcgtcttcattaaggtttcaacagggaaattcttcacggcgcccttttatgtggcagaaatcagctggggcttgtttagcttccagcacactctcagtcatagcatgtgtagctaaaggaagtaatgggaaggggttcatgttctctttataatgcagtggcaaaaggttctgaaagccttttaaactcgaaccagtgggggaaagatggatcttgaagctaatcctgcagagagttttatagaggccagggattgccttctaaattatgataaaacagaagtgaagagtttcagagcatcagattgagtgaaaagttgtcagattctgtattttttaacaatcttcaataatgtaaagattacttttaaaatatttaagttaaaactacttgaatagtattttgctgaagagcaagatatgcattaatcaccggttttatactgtccaaaatgaagcatccccgtgacaaaccagagtgggcagaagcatcgagagcgtgacaggaaatcccaagactgcttccgcctcagaggcgtcccggctgcgattcgctgccctgttgtcagtgaggcctggctgtcaccgcacaccgcgtccgtgtctccagggggttcctttcttctcacacgtcgcgtgtacccatagcactcttgtgtttctgtttttcccagtatgcatgtttaaaatagaagtgacaagaatcacatccggttgtgtcctgtgggagggtcagaggcagaatctacttacagtggtgtaattaaagttatttaaccaaaaataggtatgtgtccatctcagcattcacctttatcaagtgactgatttttttttcttttctttccttttttttttttttttgagacggagtttcactcttgttgcccaggctggagtgcaatggcatgatctcggctcaccgcaacctccgcctcccgggttcaagcgattctcctgcctcagcctcccaagtagctgggattacaggcacgcgccaccacgcctggctgattttgtatttttagtagacacgggttttcaccatgttggtcaggctggtctcaaactcccgacctcaagtagtctgcctgcctcaacctcccaaagtgctgggattacaggcgtgagccactgcgcctggccgtgactgattttttttcatgtagaattgtcaacacgagagatcacagtggagcactttgaaagaccgtcggttgtgtgcacgcacgcacacactcatgcacacgctgacacgcggttgcatggagtccaggttactcaggccggcacttctgagtgacaggtgccacctgcgtgtgtcttggcgtccacatcacacctgtgacggaagcacttctggaagtgaacactcgttttgaaagcttgattttgtagctttggaagctggaagcgatggtgtttggtgccgagtcctgtgtcatcctcggggcctatgagctccgtaccagccactcaaaagtgtctgaacagaaccgctccgtgactggtagctgggtctgaggattcaggattgtggcgttattcaaagaggagactttgaaattccccgatggctggaatgtggagcccaggtgcctctggtggagggtcatctgcttttccagactgtggttgtgaaccggctccttctccaagaaaggttgcaagctgagaacatccagaggtgagactcagacacattgaaagtgactgcatttagggaggtttaacgagttcttactgatcattccacttgttactggttaagataatttgcccacgggtttgtttccaagtcctcttctaggaccaggctcctggtatttcaggggctggttggctgcacagacagcccctcttctgctgtccttgaggacagacaccaaaccagaggtggaggaagaacggtaggaaggctgatggcaaaagcggctgtgtgtcgaggttattttaactttttactactttttgttactgtttctgcaaatgctaacacataaaccatgacctaacttttgtcaccttggatatctattgaatgttaaacatctctaataaagatggccaccacttaatgtgtggaaagtgatggccttctcgtgggccacgcgtttgggtgtgagtatggccttgaccaagggtcttggtgctttattcacttttagagatagggtcaccttgcccaggctcgagtgcagtggtgcagtcatagctcactgcagcctcgacatcctgggctcaagcagtcctccagcctcagcctcccaagtagctaggaccataggcacatgccaccaa

SEQ ID NO: 313513 - DNA, 792 bp, Homo sapiens
ggtgtcagtgggtcgcgggcctacggggcgggggcggggcggcagtgagctcggccggcaaccgagggacccgcgtccagatcttcagtgtctattggatttttccaagagaaagtttgtaaaattccttacactgtagatgtggatcagatacgatgattcagtagaagagcacatgtcaggggcagtggaggctggctgctgaaggatgaacggagaggaagaattctttgatgccgtcacaggctttgattctgataactcttctggggaattttcagaggcaaatcagaaagtcacgggaatgattgacttagacaccagcaaaaataataggattgggaaaactggggagaggccctctcaagagaacggaattcagaaacacaggacatcgctgccggctcccatgttcagcagaagcgacttcagcgtgtggaccatcctgaagaagtgtgttggcctggagctgtccaagatcacgatgccaatcgccatcaagccatgaaaagacacagaggaacctaaattgcacattgctgagtgaaagaagccaactgaaaaggtaatacagtgtatagttccaacttcataccattctggaaaaggcaaaattatggggacagcaaaaagatcagggattcaggggaggggattattaaggcaatgaaatgattctatctgatattgtaatggtggatgcatcatatgtacaacaccaacagtgaatgctaatgtaaacgatggactttgagatggtaacgatgcgtctaatgtacggtttaccagttc

SEQ ID NO: 313514 - DNA, 400 bp, Homo sapiens
ggtgcccaccgccctccacaagaggccatcttctccagcgcgtttcctaactgaagctgtgcctgtcccccccgtggattatttacagtctgtggctgcttttgctgtttcggctgtggcttcccagtgggagaggaccggcaaaccatttaatccactcttgggagaaacgtatgaattaatcaggtaaggggggaaaggcccatcataaatatcttgtaaatggaattccttggatgacagataagtttgattctttcactagcattgattcctctgctctgagaataaactgtttgaattaagagctcacgaaagcgtttggatgctgtaggcgagatgtttcacacacacggggtgttgtgctagcgtgccacggcgtctgagtgagtgtaaagcg

SEQ ID NO: 313515 - DNA, 2649 bp, Homo sapiens
ggtgtcagtgggtcgcgggcctacggggcgggggcggggcggcagtgagctcggccggcaaccgagggacccgcgtccagatcttcagtgtctattggatttttccaagagaaagtttgtaaaattccttacactgtagatgtggatcagatacgatgattcagtagaagagcacatgtcaggggcagtggaggctggctgctgaaggatgaacggagaggaagaattctttgatgccgtcacaggctttgattctgataactcttctggggaattttcagaggcaaatcagaaagtcacgggaatgattgacttagacaccagcaaaaataataggattgggaaaactggggagaggccctctcaagagaacggaattcagaaacacaggacatcgctgccggctcccatgttcagcagaagcgacttcagcgtgtggaccatcctgaagaagtgtgttggcctggagctgtccaagatcacgatgccaatcgccttcaacgagcctctgagcttcttgcagcggatcacggagtacatggagcacgtgtacctcatccacagggcctcctgccagccccagcccctggagaggatgcagtctgtggctgcttttgctgtttcggctgtggcttcccagtgggagaggaccggcaaaccatttaatccactcttgggagaaacgtatgaattaatcagggaagatttaggattcagatttatatcggaacaggtcagtcaccacccccccatcagtgcgttccactcggaaggtctcaaccatgacttcctgttccatggctccatctaccccaagctcaagttctggggcaaaagcgtggaggcggagccccgaggcaccatcaccctggagctgctcaaacataatgaagcctacacctggaccaaccccacctgctgcgtccacaacgtcatcatcgggaagctgtggatagagcagtatgggacagtggagattttaaaccacagaactggacataagtgtgtgcttcactttaaaccgtgtggattatttggaaaagaacttcacaaggtggaaggacacattcaagacaaaaacaaaaagaagctctttatgatctatggcaaatggacggaatgtttgtggggcatagatcctgtttcgtatgaatccttcaagaagcaggagaggagaggtgaccacctgagaaaggccaagctggatgaagactccgggaaggctgacagcgacgtggctgacgacgtgcctgtggcccaggagaccgtgcaggtcattcctggcagcaagctgctctggaggatcaacacccggccccccaactctgcccagatgtataatttcaccagtttcactgtgagcctcaacgagctggagacaggcatggagaagaccctgccacccacggactgccgcctgcgccctgacatccgcggcatggagaatggcaacatggatctggccagccaggagaaggagcggctggaggagaagcagagagaagcacggagggagcgggccaaggaggaggcagagtggcagacgaggtggttctacccaggcaataacccctacactgggacccccgactggttgtatgcaggggattactttgagcggaatttctccgactgcccagatatctactgagggcctggaggggcctggggcccgggaccggaggctgacgaggctggacttcctcgagtggccactgtgagcctcgtcacagcagaaaccaacttttctaacgactgagttcgcggagatagcatcatccctgatcaaggatgtaattctaattaactgttgattgccaaacatttcactctgctgtgccgtctcttcataaagcttcacttgggatcatcgtcttcattaaggtttcaacagggaaattcttcacggcgcccttttatgtggcagaaatcagctggggcttgtttagcttccagcacactctcagtcatagcatgtgtagctaaaggaagtaatgggaaggggttcatgttctctttataatgcagtggcaaaaggttctgaaagccttttaaactcgaaccagtgggggaaagatggatcttgaagctaatcctgcagagagttttatagaggccagggattgccttctaaattatgataaaacagaagtgaagagtttcagagcatcagattgagtgaaaagttgtcagattctgtattttttaacaatcttcaataatgtaaagattacttttaaaatatttaagttaaaactacttgaatagtattttgctgaagagcaagatatgcattaatcaccggttttatactgtccaaaatgaagcatccccgtgacaaaccagagtgggcagaagcatcgagagcgtgacaggaaatcccaagactgcttccgcctcagaggcgtcccggctgcgattcgctgccctgttgtcagtgaggcctggctgtcaccgcacaccgcgtccgtgtctccagggggttcctttcttctcacacgtcgcgtgtacccatagcactcttgtgtttctgtttttcccagtatgcatgtttaaaatagaagtgacaagaatcacatccggttgtgtcctgtgggagggtcagaggcagaatctacttacagtggtgtaattaaagttatttaacca

SEQ ID NO: 313516 - DNA, 3946 bp, Homo sapiens
ggtgtcagtgggtcgcgggcctacggggcgggggcggggcggcagtgagctcggccggcaaccgagggacccgcgtccagatcttcagtgtctattggatttttccaagagaaagtttgtaaaattccttacactgtagatgtggatcagatacgatgattcagtagaagagcacatgtcaggggcagtggaggctggctgctgaaggatgaacggagaggaagaattctttgatgccgtcacaggctttgattctgataactcttctggggaattttcagaggcaaatcagaaagtcacgggaatgattgacttagacaccagcaaaaataataggattgggaaaactggggagaggccctctcaagagaacggaattcagaaacacaggacatcgctgccggctcccatgttcagcagaagcgacttcagcgtgtggaccatcctgaagaagtgtgttggcctggagctgtccaagatcacgatgccaatcgccttcaacgagcctctgagcttcttgcagcggatcacggagtacatggagcacgtgtacctcatccacagggcctcctgccagccccagcccctggagaggatgcagtctgtggctgcttttgctgtttcggctgtggcttcccagtgggagaggaccggcaaaccatttaatccactcttgggagaaacgtatgaattaatcagggaagatttaggattcagatttatatcggaacaggtcagtcaccacccccccatcagtgcgttccactcggaaggtctcaaccatgacttcctgttccatggctccatctaccccaagctcaagttctggggcaaaagcgtggaggcggagccccgaggcaccatcaccctggagctgctcaaacataatgaagcctacacctggaccaaccccacctgctgcgtccacaacgtcatcatcgggaagctgtggatagagcagtatgggacagtggagattttaaaccacagaactggacataagtgtgtgcttcactttaaaccgtgtggattatttggaaaagaacttcacaaggtggaaggacacattcaagacaaaaacaaaaagaagctctttatgatctatggcaaatggacggaatgtttgtggggcatagatcctgtttcgtatgaatccttcaagaagcaggagaggagaggtgaccacctgagaaaggccaagctggatgaagactccgggaaggctgacagcgacgtggctgacgacgtgcctgtggcccaggagaccgtgcaggtcattcctggcagcaagctgctctggaggatcaacacccggccccccaactctgcccagatgtataatttcaccagtttcactgtgagcctcaacgagctggagacaggcatggagaagaccctgccacccacggactgccgcctgcgccctgacatccgcggcatggagaatggcaacatggatctggccagccaggagaaggagcggctggaggagaagcagagagaagcacggagggagcgggccaaggaggaggcagagtggcagacgaggtggttctacccaggcaataacccctacactgggacccccgactggttgtatgcaggggattactttgagcggaatttctccgactgcccagatatctactgagggcctggaggggcctggggcccgggaccggaggctgacgaggctggacttcctcgagtggccactgtgagcctcgtcacagcagaaaccaacttttctaacgactgagttcgcggagatagcatcatccctgatcaaggatgtaattctaattaactgttgattgccaaacatttcactctgctgtgccgtctcttcataaagcttcacttgggatcatcgtcttcattaaggtttcaacagggaaattcttcacggcgcccttttatgtggcagaaatcagctggggcttgtttagcttccagcacactctcagtcatagcatgtgtagctaaaggaagtaatgggaaggggttcatgttctctttataatgcagtggcaaaaggttctgaaagccttttaaactcgaaccagtgggggaaagatggatcttgaagctaatcctgcagagagttttatagaggccagggattgccttctaaattatgataaaacagaagtgaagagtttcagagcatcagattgagtgaaaagttgtcagattctgtattttttaacaatcttcaataatgtaaagattacttttaaaatatttaagttaaaactacttgaatagtattttgctgaagagcaagatatgcattaatcaccggttttatactgtccaaaatgaagcatccccgtgacaaaccagagtgggcagaagcatcgagagcgtgacaggaaatcccaagactgcttccgcctcagaggcgtcccggctgcgattcgctgccctgttgtcagtgaggcctggctgtcaccgcacaccgcgtccgtgtctccagggggttcctttcttctcacacgtcgcgtgtacccatagcactcttgtgtttctgtttttcccagtatgcatgtttaaaatagaagtgacaagaatcacatccggttgtgtcctgtgggagggtcagaggcagaatctacttacagtggtgtaattaaagttatttaaccaaaaataggtatgtgtccatctcagcattcacctttatcaagtgactgatttttttttcttttctttccttttttttttttttttgagacggagtttcactcttgttgcccaggctggagtgcaatggcatgatctcggctcaccgcaacctccgcctcccgggttcaagcgattctcctgcctcagcctcccaagtagctgggattacaggcacgcgccaccacgcctggctgattttgtatttttagtagacacgggttttcaccatgttggtcaggctggtctcaaactcccgacctcaagtagtctgcctgcctcaacctcccaaagtgctgggattacaggcgtgagccactgcgcctggccgtgactgattttttttcatgtagaattgtcaacacgagagatcacagtggagcactttgaaagaccgtcggttgtgtgcacgcacgcacacactcatgcacacgctgacacgcggttgcatggagtccaggttactcaggccggcacttctgagtgacaggtgccacctgcgtgtgtcttggcgtccacatcacacctgtgacggaagcacttctggaagtgaacactcgttttgaaagcttgattttgtagctttggaagctggaagcgatggtgtttggtgccgagtcctgtgtcatcctcggggcctatgagctccgtaccagccactcaaaagtgtctgaacagaaccgctccgtgactggtagctgggtctgaggattcaggattgtggcgttattcaaagaggagactttgaaattccccgatggctggaatgtggagcccaggtgcctctggtggagggtcatctgcttttccagactgtggttgtgaaccggctccttctccaagaaaggttgcaagctgagaacatccagaggtgagactcagacacattgaaagtgactgcatttagggaggtttaacgagttcttactgatcattccacttgttactggttaagataatttgcccacgggtttgtttccaagtcctcttctaggaccaggctcctggtatttcaggggctggttggctgcacagacagcccctcttctgctgtccttgaggacagacaccaaaccagaggtggaggaagaacggtaggaaggctgatggcaaaagcggctgtgtgtcgaggttattttaactttttactactttttgttactgtttctgcaaatgctaacacataaaccatgacctaacttttgtcaccttggatatctattgaatgttaaacatctctaataaagatggccaccactta

SEQ ID NO: 313517 - DNA, 3916 bp, Homo sapiens
  misc_feature (3909)..(3909): n is a, c, g, or t
  misc_feature (3912)..(3912): n is a, c, g, or t
ggtgtcagtgggtcgcgggcctacggggcgggggcggggcggcagtgagctcggccggcaaccgagggacccgcgtccagatcttcagtgtctattggatttttccaagagaaagtttgtaaaattccttacactgtagatgtggatcagatacgatgattcagtagaagagcacatgtcaggggcagtggaggctggctgctgaaggatgaacggagaggaagaattctttgatgccgtcacaggctttgattctgataactcttctggggaattttcagaggcaaatcagaaagtcacgggaatgattgacttagacaccagcaaaaataataggattgggaaaactggggagaggccctctcaagagaacggaattcagaaacacaggacatcgctgccggctcccatgttcagcagaagcgacttcagcgtgtggaccatcctgaagaagtgtgttggcctggagctgtccaagatcacgatgccaatcgccttcaacgagcctctgagcttcttgcagcggatcacggagtacatggagcacgtgtacctcatccacagggcctcctgccagccccagcccctggagaggatgcagtctgtggctgcttttgctgtttcggctgtggcttcccagtgggagaggaccggcaaaccatttaatccactcttgggagaaacgtatgaattaatcagggaagatttaggattcagatttatatcggaacaggtcagtcaccacccccccatcagtgcgttccactcggaaggtctcaaccatgacttcctgttccatggctccatctaccccaagctcaagttctggggcaaaagcgtggaggcggagccccgaggcaccatcaccctggagctgctcaaacataatgaagcctacacctggaccaaccccacctgctgcgtccacaacgtcatcatcgggaagctgtggatagagcagtatgggacagtggagattttaaaccacagaactggacataagtgtgtgcttcactttaaaccgtgtggattatttggaaaagaacttcacaaggtggaaggacacattcaagacaaaaacaaaaagaagctctttatgatctatggcaaatggacggaatgtttgtggggcatagatcctgtttcgtatgaatccttcaagaagcaggagaggagaggtgaccacctgagaaaggccaagctggatgaagactccgggaaggctgacagcgacgtggctgacgacgtgcctgtggcccaggagaccgtgcaggtcattcctggcagcaagctgctctggaggatcaacacccggccccccaactctgcccagatgtataatttcaccagtttcactgtgagcctcaacgagctggagacaggcatggagaagaccctgccacccacggactgccgcctgcgccctgacatccgcggcatggagaatggcaacatggatctggccagccaggagaaggagcggctggaggagaagcagagagaagcacggagggagcgggccaaggaggaggcagagtggcagacgaggtggttctacccaggcaataacccctacactgggacccccgactggttgtatgcaggggattactttgagcggaatttctccgactgcccagatatctactgagggcctggaggggcctggggcccgggaccggaggctgacgaggctggacttcctcgagtggccactgtgagcctcgtcacagcagaaaccaacttttctaacgactgagttcgcggagatagcatcatccctgatcaaggatgtaattctaattaactgttgattgccaaacatttcactctgctgtgccgtctcttcataaagcttcacttgggatcatcgtcttcattaaggtttcaacagggaaattcttcacggcgcccttttatgtggcagaaatcagctggggcttgtttagcttccagcacactctcagtcatagcatgtgtagctaaaggaagtaatgggaaggggttcatgttctctttataatgcagtggcaaaaggttctgaaagccttttaaactcgaaccagtgggggaaagatggatcttgaagctaatcctgcagagagttttatagaggccagggattgccttctaaattatgataaaacagaagtgaagagtttcagagcatcagattgagtgaaaagttgtcagattctgtattttttaacaatcttcaataatgtaaagattacttttaaaatatttaagttaaaactacttgaatagtattttgctgaagagcaagatatgcattaatcaccggttttatactgtccaaaatgaagcatccccgtgacaaaccagagtgggcagaagcatcgagagcgtgacaggaaatcccaagactgcttccgcctcagaggcgtcccggctgcgattcgctgccctgttgtcagtgaggcctggctgtcaccgcacaccgcgtccgtgtctccagggggttcctttcttctcacacgtcgcgtgtacccatagcactcttgtgtttctgtttttcccagtatgcatgtttaaaatagaagtgacaagaatcacatccggttgtgtcctgtgggagggtcagaggcagaatctacttacagtggtgtaattaaagttatttaaccaaaaataggtatgtgtccatctcagcattcacctttatcaagtgactgatttttttttcttttctttccttttttttttttttttgagacggagtttcactcttgttgcccaggctggagtgcaatggcatgatctcggctcaccgcaacctccgcctcccgggttcaagcgattctcctgcctcagcctcccaagtagctgggattacaggcacgcgccaccacgcctggctgattttgtatttttagtagacacgggttttcaccatgttggtcaggctggtctcaaactcccgacctcaagtagtctgcctgcctcaacctcccaaagtgctgggattacaggcgtgagccactgcgcctggccgtgactgattttttttcatgtagaattgtcaacacgagagatcacagtggagcactttgaaagaccgtcggttgtgtgcacgcacgcacacactcatgcacacgctgacacgcggttgcatggagtccaggttactcaggccggcacttctgagtgacaggtgccacctgcgtgtgtcttggcgtccacatcacacctgtgacggaagcacttctggaagtgaacactcgttttgaaagcttgattttgtagctttggaagctggaagcgatggtgtttggtgccgagtcctgtgtcatcctcggggcctatgagctccgtaccagccactcaaaagtgtctgaacagaaccgctccgtgactggtagctgggtctgaggattcaggattgtggcgttattcaaagaggagactttgaaattccccgatggctggaatgtggagcccaggtgcctctggtggagggtcatctgcttttccagactgtggttgtgaaccggctccttctccaagaaaggttgcaagctgagaacatccagaggtgagactcagacacattgaaagtgactgcatttagggaggtttaacgagttcttactgatcattccacttgttactggttaagataatttgcccacgggtttgtttccaagtcctcttctaggaccaggctcctggtatttcaggggctggttggctgcacagacagcccctcttctgctgtccttgaggacagacaccaaaccagaggtggaggaagaacggtaggaaggctgatggcaaaagcggctgtgtgtcgaggttattttaactttttactactttttgttactgtttctgcaaatgctaacacaggcccaagatgaggggatcctctagagcgaccgcaggcancanaagc

SEQ ID NO: 313518 - DNA, 3758 bp, Homo sapiens
tgcggccgctccaacatcagaatggtccacacgctgaagaagtgtgttggcctggagctgtccaagatcacgatgccaatcgccttcaacgagcctctgagcttcttgcagcggatcacggagtacatggagcacgtgtacctcatccacagggcctcctgccagccccagcccctggagaggatgcagtctgtggctgcttttgctgtttcggctgtggcttcccagtgggagaggaccggcaaaccatttaatccactcttgggagaaacgtatgaattaatcagggaagatttaggattcagatttatatcggaacaggtcagtcaccacccccccatcagtgcgttccactcggaaggtctcaaccatgacttcctgttccatggctccatctaccccaagctcaagttctggggcaaaagcgtggaggcggagccccgaggcaccatcaccctggagctgctcaaacataatgaagcctacacctggaccaaccccacctgctgcgtccacaacgtcatcatcgggaagctgtggatagagcagtatgggacagtggagattttaaaccacagaactggacataagtgtgtgcttcactttaaaccgtgtggattatttggaaaagaacttcacaaggtggaaggacacattcaagacaaaaacaaaaagaagctctttatgatctatggcaaatggacggaatgtttgtggggcatagatcctgtttcgtatgaatccttcaagaagcaggagaggagaggtgaccacctgagaaaggccaagctggatgaagactccgggaaggctgacagcgacgtggctgacgacgtgcctgtggcccaggagaccgtgcaggtcattcctggcagcaagctgctctggaggatcaacacccggccccccaactctgcccagatgtataatttcaccagtttcactgtgagcctcaacgagctggagacaggcatggagaagaccctgccacccacggactgccgcctgcgccctgacatccgcggcatggagaatggcaacatggatctggccagccaggagaaggagcggctggaggagaagcagagagaagcacggagggagcgggccaaggaggaggcagagtggcagacgaggtggttctacccaggcaataacccctacactgggacccccgactggttgtatgcaggggattactttgagcggaatttctccgactgcccagatatctactgagggcctggaggggcctggggcccgggaccggaggctgacgaggctggacttcctcgagtggccactgtgagcctcgtcacagcagaaaccaacttttctaacgactgagttcgcggagatagcatcatccctgatcaaggatgtaattctaattaactgttgattgccaaacatttcactctgctgtgccgtctcttcataaagcttcacttgggatcatcgtcttcattaaggtttcaacagggaaattcttcacggcgcccttttatgtggcagaaatcagctggggcttgtttagcttccagcacactctcagtcatagcatgtgtagctaaaggaagtaatgggaaggggttcatgttctctttataatgcagtggcaaaaggttctgaaagccttttaaactcgaaccagtgggggaaagatggatcttgaagctaatcctgcagagagttttatagaggccagggattgccttctaaattatgataaaacagaagtgaagagtttcagagcatcagattgagtgaaaagttgtcagattctgtattttttaacaatcttcaataatgtaaagattacttttaaaatatttaagttaaaactacttgaatagtattttgctgaagagcaagatatgcattaatcaccggttttatactgtccaaaatgaagcatccccgtgacaaaccagagtgggcagaagcatcgagagcgtgacaggaaatcccaagactgcttccgcctcagaggcgtcccggctgcgattcgctgccctgttgtcagtgaggcctggctgtcaccgcacaccgcgtccgtgtctccagggggttcctttcttctcacacgtcgcgtgtacccatagcactcttgtgtttctgtttttcccagtatgcatgtttaaaatagaagtgacaagaatcacatccggttgtgtcctgtgggagggtcagaggcagaatctacttacagtggtgtaattaaagttatttaaccaaaaataggtatgtgtccatctcagcattcacctttatcaagtgactgatttttttttcttttctttccttttttttttttttttgagacggagtttcactcttgttgcccaggctggagtgcaatggcatgatctcggctcaccgcaacctccgcctcccgggttcaagcgattctcctgcctcagcctcccaagtagctgggattacaggcacgcgccaccacgcctggctgattttgtatttttagtagacacgggttttcaccatgttggtcaggctggtctcaaactcccgacctcaagtagtctgcctgcctcaacctcccaaagtgctgggattacaggcgtgagccactgcgcctggccgtgactgattttttttcatgtagaattgtcaacacgagagatcacagtggagcactttgaaagaccgtcggttgtgtgcacgcacgcacacactcatgcacacgctgacacgcggttgcatggagtccaggttactcaggccggcacttctgagtgacaggtgccacctgcgtgtgtcttggcgtccacatcacacctgtgacggaagcacttctggaagtgaacactcgttttgaaagcttgattttgtagctttggaagctggaagcgatggtgtttggtgccgagtcctgtgtcatcctcggggcctatgagctccgtaccagccactcaaaagtgtctgaacagaaccgctccgtgactggtagctgggtctgaggattcaggattgtggcgttattcaaagaggagactttgaaattccccgatggctggaatgtggagcccaggtgcctctggtggagggtcatctgcttttccagactgtggttgtgaaccggctccttctccaagaaaggttgcaagctgagaacatccagaggtgagactcagacacattgaaagtgactgcatttagggaggtttaacgagttcttactgatcattccacttgttactggttaagataatttgcccacgggtttgtttccaagtcctcttctaggaccaggctcctggtatttcaggggctggttggctgcacagacagcccctcttctgctgtccttgaggacagacaccaaaccagaggtggaggaagaacggtaggaaggctgatggcaaaagcggctgtgtgtcgaggttattttaactttttactactttttgttactgtttctgcaaatgctaacacataaaccatgacctaacttttgtcaccttggatatctattgaatgttaaacatctctaataaagatggccaccacttaatgtgtggaaagtgatggccttctcgtgggccacgcgtttgggtgtgagtatggccttgaccaagggtcttggtgctttattcacttttagagatagggtcaccttgcccaggctcgagtgcagtggtgcagtcatagctcactgcagcctcgacatcctgggctcaagcagtcctccagcctcagcctcccaagtagctaggaccataggcacatgccaccaa

SEQ ID NO: 313519 - DNA, 1255 bp, Homo sapiens
ggtgtcagtgggtcgcgggcctacggggcgggggcggggcggcagtgagctcggccggcaaccgagggacccgcgtccagatcttcagtgtctattggatttttccaagagaaagtttgtaaaattccttacactgtagatgtggatcagatacgatgattcagtagaagagcacatgtcaggggcagtggaggctggctgctgaaggatgaacggagaggaagaattctttgatgccgtcacaggctttgattctgataactcttctggggaattttcagaggcaaatcagaaagtcacgggaatgattgacttagacaccagcaaaaataataggattgggaaaactggggagaggccctctcaagagaacggaattcagaaacacaggacatcgctgccggctcccatgttcagcagaagcgacttcagcgtgtggaccatcctgaagaagtgtgttggcctggagctgtccaagatcacgatgccaatcgccttcaacgagcctctgagcttcttgcagcggatcacggagtacatggagcacgtgtacctcatccacagggcctcctgccagccccagcccctggagaggatgcagtctgtggctgcttttgctgtttcggctgtggcttcccagtgggagaggaccggcaaaccatttaatccactcttgggagaaacgtatgaattaatcagggaagatttaggattcagatttatatcggaacaggtcagtcaccacccccccatcagtgcgttccactcggaaggtctcaaccatgacttcctgttccatggctccatctaccccaagctcaagttctggggcaaaagcgtggaggcggagccccgaggcaccatcaccctggagctgctcaatgtcaaccaaagacacctcagagcaaaacacaagtctccaacaaatgccggccgctaagacccgacagacacagaccggatgctggcgtcctcctgggccaccagttctgagacgtgagtcttgccaagccactgcctgcagtcttgttgtaggcagcaggtcctaacaaatacatacagaaataagtaataaacgacaccttgcctgatgaagcatttgatttgggttttgcttcacattggccctgcctggatggtggctagaaggttccacaaggacctggagaagcccctgagagtgtgtcctggggctggtatggccgagtgcctgttgtgcagtggccttgcttaattaagaggcatgcagaaatga

SEQ ID NO: 313520 - DNA, 956 bp, Homo sapiens
tcggggtcgcctttggagcagagaggaggcaatggccaccatggagaacaaggtgatctgcgccctggtcctggtgtccatgctggccctcggcaccctggccgaggcccagacagagacgtgtacagtggccccccgtgaaagacagaattgtggttttcctggtgtcacgccctcccagtgtgcaaataagggctgctgtttcgacgacaccgttcgtggggtcccctggtgcttctatcctaataccatcgacgtccctccagaagaggagtgtgaattttagacacttctgcagggatctgcctgcatcctgacgcggtgccgtccccagcacggtgattagtcccagagctcggctgccacctccaccggacacctcagacacgcttctgcagctgtgcctcggctcacaacacagattgactgctctgactttgactactcaaaattggcctaaaaattaaaagagatcgatattaagaacaaaacccttgacatgtggaacctggccaccctgacgaggaagctgaagctcaatgccagaactccctgatctgatgatcattcgactggccgagacagccagactactggatctgatgggacccagggaatgtcctcacaaggccaagtattgaggtcatcgggcaggtccttgagcaacactcaaagtccgaagatgtccccaaacaccagttgtgactcacagcggtccgacaattcaagggtgtgccccgttgattgttagaacagagttgtccccataagggcgagggggacgacagttttgtaacaaaaaacccgcccagggataagctagtgaattccggtcgcgtcgtagttgaactcatcagcgaagaccaggaatcgcgggataccacggtctggaactccaatgactcatatagtaaggttatataggacaaaatatgtatatcctgaaataccctcag

SEQ ID NO: 313521 - DNA, 452 bp, Homo sapiens
tatcgatctcttttaatttttaggccaattttgagtagtcaaagtcagagcagtcaatctgtgttgtgagccgaggcccagacagagacgtgtacagtggccccccgtgaaagacagaattgtggttttcctggtgtcacgccctcccagtgtgcaaataagggctgctgtttcgacgacaccgttcgtggggtcccctggtgcttctatcctaataccatcgacgtccctccagaagaggagtgtgaattttagacacttctgcagggatctgcctgcatcctgacgcggtgccgtccccagcacggtgattagtcccagagctcggctgccacctccaccggacacctcagacacgcttctgcagctgtgcctcggctcacaacacagattgactgctctgactttgactactcaaaattggcctaaaaattaaaagagatcgatattaa

SEQ ID NO: 313522 - DNA, 445 bp, Homo sapiens
tcggggtcgcctttggagcagagaggaggcaatggccaccatggagaacaaggtgatctgcgccctggtcctggtgtccatgctggccctcggcaccctggccgaggcccagacagagacgtgtacagtggccccccgtgaaagacagaattgtggttttcctggtgtcacgccctcccagtgtgcaaataagggctgctgtttcgacgacaccgttcgtggggtcccctggtgcttctatcctaataccatcgacgtccctccagaagaggagtgtgaattttagacacttctgcagggatctgcctgcatcctgacgcggtgccgtccccagcacggtgattagtcccagagctcggctgccacctccgggccattcaacgcctccgggccattcaacgcctccgggccattcaacgcctccggggcattcaacgcctccggg

SEQ ID NO: 313523 - DNA, 483 bp, Homo sapiens
tcggggtcgcctttggagcagagaggaggcaatggccaccatggagaacaaggtgatctgcgccctggtcctggtgtccatgctggccctcggcaccctggccgaggcccagacagagacgtgtacagtggccccccgtgaaagacagaattgtggttttcctggtgtcacgccctcccagtgtgcaaataagggctgctgtttcgacgacaccgttcgtggggtcccctggtgcttctatcctaataccatcgacgtccctccagaagaggagtgtgaattttagacacttctgcagggatctgcctgcatcctgacgcggtgccgtccccagcacggtgattagtcccagagctcggctgccacctccaccggacacctcagacacgcttctgcagctgtgcctcggctcacaacacagattgactgctctgactttgactactcaaaattggcctaaaaattaaaagagatcgatattaa

SEQ ID NO: 313524 - DNA, 448 bp, Homo sapiens
ttgtggctgattacaggaccttattcgccgacttgggactggtgtcatgctggccctcggcacctggcgaggcccagacagagacgtgtacagtggccccccgtgaaagacagaattgtggttttcctggtgtcacgccctcccagtgtgcaaataagggctgctgtttcgacgacaccgttcgtggggtcccctggtgcttctatcctaataccatcgacgtccctccagaagaggagtgtgaattttagacacttctgcagggatctgcctgcatcctgacgcggtgccgtccccagcacggtgattagtcccagagctcggctgccacctccaccggacacctcagacacgcttctgcagctgtgcctcggctcacaacacagattgactgctctgactttgactactcaaaattggcctaaaaattaaaagagatcgatattaa

SEQ ID NO: 313525 - DNA, 206 bp, Homo sapiens
aagagcttaagagtagttaagaaacttatcaaagaatcacagataacagataataaagtcagagttcacttccagatcagtctggctcccaagtacaagcctatttattaattttattttgctttattatattttttctaatcaagggaacactttcattattcccctaaaggttattatatgctggaatatattttgctaaaaaa

SEQ ID NO: 313526 - DNA, 878 bp, Homo sapiens
cggacgcgtgggtcgacccacgcgtcggggaggaggccaaggtgcaacttccttcggtcgtcccgaatccgggttcatccgacaccagccgcctccaccatgccgccgaagttcgaccccaacgagatcaaagtcgtcggtgcgtgctctggttgtggccggggctgcgggatggagcatccctcggccccgccgcgcgtgcaaagctttccccgtatggggctcttaaagccgctgcctcccagagaccttcccggtgttgcgccgccccggccaagcctcagcctttctgggccttagcttcttcacgtgtaggtggggagggaggactggaccacctgtggcggcttgggagcccgcacgccctaggtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggtgga

SEQ ID NO: 313527 - DNA, 162 bp, Homo sapiens
gcggccgcctactactactactactgctcgaattcaagcttctaacgatgtacggggacctcatgacatcatcgatgacatcaacagtggtgctgtggaatgcccagccagttaagcacaaaggaaaacatttcaataaaggatcatttgacaactggtgga

SEQ ID NO: 313528 - DNA, 257 bp, Homo sapiens
ttatcatcggcacctcgctattcatcggcacctcgctattcatcggcaccgatccttagccagagaactctctggaaccattaaagagatcctggggactgcccagtcagtgggctgtaatgttgatggccgccatcctcatgacatcatcgatgacatcaacagtggtgctgtggaatgcccagcccgatgaatagcgaggtgccgatgaatagcgcggtgccgatgcaatagcgaggtgccgatgaatagcgggg

SEQ ID NO: 313529 - DNA, 555 bp, Homo sapiens
gctactactactaaattccccccctacgaccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggtgga

SEQ ID NO: 313530 - DNA, 505 bp, Homo sapiens
tctgtcacagtctcggatggcagcatttggcttctgtaatttgacgaagacactggccctcttggcatacaaaatggccaagcgaggattcagcttgatggcatctgtgaataagtcaatggctttctggagttcaccatcatttagggcttcaatagcagccacttttttatcatttgcctgatccatcatctcctccgttatctccgcattttcatctcccatttcttgaggagcatcagtgtctggttcaatcacaccttctttatcaatttctagatcactttcctcacttgatggttcgtctgcctttaagtcttcctccaccttcttactatcaggtttttcttccttggtattttcttctgatttagctttctgagtagcaggtggtactttaccctcatgacatcatcgatgacatcaacagtggtgctgtggaatgcccagccagttaagcacaaaggaaaacatttcaataaaggatcatttgacaactggtgga

SEQ ID NO: 313531 - DNA, 817 bp, Homo sapiens
tctcatttaacttttttaatgggtctcaaaattctgtgacaaatttttggtcaagttgtttccattaaaaagtactgattttaaaaactaataacttaaaactgccacacgcaaaaaagaaaaccaaagtggtccacaaaacattctcctttccttctgaaggttttacgatgcattgttatcattaaccagtcttttactactagaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggtgga

SEQ ID NO: 313532 - DNA, 1631 bp, Homo sapiens
  misc_feature (1458)..(1458): n is a, c, g, or t
ctcctaggttataaacctgttgggctcccccatttgggggggacccggggcgtatccttcatatgtccctgagtctctcctatccaaagggccctatattccccgcaggctgtatacaccgttccccgggtaactttggtttgaccgcaggttaaattaaacctgggcccacaaatcaattgcacatgctctcctggtacacaggccgggcattttttctcacttacaatacctgacgaacggcatgacctttatgacacggccgcccacaattgttgccaaacttcgaaagagtgtgcccccacctgcagattttcttgacgcacaagagtgttgagattcccccatggatacacgggagttcatggacgaggatcttcttgttggaaccttgctggccatcgtgtttgatggtaagagtttctcaccaaagccgcgaaatgtagctgaagatccaaaaaatctcaccagaaggggagggagaagagattcgattctgaggtctcctactcccgggtttctgcgtagagaaaccgactctgctggaggtcggcaaccggccacaaccgctcagcgaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggtggaaaaaaaaaacaaaagaaaaaaaaaaaaaaaacagaaaaaacaaaaacaaaacacaaagaaaaaaaaaaacaccccgggggcccaaattgggggggggggcaacaaaaggggtgaacaaacagggcccgcgggggccacaaagaggtgtccgcgcgcccccgatttgttgtagcagacggaggggggaaaagtcgcgggggggccccccaaaaagaggggacgcgcagaaacaacacttcaggcaagcgccccgggtgaccccagataaatnagccagagcgacaaggaaggccccgcgagcgacgtactcgccgccacgaagcgggcggccgaacagaggaggagcacacagcactgatcgctagaaaccctctgctacaacgaactacctgcgttgaaagaccaacgaacaacacgagccaagtggtgggacgacagcggcgc

SEQ ID NO: 313533 - DNA, 1742 bp, Homo sapiens
  misc_feature (1188)..(1188): n is a, c, g, or t
ctcctaggttataaacctgttgggctcccccatttgggggggacccggggcgtatccttcatatgtccctgagtctctcctatccaaagggccctatattccccgcaggctgtatacaccgttccccgggtaactttggtttgaccgcaggttaaattaaacctgggcccacaaatcaattgcacatgctctcctggtacacaggccgggcattttttctcacttacaatacctgacgaacggcatgacctttatgacacggccgcccacaattgttgccaaacttcgaaagagtgtgcccccacctgcagattttcttgacgcacaagagtgttgagattcccccatggatacacgggagttcatggacgaggatcttcttgttggaaccttgctggccatcgtgtttgatggtaagagtttctcaccaaagccgcgaaatgtagctgaagatccaaaaaatctcaccagaaggggagggagaagagattcgattctgaggtctcctactcccgggtttctgcgtagagaaaccgactctgctggaggtcggcaaccggccacaaccgctcagcgaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggtgganaaaaaaaaaaaaaaaaaaaaaaaaaaaaaaaaaaaaaaaaaaaaaaaaaaaaacaaaagaaaaaaaaaaaaaaaaaaaaaaagagaggggggggggcaaattattctctccggaggggggacaaattagccccaccattttttttataaaaagagaggggacgaactaatgagaggggtttattatatataaagaagagaggcagggaggggcgattgtattataaaaaggagaggtagggaggtagggggaaaagagagactgagagtgagtacatatatggagagaagagcaaacatagtatgtggagagagatgaaaaaaataaagagagagaaataaataagaatgagaaagaagaattagagaagctcagtagagagaagaaaaataataaaaaaagaggaagaaggagagagaataggaagggtggaaagaacagaaagcaacgaagagaatatatagtcgtgcgggaggaaagaagaaatagtgggacagtaggagaagatataggtgttaaggaagatagtatattaagggagaggaggtagtgtg

SEQ ID NO: 313534 - DNA, 1384 bp, Homo sapiens
ctcctaggttataaacctgttgggctcccccatttgggggggacccggggcgtatccttcatatgtccctgagtctctcctatccaaagggccctatattccccgcaggctgtatacaccgttccccgggtaactttggtttgaccgcaggttaaattaaacctgggcccacaaatcaattgcacatgctctcctggtacacaggccgggcattttttctcacttacaatacctgacgaacggcatgacctttatgacacggccgcccacaattgttgccaaacttcgaaagagtgtgcccccacctgcagattttcttgacgcacaagagtgttgagattcccccatggatacacgggagttcatggacgaggatcttcttgttggaaccttgctggccatcgtgtttgatggtaagagtttctcaccaaagccgcgaaatgtagctgaagatccaaaaaatctcaccagaaggggagggagaagagattcgattctgaggtctcctactcccgggtttctgcgtagagaaaccgactctgctggaggtcggcaaccggccacaaccgctcagcgaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggtggaaaaaaaaaaaaaaaaaccccgagtttttttttctttttcggggacaccagagtctggcttggtgccccccgggtgggggtccccgggggccccctcctcagtctccttgggaccctgggccttctcggggcacccccatttttggggccaaagccccccagaaacctcgggacacaacggggcgttcgcccccgggc

SEQ ID NO: 313535 - DNA, 1170 bp, Homo sapiens
ctcctaggttataaacctgttgggctcccccatttgggggggacccggggcgtatccttcatatgtccctgagtctctcctatccaaagggccctatattccccgcaggctgtatacaccgttccccgggtaactttggtttgaccgcaggttaaattaaacctgggcccacaaatcaattgcacatgctctcctggtacacaggccgggcattttttctcacttacaatacctgacgaacggcatgacctttatgacacggccgcccacaattgttgccaaacttcgaaagagtgtgcccccacctgcagattttcttgacgcacaagagtgttgagattcccccatggatacacgggagttcatggacgaggatcttcttgttggaaccttgctggccatcgtgtttgatggtaagagtttctcaccaaagccgcgaaatgtagctgaagatccaaaaaatctcaccagaaggggagggagaagagattcgattctgaggtctcctactcccgggtttctgcgtagagaaaccgactctgctggaggtcggcaaccggccacaaccgctcagcgaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccttaatctgggcccagcctgctggtccggctgtttgg

SEQ ID NO: 313536 - DNA, 1314 bp, Homo sapiens
ctcctaggttataaacctgttgggctcccccatttgggggggacccggggcgtatccttcatatgtccctgagtctctcctatccaaagggccctatattccccgcaggctgtatacaccgttccccgggtaactttggtttgaccgcaggttaaattaaacctgggcccacaaatcaattgcacatgctctcctggtacacaggccgggcattttttctcacttacaatacctgacgaacggcatgacctttatgacacggccgcccacaattgttgccaaacttcgaaagagtgtgcccccacctgcagattttcttgacgcacaagagtgttgagattcccccatggatacacgggagttcatggacgaggatcttcttgttggaaccttgctggccatcgtgtttgatggtaagagtttctcaccaaagccgcgaaatgtagctgaagatccaaaaaatctcaccagaaggggagggagaagagattcgattctgaggtctcctactcccgggtttctgcgtagagaaaccgactctgctggaggtcggcaaccggccacaaccgctcagcgaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacatagttcagcgtctgacgtcagacgctgaactatgtggggagcgggccgatgtccagcctcagaacttctggaactgcttcttggtgccggcagccttggtgaccttgagcacgttgaagcgcactgtcttgctcagaggccggcactcgcccactgtgacgatgtcacc

SEQ ID NO: 313537 - DNA, 1125 bp, Homo sapiens
cggacgcgtgggtcgacccacgcgtcggggaggaggccaaggtgcaacttccttcggtcgtcccgaatccgggttcatccgacaccagccgcctccaccatgccgccgaagttcgaccccaacgagatcaaagtcgtcggtgcgtgctctggttgtggccggggctgcgggatggagcatccctcggccccgccgcgcgtgcaaagctttccccgtatggggctcttaaagccgctgcctcccagagaccttcccggtgttgcgccgccccggccaagcctcagcctttctgggccttagcttcttcacgtgtaggtggggagggaggactggaccacctgtggcggcttgggagcccgcacgccctagggtaaggcttgtctccgggcgtttcgccccattggcctgggttagcgggcgacggggctctctccacgcctccccggtgtgagtttcggagctgcccacacccgagggaggagcgggtggcccgcctcgcgctctgtgctgtttcgagaagaggcagagggtggcgtgtccaaccccggaaagacgctgagagggctgtggctcggggctccctctgcacagacactaactcttcttttcccccagtatatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggtgga

SEQ ID NO: 313538 - DNA, 2047 bp, Homo sapiens
ctcctaggttataaacctgttgggctcccccatttgggggggacccggggcgtatccttcatatgtccctgagtctctcctatccaaagggccctatattccccgcaggctgtatacaccgttccccgggtaactttggtttgaccgcaggttaaattaaacctgggcccacaaatcaattgcacatgctctcctggtacacaggccgggcattttttctcacttacaatacctgacgaacggcatgacctttatgacacggccgcccacaattgttgccaaacttcgaaagagtgtgcccccacctgcagattttcttgacgcacaagagtgttgagattcccccatggatacacgggagttcatggacgaggatcttcttgttggaaccttgctggccatcgtgtttgatggtaagagtttctcaccaaagccgcgaaatgtagctgaagatccaaaaaatctcaccagaaggggagggagaagagattcgattctgaggtctcctactcccgggtttctgcgtagagaaaccgactctgctggaggtcggcaaccggccacaaccgctcagcgaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacagtaagttgtcttttccctagtttggttttggtaatggtttgtgagatgtttgatatatgtggctgtgttttcccttaaaggaaacctggggttgacatgggtattgggtgttgatatggttagggctgctagagccaggtagtatgaaaaagtgccacgtatgctgggtggctcacacctgtaatcccagcactgggaggctgaggcgggtggatcagttgagatcaggagttcgagaccagcctggccaacatggtgaaaccccatctccaccaaaaaatacaaaattagcctggtggtgctcgcctgtagacctggctactcagacggctgaggcaggagaatcactcgaacccaggaggtggaggttgtagcagtgagccaagattgtgccactgcactccagcctgggtaacagtgagactccgtctcaaaaaaaaaaaaaaaagtgccatgtagtccctgtgtggggcaggccccaatcagtgcatgtgggaggaagatgtcagcaataatgacctataatcaggagaccacatacaggtggcaggtactgggcagtttaactccctggcaatttaagcttgtcatttctctaaaacagtttctgccatgtcagatttgtgaaggcttggttttgccctcagccacccgccactgcacctgaccaggtctctgttggctggtgcaatccagtggtgagctgatagtaaaccccagcttaggaaacagggttgttcttcatgtggatgactctgtgccgaaagcatgggaacagcctagaaatgaaatgaaggacacatgatctgctttggcttcagactttaaaagagcttttgctgtttcctcttctgcagttattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggtgga

SEQ ID NO: 313539 - DNA, 1688 bp, Homo sapiens
ctcctaggttataaacctgttgggctcccccatttgggggggacccggggcgtatccttcatatgtccctgagtctctcctatccaaagggccctatattccccgcaggctgtatacaccgttccccgggtaactttggtttgaccgcaggttaaattaaacctgggcccacaaatcaattgcacatgctctcctggtacacaggccgggcattttttctcacttacaatacctgacgaacggcatgacctttatgacacggccgcccacaattgttgccaaacttcgaaagagtgtgcccccacctgcagattttcttgacgcacaagagtgttgagattcccccatggatacacgggagttcatggacgaggatcttcttgttggaaccttgctggccatcgtgtttgatggtaagagtttctcaccaaagccgcgaaatgtagctgaagatccaaaaaatctcaccagaaggggagggagaagagattcgattctgaggtctcctactcccgggtttctgcgtagagaaaccgactctgctggaggtcggcaaccggccacaaccgctcagcgaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggtaagagcaggacaacatgtaaccgccataactgtagttgtgtttttcactgagtgataacattcttcttacttgaagggtgctcagtgagacccaagatggggtgcagttttctgggactgaaaggatggatcgtaaattggatgtgtttaatctgggcatcaaggacccatggaagctttgcattccgggttatggaactagatggaactctatattctatattaggggagcaggaacctcattccttccattgcctgctatgaaccccttcagtattccccagtatctgcagattgtgagggactgagccagcacctccaatgccaccatttctttacttaaaggaaccattaaagagatcctggggactgcccagtcagtgggctgtaatgttgatggccgccatcctcatgacatcatcgatgacatcaacagtggtgctgtggaatgcccagccagccgtaagtgacattttcattgttacagtaggggtgaaaggggggccacccagtgtattcacagagataagctgggaagttttggaaatggttactggtggggtgggataatccttttaaactttttactgattttttttttctttcccacagagttaagcacaaaggaaaacatttcaataaaggatcatttgacaactggtgga

SEQ ID NO: 313540 - DNA, 1466 bp, Homo sapiens
ctcctaggttataaacctgttgggctcccccatttgggggggacccggggcgtatccttcatatgtccctgagtctctcctatccaaagggccctatattccccgcaggctgtatacaccgttccccgggtaactttggtttgaccgcaggttaaattaaacctgggcccacaaatcaattgcacatgctctcctggtacacaggccgggcattttttctcacttacaatacctgacgaacggcatgacctttatgacacggccgcccacaattgttgccaaacttcgaaagagtgtgcccccacctgcagattttcttgacgcacaagagtgttgagattcccccatggatacacgggagttcatggacgaggatcttcttgttggaaccttgctggccatcgtgtttgatggtaagagtttctcaccaaagccgcgaaatgtagctgaagatccaaaaaatctcaccagaaggggagggagaagagattcgattctgaggtctcctactcccgggtttctgcgtagagaaaccgactctgctggaggtcggcaaccggccacaaccgctcagcgaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggtaagagcaggacaacatgtaaccgccataactgtagttgtgtttttcactgagtgataacattcttcttacttgaagggtgctcagtgagacccaagatggggtgcagttttctgggactgaaaggatggatcgtaaattggatgtgtttaatctgggcatcaaggacccatggaagctttgcattccgggttatggaactagatggaactctatattctatattaggggagcaggaacctcattccttccattgcctgctatgaaccccttcagtattccccagtatctgcagattgtgagggactgagccagcacctccaatgccaccatttctttacttaaagaaccaccaagagacagaaagaaactagaaaaacattaaacacagtgggaatatcacttttgatgagacagcatatagaggatcctgctagagtcacct

SEQ ID NO: 313541 - DNA, 1923 bp, Homo sapiens
tctcatttaacttttttaatgggtctcaaaattctgtgacaaatttttggtcaagttgtttccattaaaaagtactgattttaaaaactaataacttaaaactgccacacgcaaaaaagaaaaccaaagtggtccacaaaacattctcctttccttctgaaggttttacgatgcattgttatcattaaccagtcttttactactagaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccaggtatttgcttgtgcttggtttcgggagaggagggtggggggacaggtagcaaccctctgggattcctgaagagtatttctgccaccagtggtgagccgagagtgatttcaccttgttggggaggctttgtcaagagtacggacctagggcaaagacttggacagtgtgtggccatgatttttgagagccagcgtgcatggcagtattcactggaggtggagtattcactcaggaatctcttctgcaattgaggtggtgccttctgcctctgccctgatcatcaaagccctcaaggaaccaccaagagacagaaagaaacagaaaaacagtaagttgtcttttccctagtttggttttggtaatggtttgtgagatgtttgatatatgtggctgtgttttcccttaaaggaaacctggggttgacatgggtattgggtgttgatatggttagggctgctagagccaggtagtatgaaaaagtgccacgtatgctgggtggctcacacctgtaatcccagcactgggaggctgaggcgggtggatcagttgagatcaggagttcgagaccagcctggccaacatggtgaaaccccatctccaccaaaaaatacaaaattagcctggtggtgctcgcctgtagacctggctactcagacggctgaggcaggagaatcactcgaacccaggaggtggaggttgtagcagtgagccaagattgtgccactgcactccagcctgggtaacagtgagactccgtctcaaaaaaaaaaaaaaaagtgccatgtagtccctgtgtggggcaggccccaatcagtgcatgtgggaggaagatgtcagcaataatgacctataatcaggagaccacatacaggtggcaggtactgggcagtttaactccctggcaatttaagcttgtcatttctctaaaacagtttctgccatgtcagatttgtgaaggcttggttttgccctcagccacccgccactgcacctgaccaggtctctgttggctggtgcaatccagtggtgagctgatagtaaaccccagcttaggaaacagggttgttcttcatgtggatgactctgtgccgaaagcatgggaacagcctagaaatgaaatgaaggacacatgatctgctttggcttcagactttaaaagagcttttgctgtttcctcttctgcagttattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggtgga

SEQ ID NO: 313542 - DNA, 3252 bp, Homo sapiens
cggacgcgtgggtcgacccacgcgtcggggaggaggccaaggtgcaacttccttcggtcgtcccgaatccgggttcatccgacaccagccgcctccaccatgccgccgaagttcgaccccaacgagatcaaagtcgtcggtgcgtgctctggttgtggccggggctgcgggatggagcatccctcggccccgccgcgcgtgcaaagctttccccgtatggggctcttaaagccgctgcctcccagagaccttcccggtgttgcgccgccccggccaagcctcagcctttctgggccttagcttcttcacgtgtaggtggggagggaggactggaccacctgtggcggcttgggagcccgcacgccctagggtaaggcttgtctccgggcgtttcgccccattggcctgggttagcgggcgacggggctctctccacgcctccccggtgtgagtttcggagctgcccacacccgagggaggagcgggtggcccgcctcgcgctctgtgctgtttcgagaagaggcagagggtggcgtgtccaaccccggaaagacgctgagagggctgtggctcggggctccctctgcacagacactaactcttcttttcccccagtatatacctgaggtgcaccggaggtgaagtcggtgccacttctgccctggcccccaagatcggccccctgggtctggtacgttatcccctccaaggggcatttttttcacatttgtttcactttaagcgccggctcgtggagtcacgcctgtgccagaggtgccctcgtggcttggactgtcaccctcagtaggcctgagccactgaactagtactaggtaccttaggaaggtcgtgtgtgaaaaatcgaacctggtgcctttaaattgtaattagctccatgtgtctccactgctgctttagtgtacctgaggggtgggcccaagggggagttttgaagttaggactggcttagagacattgggcagccaacatctgtatttcctcgtcaggaagtgggcatggcgttgttgggagattaaacggggtgtgggtgaagatccagtgagcgtttccagctgtgttgtagatgtaaacctagcagttaatgtggcaggctgtgtctcatgcctgctgagcaactgctggcttccccgtcattctgtcctcttggatttctctgaatttcattaggcctttatttaatccttgcacagtgctcccctgccccaaatgctcttccccattggtcttttttaacctgtatcttaactattcttccttggccgttagctggcacttaagggacacttagcctcctgttgaggctaaggattactagaggaggagaacttcagagtagcaaataatcagacctccatccaggaagatggacgtgggtggtctgacatgggagcctagtattttgaaagctccttaggtgattctaatgtcagcagggctgaaaatccccctccttaagcacatgggcacttaggagggggtctaggttacattgtggccaagtctgcagtttacagttctggacaagaaccccaaccccaatttatgctatggtgatagctgtgctctgattgagaaggtgcccttaggtacttgagatagcttcctttgttgccaagtgagaagtggtgggcaggtttcaaggctgtggttcacctctggacaccatgttgattacatgcctttatttctagtctccaaaaaaagttggtgatgacattgccaaggcaacgggtgactggaagggcctgaggattacagtgaaactgaccattcagaacagacaggcccaggtatttgcttgtgcttggtttcgggagaggagggtggggggacaggtagcaaccctctgggattcctgaagagtatttctgccaccagtggtgagccgagagtgatttcaccttgttggggaggctttgtcaagagtacggacctagggcaaagacttggacagtgtgtggccatgatttttgagagccagcgtgcatggcagtattcactggaggtggagtattcactcaggaatctcttctgcaattgaggtggtgccttctgcctctgccctgatcatcaaagccctcaaggaaccaccaagagacagaaagaaacagaaaaacagtaagttgtcttttccctagtttggttttggtaatggtttgtgagatgtttgatatatgtggctgtgttttcccttaaaggaaacctggggttgacatgggtattgggtgttgatatggttagggctgctagagccaggtagtatgaaaaagtgccacgtatgctgggtggctcacacctgtaatcccagcactgggaggctgaggcgggtggatcagttgagatcaggagttcgagaccagcctggccaacatggtgaaaccccatctccaccaaaaaatacaaaattagcctggtggtgctcgcctgtagacctggctactcagacggctgaggcaggagaatcactcgaacccaggaggtggaggttgtagcagtgagccaagattgtgccactgcactccagcctgggtaacagtgagactccgtctcaaaaaaaaaaaaaaaagtgccatgtagtccctgtgtggggcaggccccaatcagtgcatgtgggaggaagatgtcagcaataatgacctataatcaggagaccacatacaggtggcaggtactgggcagtttaactccctggcaatttaagcttgtcatttctctaaaacagtttctgccatgtcagatttgtgaaggcttggttttgccctcagccacccgccactgcacctgaccaggtctctgttggctggtgcaatccagtggtgagctgatagtaaaccccagcttaggaaacagggttgttcttcatgtggatgactctgtgccgaaagcatgggaacagcctagaaatgaaatgaaggacacatgatctgctttggcttcagactttaaaagagcttttgctgtttcctcttctgcagttattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggtgga

SEQ ID NO: 313543 - DNA, 545 bp, Homo sapiens
cggacgcgtgggtcgacccacgcgtcggggaggaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggtgga

SEQ ID NO: 313544 - DNA, 1322 bp, Homo sapiens
  misc_feature (1149)..(1149): n is a, c, g, or t
cggacgcgtgggtcgacccacgcgtcggggaggaggccaaggtgcaacttccttcggtcgtcccgaatccgggttcatccgacaccagccgcctccaccatgccgccgaagttcgaccccaacgagatcaaagtcgtcggtgcgtgctctggttgtggccggggctgcgggatggagcatccctcggccccgccgcgcgtgcaaagctttccccgtatggggctcttaaagccgctgcctcccagagaccttcccggtgttgcgccgccccggccaagcctcagcctttctgggccttagcttcttcacgtgtaggtggggagggaggactggaccacctgtggcggcttgggagcccgcacgccctaggtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggtggaaaaaaaaaacaaaagaaaaaaaaaaaaaaaacagaaaaaacaaaaacaaaacacaaagaaaaaaaaaaacaccccgggggcccaaattgggggggggggcaacaaaaggggtgaacaaacagggcccgcgggggccacaaagaggtgtccgcgcgcccccgatttgttgtagcagacggaggggggaaaagtcgcgggggggccccccaaaaagaggggacgcgcagaaacaacacttcaggcaagcgccccgggtgaccccagataaatnagccagagcgacaaggaaggccccgcgagcgacgtactcgccgccacgaagcgggcggccgaacagaggaggagcacacagcactgatcgctagaaaccctctgctacaacgaactacctgcgttgaaagaccaacgaacaacacgagccaagtggtgggacgacagcggcgc

SEQ ID NO: 313545 - DNA, 708 bp, Homo sapiens
tctcatttaacttttttaatgggtctcaaaattctgtgacaaatttttggtcaagttgtttccattaaaaagtactgattttaaaaactaataacttaaaactgccacacgcaaaaaagaaaaccaaagtggtccacaaaacattctcctttccttctgaaggttttacgatgcattgttatcattaaccagtcttttactactagaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggtgga

SEQ ID NO: 313546 - DNA, 1065 bp, Homo sapiens
cggacgcgtgggtcgacccacgcgtcggggaggaggccaaggtgcaacttccttcggtcgtcccgaatccgggttcatccgacaccagccgcctccaccatgccgccgaagttcgaccccaacgagatcaaagtcgcacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggtggaaaaccagcacacaaaaaaccaaaaacaagcaaacaacacaacacacacaaaaacaaacaagcgcgggcgcgcccacaaaaaagttcccccccaggagggcccacagtctcaacgcacacccgctttttctcgacaccacaggggacccccacatatgaggagagcagcactaataaaaaccgacacgcgacaggcgaccgaacatataacaacacagtagagacagtgggaaaacgctggcatagcggggaaaactcgagcaaaaggacaccagacactgcacgggggagccaggccacaaagggggggcacgaaccaccgcccgacgacatattaaggccgtacagaggccgcaaatcaaacacatgcacacggccctaacaggcgcaaacacaaggccgacacagggacggaaaaaacacacgcgggcacacggaaatagatgccccgaaact

SEQ ID NO: 313547 - DNA, 1187 bp, Homo sapiens
ctcctaggttataaacctgttgggctcccccatttgggggggacccggggcgtatccttcatatgtccctgagtctctcctatccaaagggccctatattccccgcaggctgtatacaccgttccccgggtaactttggtttgaccgcaggttaaattaaacctgggcccacaaatcaattgcacatgctctcctggtacacaggccgggcattttttctcacttacaatacctgacgaacggcatgacctttatgacacggccgcccacaattgttgccaaacttcgaaagagtgtgcccccacctgcagattttcttgacgcacaagagtgttgagattcccccatggatacacgggagttcatggacgaggatcttcttgttggaaccttgctggccatcgtgtttgatggtaagagtttctcaccaaagccgcgaaatgtagctgaagatccaaaaaatctcaccagaaggggagggagaagagattcgattctgaggtctcctactcccgggtttctgcgtagagaaaccgactctgctggaggtcggcaaccggccacaaccgctcagcgaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggtgga

SEQ ID NO: 313548 - DNA, 1163 bp, Homo sapiens
  misc_feature (649)..(649): n is a, c, g, or t
cggacgcgtgggtcgacccacgcgtcggggaggaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaaccattttcactaaaggattcattttgacaactgggttgnacaacacacacaaaacaagcaaacaaccaaaacagcacccgcaaacaagaaacaacaaggacacacacacagaccacacaagccaacaacaaggacgcacaagaaaacacaaaacaacaaacacaaacagccacaccccacaaaaaaagacaccaagcaaaaaaacgaacagtaaacacccaacccaacctacaagcagaacacaaacacaacatcaaccagacacacctgacaaactaactcaacgcactcaacaccgaaacgaaacccaacagcagaccaccaaaacaacgaacaagagcgatacaacacccgcaaaacaccaggaacggacccaaagacacacccaacaccaacaccacacaccccaccgtcacaccctgaaaaaaacagaacgagcaagagagaccaaacacaaaataatcaaccgatgcagcataacatgacaaaccaaaacaagaaccaagaacgaaaaaagaaacacacacagaaactacaccactcaacgcaaacc

SEQ ID NO: 313549 - DNA, 1361 bp, Homo sapiens
ctcctaggttataaacctgttgggctcccccatttgggggggacccggggcgtatccttcatatgtccctgagtctctcctatccaaagggccctatattccccgcaggctgtatacaccgttccccgggtaactttggtttgaccgcaggttaaattaaacctgggcccacaaatcaattgcacatgctctcctggtacacaggccgggcattttttctcacttacaatacctgacgaacggcatgacctttatgacacggccgcccacaattgttgccaaacttcgaaagagtgtgcccccacctgcagattttcttgacgcacaagagtgttgagattcccccatggatacacgggagttcatggacgaggatcttcttgttggaaccttgctggccatcgtgtttgatggtaagagtttctcaccaaagccgcgaaatgtagctgaagatccaaaaaatctcaccagaaggggagggagaagagattcgattctgaggtctcctactcccgggtttctgcgtagagaaaccgactctgctggaggtcggcaaccggccacaaccgctcagcgaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggtggaaaaaaaaaacaaaagaaaaaaaaaaaaaaaacccgggggccctaaaggggggggggaaaaaaggcgcactgcaaggggcacgtggccaaacgggtgtctccggccccgagtttctgtggcacaaggggggaacacgggggggccccaataggggagcccggcataaatgcgaag

SEQ ID NO: 313550 - DNA, 1341 bp, Homo sapiens
ctcctaggttataaacctgttgggctcccccatttgggggggacccggggcgtatccttcatatgtccctgagtctctcctatccaaagggccctatattccccgcaggctgtatacaccgttccccgggtaactttggtttgaccgcaggttaaattaaacctgggcccacaaatcaattgcacatgctctcctggtacacaggccgggcattttttctcacttacaatacctgacgaacggcatgacctttatgacacggccgcccacaattgttgccaaacttcgaaagagtgtgcccccacctgcagattttcttgacgcacaagagtgttgagattcccccatggatacacgggagttcatggacgaggatcttcttgttggaaccttgctggccatcgtgtttgatggtaagagtttctcaccaaagccgcgaaatgtagctgaagatccaaaaaatctcaccagaaggggagggagaagagattcgattctgaggtctcctactcccgggtttctgcgtagagaaaccgactctgctggaggtcggcaaccggccacaaccgctcagcgaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagccgtaagtgacattttcattgttacagtaggggtgaaaggggggccacccagtgtattcacagagataagctgggaagttttggaaatggttactggtggggtgggataatccttttaaactttttactgattttttttttctttcccacagagttaagcacaaaggaaaacatttcaataaaggatcatttgacaactggtgga

SEQ ID NO: 313551 - DNA, 1177 bp, Homo sapiens
ctcctaggttataaacctgttgggctcccccatttgggggggacccggggcgtatccttcatatgtccctgagtctctcctatccaaagggccctatattccccgcaggctgtatacaccgttccccgggtaactttggtttgaccgcaggttaaattaaacctgggcccacaaatcaattgcacatgctctcctggtacacaggccgggcattttttctcacttacaatacctgacgaacggcatgacctttatgacacggccgcccacaattgttgccaaacttcgaaagagtgtgcccccacctgcagattttcttgacgcacaagagtgttgagattcccccatggatacacgggagttcatggacgaggatcttcttgttggaaccttgctggccatcgtgtttgatggtaagagtttctcaccaaagccgcgaaatgtagctgaagatccaaaaaatctcaccagaaggggagggagaagagattcgattctgaggtctcctactcccgggtttctgcgtagagaaaccgactctgctggaggtcggcaaccggccacaaccgctcagcgaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcaaaaatgatcctttattgaaatgttttcctttgtg

SEQ ID NO: 313552 - DNA, 1204 bp, Homo sapiens
ctcctaggttataaacctgttgggctcccccatttgggggggacccggggcgtatccttcatatgtccctgagtctctcctatccaaagggccctatattccccgcaggctgtatacaccgttccccgggtaactttggtttgaccgcaggttaaattaaacctgggcccacaaatcaattgcacatgctctcctggtacacaggccgggcattttttctcacttacaatacctgacgaacggcatgacctttatgacacggccgcccacaattgttgccaaacttcgaaagagtgtgcccccacctgcagattttcttgacgcacaagagtgttgagattcccccatggatacacgggagttcatggacgaggatcttcttgttggaaccttgctggccatcgtgtttgatggtaagagtttctcaccaaagccgcgaaatgtagctgaagatccaaaaaatctcaccagaaggggagggagaagagattcgattctgaggtctcctactcccgggtttctgcgtagagaaaccgactctgctggaggtcggcaaccggccacaaccgctcagcgaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagcccgatgaatagcgaggtgccgatgaatagcgcggtgccgatgcaatagcgaggtgccgatgaatagcgggg

SEQ ID NO: 313553 - DNA, 2548 bp, Homo sapiens
ctcctaggttataaacctgttgggctcccccatttgggggggacccggggcgtatccttcatatgtccctgagtctctcctatccaaagggccctatattccccgcaggctgtatacaccgttccccgggtaactttggtttgaccgcaggttaaattaaacctgggcccacaaatcaattgcacatgctctcctggtacacaggccgggcattttttctcacttacaatacctgacgaacggcatgacctttatgacacggccgcccacaattgttgccaaacttcgaaagagtgtgcccccacctgcagattttcttgacgcacaagagtgttgagattcccccatggatacacgggagttcatggacgaggatcttcttgttggaaccttgctggccatcgtgtttgatggtaagagtttctcaccaaagccgcgaaatgtagctgaagatccaaaaaatctcaccagaaggggagggagaagagattcgattctgaggtctcctactcccgggtttctgcgtagagaaaccgactctgctggaggtcggcaaccggccacaaccgctcagcgaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacagtaagttgtcttttccctagtttggttttggtaatggtttgtgagatgtttgatatatgtggctgtgttttcccttaaaggaaacctggggttgacatgggtattgggtgttgatatggttagggctgctagagccaggtagtatgaaaaagtgccacgtatgctgggtggctcacacctgtaatcccagcactgggaggctgaggcgggtggatcagttgagatcaggagttcgagaccagcctggccaacatggtgaaaccccatctccaccaaaaaatacaaaattagcctggtggtgctcgcctgtagacctggctactcagacggctgaggcaggagaatcactcgaacccaggaggtggaggttgtagcagtgagccaagattgtgccactgcactccagcctgggtaacagtgagactccgtctcaaaaaaaaaaaaaaaagtgccatgtagtccctgtgtggggcaggccccaatcagtgcatgtgggaggaagatgtcagcaataatgacctataatcaggagaccacatacaggtggcaggtactgggcagtttaactccctggcaatttaagcttgtcatttctctaaaacagtttctgccatgtcagatttgtgaaggcttggttttgccctcagccacccgccactgcacctgaccaggtctctgttggctggtgcaatccagtggtgagctgatagtaaaccccagcttaggaaacagggttgttcttcatgtggatgactctgtgccgaaagcatgggaacagcctagaaatgaaatgaaggacacatgatctgctttggcttcagactttaaaagagcttttgctgtttcctcttctgcagttattaaacacagtgggaatatcacttttgatgagattgtcaacattgctcgacagatgcggcaccgatccttagccagagaactctctggtaagagcaggacaacatgtaaccgccataactgtagttgtgtttttcactgagtgataacattcttcttacttgaagggtgctcagtgagacccaagatggggtgcagttttctgggactgaaaggatggatcgtaaattggatgtgtttaatctgggcatcaaggacccatggaagctttgcattccgggttatggaactagatggaactctatattctatattaggggagcaggaacctcattccttccattgcctgctatgaaccccttcagtattccccagtatctgcagattgtgagggactgagccagcacctccaatgccaccatttctttacttaaaggaaccattaaagagatcctggggactgcccagtcagtgggctgtaatgttgatggccgccatcctcatgacatcatcgatgacatcaacagtggtgctgtggaatgcccagccagccgtaagtgacattttcattgttacagtaggggtgaaaggggggccacccagtgtattcacagagataagctgggaagttttggaaatggttactggtggggtgggataatccttttaaactttttactgattttttttttctttcccacagagttaagcacaaaggaaaacatttcaataaaggatcatttgacaactggtgga

SEQ ID NO: 313554 - DNA, 2146 bp, Homo sapiens
cggacgcgtgggtcgacccacgcgtcggggaggaggccaaggtgcaacttccttcggtcgtcccgaatccgggttcatccgacaccagccgcctccaccatgccgccgaagttcgaccccaacgagatcaaagtcgtcggtgcgtgctctggttgtggccggggctgcgggatggagcatccctcggccccgccgcgcgtgcaaagctttccccgtatggggctcttaaagccgctgcctcccagagaccttcccggtgttgcgccgccccggccaagcctcagcctttctgggccttagcttcttcacgtgtaggtggggagggaggactggaccacctgtggcggcttgggagcccgcacgccctagggtaaggcttgtctccgggcgtttcgccccattggcctgggttagcgggcgacggggctctctccacgcctccccggtgtgagtttcggagctgcccacacccgagggaggagcgggtggcccgcctcgcgctctgtgctgtttcgagaagaggcagagggtggcgtgtccaaccccggaaagacgctgagagggctgtggctcggggctccctctgcacagacactaactcttcttttcccccagtatatacctgaggtgcaccggaggtgaagtcggtgccacttctgccctggcccccaagatcggccccctgggtctggtacgttatcccctccaaggggcatttttttcacatttgtttcactttaagcgccggctcgtggagtcacgcctgtgccagaggtgccctcgtggcttggactgtcaccctcagtaggcctgagccactgaactagtactaggtaccttaggaaggtcgtgtgtgaaaaatcgaacctggtgcctttaaattgtaattagctccatgtgtctccactgctgctttagtgtacctgaggggtgggcccaagggggagttttgaagttaggactggcttagagacattgggcagccaacatctgtatttcctcgtcaggaagtgggcatggcgttgttgggagattaaacggggtgtgggtgaagatccagtgagcgtttccagctgtgttgtagatgtaaacctagcagttaatgtggcaggctgtgtctcatgcctgctgagcaactgctggcttccccgtcattctgtcctcttggatttctctgaatttcattaggcctttatttaatccttgcacagtgctcccctgccccaaatgctcttccccattggtcttttttaacctgtatcttaactattcttccttggccgttagctggcacttaagggacacttagcctcctgttgaggctaaggattactagaggaggagaacttcagagtagcaaataatcagacctccatccaggaagatggacgtgggtggtctgacatgggagcctagtattttgaaagctccttaggtgattctaatgtcagcagggctgaaaatccccctccttaagcacatgggcacttaggagggggtctaggttacattgtggccaagtctgcagtttacagttctggacaagaaccccaaccccaatttatgctatggtgatagctgtgctctgattgagaaggtgcccttaggtacttgagatagcttcctttgttgccaagtgagaagtggtgggcaggtttcaaggctgtggttcacctctggacaccatgttgattacatgcctttatttctagtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggtgga

SEQ ID NO: 313555 - DNA, 2392 bp, Homo sapiens
cggacgcgtgggtcgacccacgcgtcggggaggaggccaaggtgcaacttccttcggtcgtcccgaatccgggttcatccgacaccagccgcctccaccatgccgccgaagttcgaccccaacgagatcaaagtcgtcggtgcgtgctctggttgtggccggggctgcgggatggagcatccctcggccccgccgcgcgtgcaaagctttccccgtatggggctcttaaagccgctgcctcccagagaccttcccggtgttgcgccgccccggccaagcctcagcctttctgggccttagcttcttcacgtgtaggtggggagggaggactggaccacctgtggcggcttgggagcccgcacgccctagggtaaggcttgtctccgggcgtttcgccccattggcctgggttagcgggcgacggggctctctccacgcctccccggtgtgagtttcggagctgcccacacccgagggaggagcgggtggcccgcctcgcgctctgtgctgtttcgagaagaggcagagggtggcgtgtccaaccccggaaagacgctgagagggctgtggctcggggctccctctgcacagacactaactcttcttttcccccagtatatacctgaggtgcaccggaggtgaagtcggtgccacttctgccctggcccccaagatcggccccctgggtctggtacgttatcccctccaaggggcatttttttcacatttgtttcactttaagcgccggctcgtggagtcacgcctgtgccagaggtgccctcgtggcttggactgtcaccctcagtaggcctgagccactgaactagtactaggtaccttaggaaggtcgtgtgtgaaaaatcgaacctggtgcctttaaattgtaattagctccatgtgtctccactgctgctttagtgtacctgaggggtgggcccaagggggagttttgaagttaggactggcttagagacattgggcagccaacatctgtatttcctcgtcaggaagtgggcatggcgttgttgggagattaaacggggtgtgggtgaagatccagtgagcgtttccagctgtgttgtagatgtaaacctagcagttaatgtggcaggctgtgtctcatgcctgctgagcaactgctggcttccccgtcattctgtcctcttggatttctctgaatttcattaggcctttatttaatccttgcacagtgctcccctgccccaaatgctcttccccattggtcttttttaacctgtatcttaactattcttccttggccgttagctggcacttaagggacacttagcctcctgttgaggctaaggattactagaggaggagaacttcagagtagcaaataatcagacctccatccaggaagatggacgtgggtggtctgacatgggagcctagtattttgaaagctccttaggtgattctaatgtcagcagggctgaaaatccccctccttaagcacatgggcacttaggagggggtctaggttacattgtggccaagtctgcagtttacagttctggacaagaaccccaaccccaatttatgctatggtgatagctgtgctctgattgagaaggtgcccttaggtacttgagatagcttcctttgttgccaagtgagaagtggtgggcaggtttcaaggctgtggttcacctctggacaccatgttgattacatgcctttatttctagtctccaaaaaaagttggtgatgacattgccaaggcaacgggtgactggaagggcctgaggattacagtgaaactgaccattcagaacagacaggcccaggtatttgcttgtgcttggtttcgggagaggagggtggggggacaggtagcaaccctctgggattcctgaagagtatttctgccaccagtggtgagccgagagtgatttcaccttgttggggaggctttgtcaagagtacggacctagggcaaagacttggacagtgtgtggccatgatttttgagagccagcgtgcatggcagtattcactggaggtggagtattcactcaggaatctcttctgcaattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggtgga

SEQ ID NO: 313556 - DNA, 471 bp, Homo sapiens
cggacgcgtgggtcgacccacgcgtcggggaggaggccaaggtgcaacttccttcggtcgtcccgaatccgggttcatccgacaccagccgcctccaccatgccgccgaagttcgaccccaacgagatcaaagtcgattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggtgga

SEQ ID NO: 313557 - DNA, 2191 bp, Homo sapiens
cggacgcgtgggtcgacccacgcgtcggggaggaggccaaggtgcaacttccttcggtcgtcccgaatccgggttcatccgacaccagccgcctccaccatgccgccgaagttcgaccccaacgagatcaaagtcgtcggtgcgtgctctggttgtggccggggctgcgggatggagcatccctcggccccgccgcgcgtgcaaagctttccccgtatggggctcttaaagccgctgcctcccagagaccttcccggtgttgcgccgccccggccaagcctcagcctttctgggccttagcttcttcacgtgtaggtggggagggaggactggaccacctgtggcggcttgggagcccgcacgccctagggtaaggcttgtctccgggcgtttcgccccattggcctgggttagcgggcgacggggctctctccacgcctccccggtgtgagtttcggagctgcccacacccgagggaggagcgggtggcccgcctcgcgctctgtgctgtttcgagaagaggcagagggtggcgtgtccaaccccggaaagacgctgagagggctgtggctcggggctccctctgcacagacactaactcttcttttcccccagtatatacctgaggtgcaccggaggtgaagtcggtgccacttctgccctggcccccaagatcggccccctgggtctggtacgttatcccctccaaggggcatttttttcacatttgtttcactttaagcgccggctcgtggagtcacgcctgtgccagaggtgccctcgtggcttggactgtcaccctcagtaggcctgagccactgaactagtactaggtaccttaggaaggtcgtgtgtgaaaaatcgaacctggtgcctttaaattgtaattagctccatgtgtctccactgctgctttagtgtacctgaggggtgggcccaagggggagttttgaagttaggactggcttagagacattgggcagccaacatctgtatttcctcgtcaggaagtgggcatggcgttgttgggagattaaacggggtgtgggtgaagatccagtgagcgtttccagctgtgttgtagatgtaaacctagcagttaatgtggcaggctgtgtctcatgcctgctgagcaactgctggcttccccgtcattctgtcctcttggatttctctgaatttcattaggcctttatttaatccttgcacagtgctcccctgccccaaatgctcttccccattggtcttttttaacctgtatcttaactattcttccttggccgttagctggcacttaagggacacttagcctcctgttgaggctaaggattactagaggaggagaacttcagagtagcaaataatcagacctccatccaggaagatggacgtgggtggtctgacatgggagcctagtattttgaaagctccttaggtgattctaatgtcagcagggctgaaaatccccctccttaagcacatgggcacttaggagggggtctaggttacattgtggccaagtctgcagtttacagttctggacaagaaccccaaccccaatttatgctatggtgatagctgtgctctgattgagaaggtgcccttaggtacttgagatagcttcctttgttgccaagtgagaagtggtgggcaggtttcaaggctgtggttcacctctggacaccatgttgattacatgcctttatttctagtctccaaaaaaagttggtgatgacattgccaaggcaacgggtgactggaagggcctgaggattacagtgaaattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagccgtaagtgacattttcattgttacagtaggggtgaaaggggggccacccagtgtattcacagagataagctgggaagttttggaaatggttactggtggggtgggataatccttttaaactttttactgattttttttttctttcccacagagttaagcacaaaggaaaacatttcaataaaggatcatttgacaactggtgga

SEQ ID NO: 313558 - DNA, 4245 bp, Homo sapiens
cccaacctcccgggctcacgtcccccgccggctccgcgctcgcgccccccgcccgaacggggctgggcggggccggcgctggttagctccggagtgtgaaaccgcgtgttaatgtaagcggcgcgagaggcgcgggcggcggcggcggtgggagcggcggctgcagaagcagcagcagcagaaacagcggcgggtactctgtgccccgcgtcccggaggcagccgactgcgccaccccaccctcgcacggccgggcgggacccgcgccaccagcccggacctccgtcgtcccgcggcgaccaaaacccccgctggccccaccgctgtgactactctggactcgcccgcagagtttgcccgccggggagggtggccgattggcggagcgcactcctgctgttttccccaccatctcgtggatgtcgtccctcgggtggtgagagaactttgcagtgggctggagcgccctttgcggagaagcacacgaaggtgaaggaaggaaagaaagaagaccgaggaagaaggagctcggaagaagggtccggagcggccggtccggccgtgcagggcgagtgcgcccgaggcgcggcgccctgatgctccccgggctcgaggagcattgggcacttgcgggactgctctcggtggagtagccccgtcgggcccggagggtttgtgcaaccgcggagaacaccgagtgctggtcgcacggggcgtgccgagccgcctcccggcgcgccctccgcactttccccgcctcgtcatccgtcgctccccggccaggagcctccgctgcgtcttcaacctcgctcccctttgcgtcccgggagcctgcgagcacccggccgaaggcgcagccgaatcttgcgggagtcgccccgaaagcgtcgggtttgtgtggggttagcgggggccgccgcgccacctgcacctcgcccgccgccgcctcggggaaagcccgaagaggaggcggaccaggagaagagcaaagaaaagcagtccgtctggatttgtttgcccaggactggcgccgcgcacgcggatcgccgaggggagtgcggtcggagtcaccgcgcccccgcctccccgcccgggcagctgaggccgggggttggagcgctgcccccgcgcacagtccccgagcgcccgacgtctccgcgcaggttcttgaagcagctgggcctggggcgcccactaatgtggccctgagggccggagcccgcaccgacgggagcgggagccggagcagctgcgggcgccgagtggccggtgcgcccggcggagcgcgcgtgcgtggccagcgcgctccccgcttctgcttggctttccggcttaattttcctcggcgggattaaagttggaaattgaccggagaattgagttgccggggaacagagccccggccgccgccagagcgatgttcccgcagagccggcacccgacgccgcaccaggctgcaggccagcccttcaagttcactatcccggagtccctggaccggattaaagaggaattccagttcctgcaggcgcagtatcacagccttaaattggaatgtgagaaactggcaagtgaaaagacagaaatgcagaggcactatgtgatgtattatgaaatgtcatatggattaaacattgaaatgcacaaacagactgaaatcgccaagagattgaatacgatttgtgcacaagtcatcccatttctgtctcaggaacatcaacaacaggtggcccaggctgttgaacgtgccaaacaggtgaccatggcagagttgaatgccatcatcgggcagcagcagttgcaagctcagcatctttctcatggccacggacccccagttccccttacgcctcacccttcgggacttcagcctcctggaatcccgcccctcgggggcagtgccggccttcttgcgctgtctagtgctctgagtgggcagtctcacttggcaataaaagatgacaagaagcaccacgatgcagagcaccacagagacagagagccgggcacaagtaattccctcctggtcccagacagtctaagaggcacagataaacgcagaaatggacctgaattttccaatgacatcaagaaaaggaaggtggatgataaggactccagccactatgacagtgatggtgacaaaagcgatgacaacttagttgtggatgtgtctaatgaggacccttcttctccgcgagcaagccctgcccactcgccccgggaaaatggaatcgacaaaaatcgcctgctaaagaaggatgcttctagcagtccagcttccacggcctcctcggcaagttccacttctttgaaatccaaagaaatgagcttgcatgaaaaagccagcacgcctgttctgaaatccagcacaccaacgcctcggagcgacatgccaacgccgggcaccagcgccactccaggcctccgtccaggtctcggcaagcctccagccatagaccccctcgttaaccaagcggcagctggcttgaggacacccctggcagtgcccggcccatatcctgctccttttgggatggtcccccacgctggcatgaacggcgagctgaccagcccaggcgctgcctacgccagtttacacaacatgtcgccccagatgagcgccgcagccgccgcggccgccgtggtggcctacgggcgctcccccatggtggggtttgatcctccccctcacatgagagtacctaccattcctccaaacctggcaggaatccctggggggaaacctgcatactccttccacgttactgcagacggtcagatgcagcctgtcccttttccccccgacgccctcatcggacccggaatcccccggcatgctcgccagatcaacaccctcaaccacggggaggtggtgtgcgctgtgaccatcagcaaccccacgagacacgtgtacacaggcgggaagggctgcgtcaaggtctgggacatcagccaccctggcaataagagccctgtctcccagctcgactgtctgaacagagacaattatatccgttcctgtaaattgctacccgatggctgcactctcatagtgggaggggaagccagtactttgtccatttgggacctggcggctccaaccccgcgcatcaaggcggagctgacgtcctcggcccccgcctgctacgccctggccatcagccccgattccaaggtctgcttctcatgctgcagcgacggcaacatcgctgtgtgggatctgcacaaccagacactagtgaggcaattccagggccacacagacggagccagctgtattgacatttctaatgatggcaccaagctctggacgggtggtttggacaacacagtcaggtcctgggacctgcgcgaggggcggcagctgcagcagcacgacttcacctcccagatcttctccctggggtactgccccaccggggagtggctggcagtgggcatggagagcagcaatgtggaggtgctgcacgtgaacaagcctgacaagtaccagctgcacctgcatgagagctgcgtgctgtccctgaaatttgcttactgtggtaaatggtttgtgagtactggaaaagataacctcctcaatgcttggcggaccccctatggagccagcatattccagtccaaagagtcctcgtcagtgcttagctgtgacatctctgtggatgataagtacatagtcactggctcgggggacaagaaggctacagtctatgaagtcatctactgaaaacattatgtggtttaacgtttatagttgaattgggccaaaatgtttcgaatttatagaaatagaaaagttgtaactttaaaagagaaaaaaaattacaaacacctgtttccaaaccttgacagaaaactactttgagtctacaaagaggaggcgacaagtccatcagcagaaagtcacctgtctacatagaccaaatggagcaccaaggccaagcggacagaggggccatgggttgtaggattgaggaacggaatctgccgactcacatgacagcccattctttctttctgggtgatctggggatcacgccttgcccaagtgtgagattacctttctgttccttgcagttcacctcactttccgtcctttgtagagcagtggtgtctccaatgaacttgtttcctggttttgcatcttgtgaaatgtttttttgtatttttgttgaaggttaaacatttgtataaattgtaaatatatttggtttattacagtaaaggctttagtaccaataa

SEQ ID NO: 313559 - DNA, 4546 bp, Homo sapiens
cccaacctcccgggctcacgtcccccgccggctccgcgctcgcgccccccgcccgaacggggctgggcggggccggcgctggttagctccggagtgtgaaaccgcgtgttaatgtaagcggcgcgagaggcgcgggcggcggcggcggtgggagcggcggctgcagaagcagcagcagcagaaacagcggcgggtactctgtgccccgcgtcccggaggcagccgactgcgccaccccaccctcgcacggccgggcgggacccgcgccaccagcccggacctccgtcgtcccgcggcgaccaaaacccccgctggccccaccgctgtgactactctggactcgcccgcagagtttgcccgccggggagggtggccgattggcggagcgcactcctgctgttttccccaccatctcgtggatgtcgtccctcgggtggtgagagaactttgcagtgggctggagcgccctttgcggagaagcacacgaaggtgaaggaaggaaagaaagaagaccgaggaagaaggagctcggaagaagggtccggagcggccggtccggccgtgcagggcgagtgcgcccgaggcgcggcgccctgatgctccccgggctcgaggagcattgggcacttgcgggactgctctcggtggagtagccccgtcgggcccggagggtttgtgcaaccgcggagaacaccgagtgctggtcgcacggggcgtgccgagccgcctcccggcgcgccctccgcactttccccgcctcgtcatccgtcgctccccggccaggagcctccgctgcgtcttcaacctcgctcccctttgcgtcccgggagcctgcgagcacccggccgaaggcgcagccgaatcttgcgggagtcgccccgaaagcgtcgggtttgtgtggggttagcgggggccgccgcgccacctgcacctcgcccgccgccgcctcggggaaagcccgaagaggaggcggaccaggagaagagcaaagaaaagcagtccgtctggatttgtttgcccaggactggcgccgcgcacgcggatcgccgaggggagtgcggtcggagtcaccgcgcccccgcctccccgcccgggcagctgaggccgggggttggagcgctgcccccgcgcacagtccccgagcgcccgacgtctccgcgcaggttcttgaagcagctgggcctggggcgcccactaatgtggccctgagggccggagcccgcaccgacgggagcgggagccggagcagctgcgggcgccgagtggccggtgcgcccggcggagcgcgcgtgcgtggccagcgcgctccccgcttctgcttggctttccggcttaattttcctcggcgggattaaagttggaaattgaccggagaattgagttgccggggaacagagccccggccgccgccagagcgatgttcccgcagagccggcacccgacgccgcaccaggctgcaggccagcccttcaagttcactatcccggagtccctggaccggattaaagaggaattccagttcctgcaggcgcagtatcacagccttaaattggaatgtgagaaactggcaagtgaaaagacagaaatgcagaggcactatgtgatgtattatgaaatgtcatatggattaaacattgaaatgcacaaacagactgaaatcgccaagagattgaatacgatttgtgcacaagtcatcccatttctgtctcaggaacatcaacaacaggtggcccaggctgttgaacgtgccaaacaggtgaccatggcagagttgaatgccatcatcggggtacgtggcctaccaggtctacctcctacacagcagcagttgcaagctcagcatctttctcatggccacggacccccagttccccttacgcctcacccttcgggacttcagcctcctggaatcccgcccctcgggggcagtgccggccttcttgcgctgtctagtgctctgagtgggcagtctcacttggcaataaaagatgacaagaagcaccacgatgcagagcaccacagagacagagagccgggcacaagtaattccctcctggtcccagacagtctaagaggcacagataaacgcagaaatggacctgaattttccaatgacatcaagaaaaggaaggtggatgataaggactccagccactatgacagtgatggtgacaaaagcgatgacaacttagttgtggatgtgtctaatgaggacccttcttctccgcgagcaagccctgcccactcgccccgggaaaatggaatcgacaaaaatcgcctgctaaagaaggatgcttctagcagtccagcttccacggcctcctcggcaagttccacttctttgaaatccaaagaaatgagcttgcatgaaaaagccagcacgcctgttctgaaatccagcacaccaacgcctcggagcgacatgccaacgccgggcaccagcgccactccaggcctccgtccaggtctcggcaagcctccagccatagaccccctcgttaaccaagcggcagctggcttgaggacacccctggcagtgcccggcccatatcctgctccttttgggatggtcccccacgctggcatgaacggcgagctgaccagcccaggcgctgcctacgccagtttacacaacatgtcgccccagatgagcgccgcagccgccgcggccgccgtggtggcctacgggcgctcccccatggtggggtttgatcctccccctcacatgagagtacctaccattcctccaaacctggcaggaatccctggggggaaacctgcatactccttccacgttactgcagacggtcagatgcagcctgtcccttttccccccgacgccctcatcggacccggaatcccccggcatgctcgccagatcaacaccctcaaccacggggaggtggtgtgcgctgtgaccatcagcaaccccacgagacacgtgtacacaggcgggaagggctgcgtcaaggtctgggacatcagccaccctggcaataagagccctgtctcccagctcgactgtctgaacagagacaattatatccgttcctgtaaattgctacccgatggctgcactctcatagtgggaggggaagccagtactttgtccatttgggacctggcggctccaaccccgcgcatcaaggcggagctgacgtcctcggcccccgcctgctacgccctggccatcagccccgattccaaggtctgcttctcatgctgcagcgacggcaacatcgctgtgtgggatctgcacaaccagacactagtgaggcaattccagggccacacagacggagccagctgtattgacatttctaatgatggcaccaagctctggacgggtggtttggacaacacagtcaggtcctgggacctgcgcgaggggcggcagctgcagcagcacgacttcacctcccagatcttctccctggggtactgccccaccggggagtggctggcagtgggcatggagagcagcaatgtggaggtgctgcacgtgaacaagcctgacaagtaccagctgcacctgcatgagagctgcgtgctgtccctgaaatttgcttactgtggtaaatggtttgtgagtactggaaaagataacctcctcaatgcttggcggaccccctatggagccagcatattccagtccaaagagtcctcgtcagtgcttagctgtgacatctctgtggatgataagtacatagtcactggctcgggggacaagaaggctacagtctatgaagtcatctactgaaaacattatgtggtttaacgtttatagttgaattgggccaaaatgtttcgaatttatagaaatagaaaagttgtaactttaaaaatgcagcgcaagtaggtctacaagacgctacttcccctatcatagaagagcttatcacctttcatgatcacgccctcataatcattttccttatctgcttcctagtcctgtatgcccttttcctaacactcacaacaaaactaactaatactaacatctcagacgctcaggaaatagaaaccgtctgaactatcctgcccgccatcatcctagtcctcatcgccctcccatccctacgcatcctttacataacagacgaggtcaacgatccctcccttaccatcaaatcaattggccaccaatggtactgaacctacgagtacaccgactacggcggactaatcttcaactcctacatacttcccccattattcctagaaccaggcgacctgcgactccttgacgttgacaatcgagtagtactcccgattgaagcccccattcgtataataattacatcacaagacgtcttgcactcatgagctgtccccacattaggcttaaaaacagatgcaattcccggacgtctaaaccaaaccactttcaccgctacacgaccgggggtatactacggtcaatgctctgaaatctgtggagcaaaccacagtttcatgcccatcgtcctagaattaattcccctaaaaatctttgaaatagggcccgtatttaccctatagcaccccctctaccccctctagagcc

SEQ ID NO: 313560 - DNA, 415 bp, Homo sapiens
tatttttagtagagacggggtttcaccatgttggccaggctggtctcaaactcctgacctcaggtgatctgcccatctcggcctcccaaagtgctgggattacaggcgtgagctaccttgcccagccttcttttagttttaaataattcaaatcctagggacttcagtaaagtttctgataattattttgaacacaagcctccccacctaactagcattgtgcgtctgactttgctaatactggctgaaacagcggtttggctggcccaaccgtgctccttgcagactatagtttgctggttttctgctaggggaggcttcaggaatcagtggtctctcctgcagtagaaattaggagggtttctctgcgactccagcccttaaaaaactcataatttgcaacctgatattcccc

SEQ ID NO: 313561 - DNA, 4275 bp, Homo sapiens
cccaacctcccgggctcacgtcccccgccggctccgcgctcgcgccccccgcccgaacggggctgggcggggccggcgctggttagctccggagtgtgaaaccgcgtgttaatgtaagcggcgcgagaggcgcgggcggcggcggcggtgggagcggcggctgcagaagcagcagcagcagaaacagcggcgggtactctgtgccccgcgtcccggaggcagccgactgcgccaccccaccctcgcacggccgggcgggacccgcgccaccagcccggacctccgtcgtcccgcggcgaccaaaacccccgctggccccaccgctgtgactactctggactcgcccgcagagtttgcccgccggggagggtggccgattggcggagcgcactcctgctgttttccccaccatctcgtggatgtcgtccctcgggtggtgagagaactttgcagtgggctggagcgccctttgcggagaagcacacgaaggtgaaggaaggaaagaaagaagaccgaggaagaaggagctcggaagaagggtccggagcggccggtccggccgtgcagggcgagtgcgcccgaggcgcggcgccctgatgctccccgggctcgaggagcattgggcacttgcgggactgctctcggtggagtagccccgtcgggcccggagggtttgtgcaaccgcggagaacaccgagtgctggtcgcacggggcgtgccgagccgcctcccggcgcgccctccgcactttccccgcctcgtcatccgtcgctccccggccaggagcctccgctgcgtcttcaacctcgctcccctttgcgtcccgggagcctgcgagcacccggccgaaggcgcagccgaatcttgcgggagtcgccccgaaagcgtcgggtttgtgtggggttagcgggggccgccgcgccacctgcacctcgcccgccgccgcctcggggaaagcccgaagaggaggcggaccaggagaagagcaaagaaaagcagtccgtctggatttgtttgcccaggactggcgccgcgcacgcggatcgccgaggggagtgcggtcggagtcaccgcgcccccgcctccccgcccgggcagctgaggccgggggttggagcgctgcccccgcgcacagtccccgagcgcccgacgtctccgcgcaggttcttgaagcagctgggcctggggcgcccactaatgtggccctgagggccggagcccgcaccgacgggagcgggagccggagcagctgcgggcgccgagtggccggtgcgcccggcggagcgcgcgtgcgtggccagcgcgctccccgcttctgcttggctttccggcttaattttcctcggcgggattaaagttggaaattgaccggagaattgagttgccggggaacagagccccggccgccgccagagcgatgttcccgcagagccggcacccgacgccgcaccaggctgcaggccagcccttcaagttcactatcccggagtccctggaccggattaaagaggaattccagttcctgcaggcgcagtatcacagccttaaattggaatgtgagaaactggcaagtgaaaagacagaaatgcagaggcactatgtgatgtattatgaaatgtcatatggattaaacattgaaatgcacaaacagactgaaatcgccaagagattgaatacgatttgtgcacaagtcatcccatttctgtctcaggaacatcaacaacaggtggcccaggctgttgaacgtgccaaacaggtgaccatggcagagttgaatgccatcatcggggtacgtggcctaccaggtctacctcctacacagcagcagttgcaagctcagcatctttctcatggccacggacccccagttccccttacgcctcacccttcgggacttcagcctcctggaatcccgcccctcgggggcagtgccggccttcttgcgctgtctagtgctctgagtgggcagtctcacttggcaataaaagatgacaagaagcaccacgatgcagagcaccacagagacagagagccgggcacaagtaattccctcctggtcccagacagtctaagaggcacagataaacgcagaaatggacctgaattttccaatgacatcaagaaaaggaaggtggatgataaggactccagccactatgacagtgatggtgacaaaagcgatgacaacttagttgtggatgtgtctaatgaggacccttcttctccgcgagcaagccctgcccactcgccccgggaaaatggaatcgacaaaaatcgcctgctaaagaaggatgcttctagcagtccagcttccacggcctcctcggcaagttccacttctttgaaatccaaagaaatgagcttgcatgaaaaagccagcacgcctgttctgaaatccagcacaccaacgcctcggagcgacatgccaacgccgggcaccagcgccactccaggcctccgtccaggtctcggcaagcctccagccatagaccccctcgttaaccaagcggcagctggcttgaggacacccctggcagtgcccggcccatatcctgctccttttgggatggtcccccacgctggcatgaacggcgagctgaccagcccaggcgctgcctacgccagtttacacaacatgtcgccccagatgagcgccgcagccgccgcggccgccgtggtggcctacgggcgctcccccatggtggggtttgatcctccccctcacatgagagtacctaccattcctccaaacctggcaggaatccctggggggaaacctgcatactccttccacgttactgcagacggtcagatgcagcctgtcccttttccccccgacgccctcatcggacccggaatcccccggcatgctcgccagatcaacaccctcaaccacggggaggtggtgtgcgctgtgaccatcagcaaccccacgagacacgtgtacacaggcgggaagggctgcgtcaaggtctgggacatcagccaccctggcaataagagccctgtctcccagctcgactgtctgaacagagacaattatatccgttcctgtaaattgctacccgatggctgcactctcatagtgggaggggaagccagtactttgtccatttgggacctggcggctccaaccccgcgcatcaaggcggagctgacgtcctcggcccccgcctgctacgccctggccatcagccccgattccaaggtctgcttctcatgctgcagcgacggcaacatcgctgtgtgggatctgcacaaccagacactagtgaggcaattccagggccacacagacggagccagctgtattgacatttctaatgatggcaccaagctctggacgggtggtttggacaacacagtcaggtcctgggacctgcgcgaggggcggcagctgcagcagcacgacttcacctcccagatcttctccctggggtactgccccaccggggagtggctggcagtgggcatggagagcagcaatgtggaggtgctgcacgtgaacaagcctgacaagtaccagctgcacctgcatgagagctgcgtgctgtccctgaaatttgcttactgtggtaaatggtttgtgagtactggaaaagataacctcctcaatgcttggcggaccccctatggagccagcatattccagtccaaagagtcctcgtcagtgcttagctgtgacatctctgtggatgataagtacatagtcactggctcgggggacaagaaggctacagtctatgaagtcatctactgaaaacattatgtggtttaacgtttatagttgaattgggccaaaatgtttcgaatttatagaaatagaaaagttgtaactttaaaagagaaaaaaaattacaaacacctgtttccaaaccttgacagaaaactactttgagtctacaaagaggaggcgacaagtccatcagcagaaagtcacctgtctacatagaccaaatggagcaccaaggccaagcggacagaggggccatgggttgtaggattgaggaacggaatctgccgactcacatgacagcccattctttctttctgggtgatctggggatcacgccttgcccaagtgtgagattacctttctgttccttgcagttcacctcactttccgtcctttgtagagcagtggtgtctccaatgaacttgtttcctggttttgcatcttgtgaaatgtttttttgtatttttgttgaaggttaaacatttgtataaattgtaaatatatttggtttattacagtaaaggctttagtaccaataa

SEQ ID NO: 313562 - DNA, 4347 bp, Homo sapiens
cccaacctcccgggctcacgtcccccgccggctccgcgctcgcgccccccgcccgaacggggctgggcggggccggcgctggttagctccggagtgtgaaaccgcgtgttaatgtaagcggcgcgagaggcgcgggcggcggcggcggtgggagcggcggctgcagaagcagcagcagcagaaacagcggcgggtactctgtgccccgcgtcccggaggcagccgactgcgccaccccaccctcgcacggccgggcgggacccgcgccaccagcccggacctccgtcgtcccgcggcgaccaaaacccccgctggccccaccgctgtgactactctggactcgcccgcagagtttgcccgccggggagggtggccgattggcggagcgcactcctgctgttttccccaccatctcgtggatgtcgtccctcgggtggtgagagaactttgcagtgggctggagcgccctttgcggagaagcacacgaaggtgaaggaaggaaagaaagaagaccgaggaagaaggagctcggaagaagggtccggagcggccggtccggccgtgcagggcgagtgcgcccgaggcgcggcgccctgatgctccccgggctcgaggagcattgggcacttgcgggactgctctcggtggagtagccccgtcgggcccggagggtttgtgcaaccgcggagaacaccgagtgctggtcgcacggggcgtgccgagccgcctcccggcgcgccctccgcactttccccgcctcgtcatccgtcgctccccggccaggagcctccgctgcgtcttcaacctcgctcccctttgcgtcccgggagcctgcgagcacccggccgaaggcgcagccgaatcttgcgggagtcgccccgaaagcgtcgggtttgtgtggggttagcgggggccgccgcgccacctgcacctcgcccgccgccgcctcggggaaagcccgaagaggaggcggaccaggagaagagcaaagaaaagcagtccgtctggatttgtttgcccaggactggcgccgcgcacgcggatcgccgaggggagtgcggtcggagtcaccgcgcccccgcctccccgcccgggcagctgaggccgggggttggagcgctgcccccgcgcacagtccccgagcgcccgacgtctccgcgcaggttcttgaagcagctgggcctggggcgcccactaatgtggccctgagggccggagcccgcaccgacgggagcgggagccggagcagctgcgggcgccgagtggccggtgcgcccggcggagcgcgcgtgcgtggccagcgcgctccccgcttctgcttggctttccggcttaattttcctcggcgggattaaagttggaaattgaccggagaattgagttgccggggaacagagccccggccgccgccagagcgatgttcccgcagagccggcacccgacgccgcaccaggctgcaggccagcccttcaagttcactatcccggagtccctggaccggattaaagaggaattccagttcctgcaggcgcagtatcacagccttaaattggaatgtgagaaactggcaagtgaaaagacagaaatgcagaggcactatgtgatgtattatgaaatgtcatatggattaaacattgaaatgcacaaacagactgaaatcgccaagagattgaatacgatttgtgcacaagtcatcccatttctgtctcaggaacatcaacaacaggtggcccaggctgttgaacgtgccaaacaggtgaccatggcagagttgaatgccatcatcgggcagcagcagttgcaagctcagcatctttctcatggccacggacccccagttccccttacgcctcacccttcgggacttcagcctcctggaatcccgcccctcgggggcagtgccggccttcttgcgctgtctagtgctctgagtgggcagtctcacttggcaataaaagatgacaagaagcaccacgatgcagagcaccacagagacagagagccgggcacaagtaattccctcctggtcccagacagtctaagaggcacagataaacgcagaaatggacctgaattttccaatgacatcaagaaaaggaaggtggatgataaggactccagccactatgacagtgatggtgacaaaagcgatgacaacttagttgtggatgtgtctaatgaggacccttcttctccgcgagcaagccctgcccactcgccccgggaaaatggaatcgacaaaaatcgcctgctaaagaaggatgcttctagcagtccagcttccacggcctcctcggcaagttccacttctttgaaatccaaagaaatgagcttgcatgaaaaagccagcacgcctgttctgaaatccagcacaccaacgcctcggagcgacatgccaacgccgggcaccagcgccactccaggcctccgtccaggtctcggcaagcctccagccatagaccccctcgttaaccaagcgggattggattttcatttggaattggtaccagggaatggaaagttcggactgaaagagaaatcttggattttatcgagaaaatcttcttttgagattaagtcagcagctggcttgaggacacccctggcagtgcccggcccatatcctgctccttttgggatggtcccccacgctggcatgaacggcgagctgaccagcccaggcgctgcctacgccagtttacacaacatgtcgccccagatgagcgccgcagccgccgcggccgccgtggtggcctacgggcgctcccccatggtggggtttgatcctccccctcacatgagagtacctaccattcctccaaacctggcaggaatccctggggggaaacctgcatactccttccacgttactgcagacggtcagatgcagcctgtcccttttccccccgacgccctcatcggacccggaatcccccggcatgctcgccagatcaacaccctcaaccacggggaggtggtgtgcgctgtgaccatcagcaaccccacgagacacgtgtacacaggcgggaagggctgcgtcaaggtctgggacatcagccaccctggcaataagagccctgtctcccagctcgactgtctgaacagagacaattatatccgttcctgtaaattgctacccgatggctgcactctcatagtgggaggggaagccagtactttgtccatttgggacctggcggctccaaccccgcgcatcaaggcggagctgacgtcctcggcccccgcctgctacgccctggccatcagccccgattccaaggtctgcttctcatgctgcagcgacggcaacatcgctgtgtgggatctgcacaaccagacactagtgaggcaattccagggccacacagacggagccagctgtattgacatttctaatgatggcaccaagctctggacgggtggtttggacaacacagtcaggtcctgggacctgcgcgaggggcggcagctgcagcagcacgacttcacctcccagatcttctccctggggtactgccccaccggggagtggctggcagtgggcatggagagcagcaatgtggaggtgctgcacgtgaacaagcctgacaagtaccagctgcacctgcatgagagctgcgtgctgtccctgaaatttgcttactgtggtaaatggtttgtgagtactggaaaagataacctcctcaatgcttggcggaccccctatggagccagcatattccagtccaaagagtcctcgtcagtgcttagctgtgacatctctgtggatgataagtacatagtcactggctcgggggacaagaaggctacagtctatgaagtcatctactgaaaacattatgtggtttaacgtttatagttgaattgggccaaaatgtttcgaatttatagaaatagaaaagttgtaactttaaaagagaaaaaaaattacaaacacctgtttccaaaccttgacagaaaactactttgagtctacaaagaggaggcgacaagtccatcagcagaaagtcacctgtctacatagaccaaatggagcaccaaggccaagcggacagaggggccatgggttgtaggattgaggaacggaatctgccgactcacatgacagcccattctttctttctgggtgatctggggatcacgccttgcccaagtgtgagattacctttctgttccttgcagttcacctcactttccgtcctttgtagagcagtggtgtctccaatgaacttgtttcctggttttgcatcttgtgaaatgtttttttgtatttttgttgaaggttaaacatttgtataaattgtaaatatatttggtttattacagtaaaggctttagtaccaataa

SEQ ID NO: 313563 - DNA, 2899 bp, Homo sapiens
gtttatgtcccacccgttcttgccttctctgacttactgctttattcatccgcccgcattcccgtccctcggtccccctcgctggtcgcccccagacgccgcaccaggctgcaggccagcccttcaagttcactatcccggagtccctggaccggattaaagaggaattccagttcctgcaggcgcagtatcacagccttaaattggaatgtgagaaactggcaagtgaaaagacagaaatgcagaggcactatgtgatgtattatgaaatgtcatatggattaaacattgaaatgcacaaacagactgaaatcgccaagagattgaatacgatttgtgcacaagtcatcccatttctgtctcaggaacatcaacaacaggtggcccaggctgttgaacgtgccaaacaggtgaccatggcagagttgaatgccatcatcgggcagcagcagttgcaagctcagcatctttctcatggccacggacccccagttccccttacgcctcacccttcgggacttcagcctcctggaatcccgcccctcgggggcagtgccggccttcttgcgctgtctagtgctctgagtgggcagtctcacttggcaataaaagatgacaagaagcaccacgatgcagagcaccacagagacagagagccgggcacaagtaattccctcctggtcccagacagtctaagaggcacagataaacgcagaaatggacctgaattttccaatgacatcaagaaaaggaaggtggatgataaggactccagccactatgacagtgatggtgacaaaagcgatgacaacttagttgtggatgtgtctaatgaggacccttcttctccgcgagcaagccctgcccactcgccccgggaaaatggaatcgacaaaaatcgcctgctaaagaaggatgcttctagcagtccagcttccacggcctcctcggcaagttccacttctttgaaatccaaagaaatgagcttgcatgaaaaagccagcacgcctgttctgaaatccagcacaccaacgcctcggagcgacatgccaacgccgggcaccagcgccactccaggcctccgtccaggtctcggcaagcctccagccatagaccccctcgttaaccaagcggcagctggcttgaggacacccctggcagtgcccggcccatatcctgctccttttgggatggtcccccacgctggcatgaacggcgagctgaccagcccaggcgctgcctacgccagtttacacaacatgtcgccccagatgagcgccgcagccgccgcggccgccgtggtggcctacgggcgctcccccatggtggggtttgatcctccccctcacatgagagtacctaccattcctccaaacctggcaggaatccctggggggaaacctgcatactccttccacgttactgcagacggtcagatgcagcctgtcccttttccccccgacgccctcatcggacccggaatcccccggcatgctcgccagatcaacaccctcaaccacggggaggtggtgtgcgctgtgaccatcagcaaccccacgagacacgtgtacacaggcgggaagggctgcgtcaaggtctgggacatcagccaccctggcaataagagccctgtctcccagctcgactgtctgaacagagacaattatatccgttcctgtaaattgctacccgatggctgcactctcatagtgggaggggaagccagtactttgtccatttgggacctggcggctccaaccccgcgcatcaaggcggagctgacgtcctcggcccccgcctgctacgccctggccatcagccccgattccaaggtctgcttctcatgctgcagcgacggcaacatcgctgtgtgggatctgcacaaccagacactagtgaggcaattccagggccacacagacggagccagctgtattgacatttctaatgatggcaccaagctctggacgggtggtttggacaacacagtcaggtcctgggacctgcgcgaggggcggcagctgcagcagcacgacttcacctcccagatcttctccctggggtactgccccaccggggagtggctggcagtgggcatggagagcagcaatgtggaggtgctgcacgtgaacaagcctgacaagtaccagctgcacctgcatgagagctgcgtgctgtccctgaaatttgcttactgtggtaaatggtttgtgagtactggaaaagataacctcctcaatgcttggcggaccccctatggagccagcatattccagtccaaagagtcctcgtcagtgcttagctgtgacatctctgtggatgataagtacatagtcactggctcgggggacaagaaggctacagtctatgaagtcatctactgaaaacattatgtggtttaacgtttatagttgaattgggccaaaatgtttcgaatttatagaaatagaaaagttgtaactttaaaagagaaaaaaaattacaaacacctgtttccaaaccttgacagaaaactactttgagtctacaaagaggaggcgacaagtccatcagcagaaagtcacctgtctacatagaccaaatggagcaccaaggccaagcggacagaggggccatgggttgtaggattgaggaacggaatctgccgactcacatgacagcccattctttctttctgggtgatctggggatcacgccttgcccaagtgtgagattacctttctgttccttgcagttcacctcactttccgtcctttgtagagcagtggtgtctccaatgaacttgtttcctggttttgcatcttgtgaaatgtttttttgtatttttgttgaaggttaaacatttgtataaattgtaaatatatttggtttattacagtaaaggctttagtaccaataa

SEQ ID NO: 313564 - DNA, 4294 bp, Homo sapiens
cccaacctcccgggctcacgtcccccgccggctccgcgctcgcgccccccgcccgaacggggctgggcggggccggcgctggttagctccggagtgtgaaaccgcgtgttaatgtaagcggcgcgagaggcgcgggcggcggcggcggtgggagcggcggctgcagaagcagcagcagcagaaacagcggcgggtactctgtgccccgcgtcccggaggcagccgactgcgccaccccaccctcgcacggccgggcgggacccgcgccaccagcccggacctccgtcgtcccgcggcgaccaaaacccccgctggccccaccgctgtgactactctggactcgcccgcagagtttgcccgccggggagggtggccgattggcggagcgcactcctgctgttttccccaccatctcgtggatgtcgtccctcgggtggtgagagaactttgcagtgggctggagcgccctttgcggagaagcacacgaaggtgaaggaaggaaagaaagaagaccgaggaagaaggagctcggaagaagggtccggagcggccggtccggccgtgcagggcgagtgcgcccgaggcgcggcgccctgatgctccccgggctcgaggagcattgggcacttgcgggactgctctcggtggagtagccccgtcgggcccggagggtttgtgcaaccgcggagaacaccgagtgctggtcgcacggggcgtgccgagccgcctcccggcgcgccctccgcactttccccgcctcgtcatccgtcgctccccggccaggagcctccgctgcgtcttcaacctcgctcccctttgcgtcccgggagcctgcgagcacccggccgaaggcgcagccgaatcttgcgggagtcgccccgaaagcgtcgggtttgtgtggggttagcgggggccgccgcgccacctgcacctcgcccgccgccgcctcggggaaagcccgaagaggaggcggaccaggagaagagcaaagaaaagcagtccgtctggatttgtttgcccaggactggcgccgcgcacgcggatcgccgaggggagtgcggtcggagtcaccgcgcccccgcctccccgcccgggcagctgaggccgggggttggagcgctgcccccgcgcacagtccccgagcgcccgacgtctccgcgcaggttcttgaagcagctgggcctggggcgcccactaatgtggccctgagggccggagcccgcaccgacgggagcgggagccggagcagctgcgggcgccgagtggccggtgcgcccggcggagcgcgcgtgcgtggccagcgcgctccccgcttctgcttggctttccggcttaattttcctcggcgggattaaagttggaaattgaccggagaattgagttgccggggaacagagccccggccgccgccagagcgatgttcccgcagagccggcacccgacgccgcaccaggctgcaggccagcccttcaagttcactatcccggagtccctggaccggattaaagaggaattccagttcctgcaggcgcagtatcacagccttaaattggaatgtgagaaactggcaagtgaaaagacagaaatgcagaggcactatgtgatgtattatgaaatgtcatatggattaaacattgaaatgcacaaacagactgaaatcgccaagagattgaatacgatttgtgcacaagtcatcccatttctgtctcaggaacatcaacaacaggtggcccaggctgttgaacgtgccaaacaggtgaccatggcagagttgaatgccatcatcgggcagcagcagttgcaagctcagcatctttctcatggccacggacccccagttccccttacgcctcacccttcgggacttcagcctcctggaatcccgcccctcgggggcagtgccggccttcttgcgctgtctagtgctctgagtgggcagtctcacttggcaataaaagatgacaagaagcaccacgatgcagagcaccacagagacagagagccgggcacaagtaattccctcctggtcccagacagtctaagaggcacagataaacgcagaaatggacctgaattttccaatgacatcaagaaaaggaaggtggatgataaggactccagccactatgacagtgatggtgacaaaagcgatgacaacttagttgtggatgtgtctaatgaggacccttcttctccgcgagcaagccctgcccactcgccccgggaaaatggaatcgacaaaaatcgcctgctaaagaaggatgcttctagcagtccagcttccacggcctcctcggcaagttccacttctttgaaatccaaagaaatgagcttgcatgaaaaagccagcacgcctgttctgaaatccagcacaccaacgcctcggagcgacatgccaacgccgggcaccagcgccactccaggcctccgtccaggtctcggcaagcctccagccatagaccccctcgttaaccaagcgggattggattttcatttggaattggtaccagggaatggaaagttcggactgaaagagaaatcttggattttatcgagtgcccggcccatatcctgctccttttgggatggtcccccacgctggcatgaacggcgagctgaccagcccaggcgctgcctacgccagtttacacaacatgtcgccccagatgagcgccgcagccgccgcggccgccgtggtggcctacgggcgctcccccatggtggggtttgatcctccccctcacatgagagtacctaccattcctccaaacctggcaggaatccctggggggaaacctgcatactccttccacgttactgcagacggtcagatgcagcctgtcccttttccccccgacgccctcatcggacccggaatcccccggcatgctcgccagatcaacaccctcaaccacggggaggtggtgtgcgctgtgaccatcagcaaccccacgagacacgtgtacacaggcgggaagggctgcgtcaaggtctgggacatcagccaccctggcaataagagccctgtctcccagctcgactgtctgaacagagacaattatatccgttcctgtaaattgctacccgatggctgcactctcatagtgggaggggaagccagtactttgtccatttgggacctggcggctccaaccccgcgcatcaaggcggagctgacgtcctcggcccccgcctgctacgccctggccatcagccccgattccaaggtctgcttctcatgctgcagcgacggcaacatcgctgtgtgggatctgcacaaccagacactagtgaggcaattccagggccacacagacggagccagctgtattgacatttctaatgatggcaccaagctctggacgggtggtttggacaacacagtcaggtcctgggacctgcgcgaggggcggcagctgcagcagcacgacttcacctcccagatcttctccctggggtactgccccaccggggagtggctggcagtgggcatggagagcagcaatgtggaggtgctgcacgtgaacaagcctgacaagtaccagctgcacctgcatgagagctgcgtgctgtccctgaaatttgcttactgtggtaaatggtttgtgagtactggaaaagataacctcctcaatgcttggcggaccccctatggagccagcatattccagtccaaagagtcctcgtcagtgcttagctgtgacatctctgtggatgataagtacatagtcactggctcgggggacaagaaggctacagtctatgaagtcatctactgaaaacattatgtggtttaacgtttatagttgaattgggccaaaatgtttcgaatttatagaaatagaaaagttgtaactttaaaagagaaaaaaaattacaaacacctgtttccaaaccttgacagaaaactactttgagtctacaaagaggaggcgacaagtccatcagcagaaagtcacctgtctacatagaccaaatggagcaccaaggccaagcggacagaggggccatgggttgtaggattgaggaacggaatctgccgactcacatgacagcccattctttctttctgggtgatctggggatcacgccttgcccaagtgtgagattacctttctgttccttgcagttcacctcactttccgtcctttgtagagcagtggtgtctccaatgaacttgtttcctggttttgcatcttgtgaaatgtttttttgtatttttgttgaaggttaaacatttgtataaattgtaaatatatttggtttattacagtaaaggctttagtaccaataa

SEQ ID NO: 313565 - DNA, 2770 bp, Homo sapiens
aaatgtcatatggattaaacattgaaatgcacaaacagactgaaatcgccaagagattgaatacgatttgtgcacaagtcatcccatttctgtctcaggaacatcaacaacaggtggcccaggctgttgaacgtgccaagcaggtgaccatggcagagttgaatgccatcatcgggactgaaatcgccaagagattgaatacgatttgtgcacaagtcatcccatttctgtctcaggaacatcaacaacaggtggcccaggctgttgaacgtgccaaacaggtgaccatggcagagttgaatgccatcatcgggcagcagcagttgcaagctcagcatctttctcatggccacggacccccagttccccttacgcctcacccttcgggacttcagcctcctggaatcccgcccctcgggggcagtgccggccttcttgcgctgtctagtgctctgagtgggcagtctcacttggcaataaaagatgacaagaagcaccacgatgcagagcaccacagagacagagagccgggcacaagtaattccctcctggtcccagacagtctaagaggcacagataaacgcagaaatggacctgaattttccaatgacatcaagaaaaggaaggtggatgataaggactccagccactatgacagtgatggtgacaaaagcgatgacaacttagttgtggatgtgtctaatgaggacccttcttctccgcgagcaagccctgcccactcgccccgggaaaatggaatcgacaaaaatcgcctgctaaagaaggatgcttctagcagtccagcttccacggcctcctcggcaagttccacttctttgaaatccaaagaaatgagcttgcatgaaaaagccagcacgcctgttctgaaatccagcacaccaacgcctcggagcgacatgccaacgccgggcaccagcgccactccaggcctccgtccaggtctcggcaagcctccagccatagaccccctcgttaaccaagcggcagctggcttgaggacacccctggcagtgcccggcccatatcctgctccttttgggatggtcccccacgctggcatgaacggcgagctgaccagcccaggcgctgcctacgccagtttacacaacatgtcgccccagatgagcgccgcagccgccgcggccgccgtggtggcctacgggcgctcccccatggtggggtttgatcctccccctcacatgagagtacctaccattcctccaaacctggcaggaatccctggggggaaacctgcatactccttccacgttactgcagacggtcagatgcagcctgtcccttttccccccgacgccctcatcggacccggaatcccccggcatgctcgccagatcaacaccctcaaccacggggaggtggtgtgcgctgtgaccatcagcaaccccacgagacacgtgtacacaggcgggaagggctgcgtcaaggtctgggacatcagccaccctggcaataagagccctgtctcccagctcgactgtctgaacagagacaattatatccgttcctgtaaattgctacccgatggctgcactctcatagtgggaggggaagccagtactttgtccatttgggacctggcggctccaaccccgcgcatcaaggcggagctgacgtcctcggcccccgcctgctacgccctggccatcagccccgattccaaggtctgcttctcatgctgcagcgacggcaacatcgctgtgtgggatctgcacaaccagacactagtgaggcaattccagggccacacagacggagccagctgtattgacatttctaatgatggcaccaagctctggacgggtggtttggacaacacagtcaggtcctgggacctgcgcgaggggcggcagctgcagcagcacgacttcacctcccagatcttctccctggggtactgccccaccggggagtggctggcagtgggcatggagagcagcaatgtggaggtgctgcacgtgaacaagcctgacaagtaccagctgcacctgcatgagagctgcgtgctgtccctgaaatttgcttactgtggtaaatggtttgtgagtactggaaaagataacctcctcaatgcttggcggaccccctatggagccagcatattccagtccaaagagtcctcgtcagtgcttagctgtgacatctctgtggatgataagtacatagtcactggctcgggggacaagaaggctacagtctatgaagtcatctactgaaaacattatgtggtttaacgtttatagttgaattgggccaaaatgtttcgaatttatagaaatagaaaagttgtaactttaaaagagaaaaaaaattacaaacacctgtttccaaaccttgacagaaaactactttgagtctacaaagaggaggcgacaagtccatcagcagaaagtcacctgtctacatagaccaaatggagcaccaaggccaagcggacagaggggccatgggttgtaggattgaggaacggaatctgccgactcacatgacagcccattctttctttctgggtgatctggggatcacgccttgcccaagtgtgagattacctttctgttccttgcagttcacctcactttccgtcctttgtagagcagtggtgtctccaatgaacttgtttcctggttttgcatcttgtgaaatgtttttttgtatttttgttgaaggttaaacatttgtataaattgtaaatatatttggtttattacagtaaaggctttagtaccaataa

SEQ ID NO: 313566 - DNA, 2803 bp, Homo sapiens
cccaacctcccgggctcacgtcccccgccggctccgcgctcgcgccccccgcccgaacggggctgggcggggccggcgctggttagctccggagtgtgaaaccgcgtgttaatgtaagcggcgcgagaggcgcgggcggcggcggcggtgggagcggcggctgcagaagcagcagcagcagaaacagcggcgggtactctgtgccccgcgtcccggaggcagccgactgcgccaccccaccctcgcacggccgggcgggacccgcgccaccagcccggacctccgtcgtcccgcggcgaccaaaacccccgctggccccaccgctgtgactactctggactcgcccgcagagtttgcccgccggggagggtggccgattggcggagcgcactcctgctgttttccccaccatctcgtggatgtcgtccctcgggtggtgagagaactttgcagtgggctggagcgccctttgcggagaagcacacgaaggtgaaggaaggaaagaaagaagaccgaggaagaaggagctcggaagaagggtccggagcggccggtccggccgtgcagggcgagtgcgcccgaggcgcggcgccctgatgctccccgggctcgaggagcattgggcacttgcgggactgctctcggtggagtagccccgtcgggcccggagggtttgtgcaaccgcggagaacaccgagtgctggtcgcacggggcgtgccgagccgcctcccggcgcgccctccgcactttccccgcctcgtcatccgtcgctccccggccaggagcctccgctgcgtcttcaacctcgctcccctttgcgtcccgggagcctgcgagcacccggccgaaggcgcagccgaatcttgcgggagtcgccccgaaagcgtcgggtttgtgtggggttagcgggggccgccgcgccacctgcacctcgcccgccgccgcctcggggaaagcccgaagaggaggcggaccaggagaagagcaaagaaaagcagtccgtctggatttgtttgcccaggactggcgccgcgcacgcggatcgccgaggggagtgcggtcggagtcaccgcgcccccgcctccccgcccgggcagctgaggccgggggttggagcgctgcccccgcgcacagtccccgagcgcccgacgtctccgcgcaggttcttgaagcagctgggcctggggcgcccactaatgtggccctgagggccggagcccgcaccgacgggagcgggagccggagcagctgcgggcgccgagtggccggtgcgcccggcggagcgcgcgtgcgtggccagcgcgctccccgcttctgcttggctttccggcttaattttcctcggcgggattaaagttggaaattgaccggagaattgagttgccggggaacagagccccggccgccgccagagcgatgttcccgcagagccggcacccgacgccgcaccaggctgcaggccagcccttcaagttcactatcccggagtccctggaccggattaaagaggaattccagttcctgcaggcgcagtatcacagccttaaattggaatgtgagaaactggcaagtgaaaagacagaaatgcagaggcactatgtgatgtattatgaaatgtcatatggattaaacattgaaatgcacaaacagactgaaatcgccaagagattgaatacgatttgtgcacaagtcatcccatttctgtctcaggaacatcaacaacaggtggcccaggctgttgaacgtgccaaacaggtgaccatggcagagttgaatgccatcatcgggcagcagcagttgcaagctcagcatctttctcatggccacggacccccagttccccttacgcctcacccttcgggacttcagcctcctggaatcccgcccctcgggggcagtgccggccttcttgcgctgtctagtgctctgagtgggcagtctcacttggcaataaaagatgacaagaagcaccacgatgcagagcaccacagagacagagagccgggcacaagtaattccctcctggtcccagacagtctaagaggcacagataaacgcagaaatggacctgaattttccaatgacatcaagaaaaggaaggtggatgataaggactccagccactatgacagtgatggtgacaaaagcgatgacaacttagttgtggatgtgtctaatgaggacccttcttctccgcgagcaagccctgcccactcgccccgggaaaatggaatcgacaaaaatcgcctgctaaagaaggatgcttctagcagtccagcttccacggcctcctcggcaagttccacttctttgaaatccaaagaaatgagcttgcatgaaaaagccagcacgcctgttctgaaatccagcacaccaacgcctcggagcgacatgccaacgccgggcaccagcgccactccaggcctccgtccaggtctcggcaagcctccagccatagaccccctcgttaaccaagcggcagctggcttgaggacacccctggcagtgcccggcccatatcctgctccttttgggatggtcccccacgctggcatgaacggcgagctgaccagcccaggcgctgcctacgccagtttacacaacatgtcgccccagatgagcgccgcagccgccgcggccgccgtggtggcctacgggcgctcccccatggtggggtttgatcctccccctcacatgagagtacctaccattcctccaaacctggcaggaatccctggggggaaacctgcgtactccctccacgttactgcagacggtcgggggtaccatatggaacccccg

SEQ ID NO: 313567 - DNA, 2633 bp, Homo sapiens
cccaacctcccgggctcacgtcccccgccggctccgcgctcgcgccccccgcccgaacggggctgggcggggccggcgctggttagctccggagtgtgaaaccgcgtgttaatgtaagcggcgcgagaggcgcgggcggcggcggcggtgggagcggcggctgcagaagcagcagcagcagaaacagcggcgggtactctgtgccccgcgtcccggaggcagccgactgcgccaccccaccctcgcacggccgggcgggacccgcgccaccagcccggacctccgtcgtcccgcggcgaccaaaacccccgctggccccaccgctgtgactactctggactcgcccgcagagtttgcccgccggggagggtggccgattggcggagcgcactcctgctgttttccccaccatctcgtggatgtcgtccctcgggtggtgagagaactttgcagtgggctggagcgccctttgcggagaagcacacgaaggtgaaggaaggaaagaaagaagaccgaggaagaaggagctcggaagaagggtccggagcggccggtccggccgtgcagggcgagtgcgcccgaggcgcggcgccctgatgctccccgggctcgaggagcattgggcacttgcgggactgctctcggtggagtagccccgtcgggcccggagggtttgtgcaaccgcggagaacaccgagtgctggtcgcacggggcgtgccgagccgcctcccggcgcgccctccgcactttccccgcctcgtcatccgtcgctccccggccaggagcctccgctgcgtcttcaacctcgctcccctttgcgtcccgggagcctgcgagcacccggccgaaggcgcagccgaatcttgcgggagtcgccccgaaagcgtcgggtttgtgtggggttagcgggggccgccgcgccacctgcacctcgcccgccgccgcctcggggaaagcccgaagaggaggcggaccaggagaagagcaaagaaaagcagtccgtctggatttgtttgcccaggactggcgccgcgcacgcggatcgccgaggggagtgcggtcggagtcaccgcgcccccgcctccccgcccgggcagctgaggccgggggttggagcgctgcccccgcgcacagtccccgagcgcccgacgtctccgcgcaggttcttgaagcagctgggcctggggcgcccactaatgtggccctgagggccggagcccgcaccgacgggagcgggagccggagcagctgcgggcgccgagtggccggtgcgcccggcggagcgcgcgtgcgtggccagcgcgctccccgcttctgcttggctttccggcttaattttcctcggcgggattaaagttggaaattgaccggagaattgagttgccggggaacagagccccggccgccgccagagcgatgttcccgcagagccggcacccgacgccgcaccaggctgcaggccagcccttcaagttcactatcccggagtccctggaccggattaaagaggaattccagttcctgcaggcgcagtatcacagccttaaattggaatgtgagaaactggcaagtgaaaagacagaaatgcagaggcactatgtgatgtattatgaaatgtcatatggattaaacattgaaatgcacaaacagactgaaatcgccaagagattgaatacgatttgtgcacaagtcatcccatttctgtctcaggaacatcaacaacaggtggcccaggctgttgaacgtgccaaacaggtgaccatggcagagttgaatgccatcatcgggcagcagcagttgcaagctcagcatctttctcatggccacggacccccagttccccttacgcctcacccttcgggacttcagcctcctggaatcccgcccctcgggggcagtgccggccttcttgcgctgtctagtgctctgagtgggcagtctcacttggcaataaaagatgacaagaagcaccacgatgcagagcaccacagagacagagagccgggcacaagccagattaggactttgtcctcatactcttacagtgctgcaaagttgtgtgcatcgctaaagagagccccaacctatacagagagcaaacaatgagataagaggaactgtcgcaaagctttccactgaaacacaggtcaccctggaagtttgcagggtttgctgtgggcatctgtagatttctcgatctcgttagattgcaggcatcttgacatcttggcaactgcctagttaatgccagtggcctgtaccatattatggaaaactgttaactgcttaattgggtaattttcaaagaaagtaatgttgttaaatggggcgaaataagaagttaaatttgaaagtgaatgtgttcaaatgaaaggtttgataattgcatctgttactacttagtttcataggctttaattctagtatgcattaaatattgggcaaaattgcacttgactaattttttgaagaaaagtaatttattctgtcaagaaataaaaaaataggctttgtgtatggttaaactgtaaatcttatgtttacaaaatactgtaattttcaggaaatcactgtattaggaatgtgcaatgacttatataaataaaagccatttttaaaactgaaaaaaact

SEQ ID NO: 313568 - DNA, 889 bp, Homo sapiens
gagagagagtagagagagagagagagtagagagagagagagagagagagagagagagagagagagagagagagagagagagagagagagagagagagagagagagagagagagagagagagagacatctttctcatggccacggacccccagttccccttacgcctcacccttcgggacttcagcctcctggaatcccgcccctcgggggcagtgccggccttcttgcgctgtctagtgctctgagtgggcagtctcacttggcaatagccagattaggactttgtcctcatactcttacagtgctgcaaagttgtgtgcatcgctaaagagagccccaacctatacagagagcaaacaatgagataagaggaactgtcgcaaagctttccactgaaacacaggtcaccctggaagtttgcagggtttgctgtgggcatctgtagatttctcgatctcgttagattgcaggcatcttgacatcttggcaactgcctagttaatgccagtggcctgtaccatattatggaaaactgttaactgcttaattgggtaattttcaaagaaagtaatgttgttaaatggggcgaaataagaagttaaatttgaaagtgaatgtgttcaaatgaaaggtttgataattgcatctgttactacttagtttcataggctttaattctagtatgcattaaatattgggcaaaattgcacttgactaattttttgaagaaaagtaatttattctgtcaagaaataaaaaaataggctttgtgtatggttaaactgtaaatcttatgtttacaaaatactgtaattttcaggaaatcactgtattaggaatgtgcaatgacttatataaataaaagccatttttaaaactgaaaaaaact

SEQ ID NO: 313569 - DNA, 392 bp, Homo sapiens
atagttcatatattaaaaatgttcttagtttgattaagtccaagttgctaattgtatagtaggaattttaaccttgtgaaaactagatattcctttgctaattctaggtaaatggtttgtgagtactggaaaagataacctcctcaatgcttggcggaccccctatggagccagcatattccaggtgagtaagtactcctcacctagatccacagtttgaccacagtgtcgcctctgaagccaggagtgaaggtgcctccgagggagcagggcctctgagtaccgttgttccacattaaacacatgtccattgttttctcttccagtccaaagagtcctcgtcagtgcttagctgtgacatctctgtggatgataagtacatagtcactggc

SEQ ID NO: 313570 - DNA, 532 bp, Homo sapiens
gggaggcttcaggaatcagtggtctctcctgcagtagaaattaggagggtttctctgcgactccagcccttaaaaaactcataatttgcaacctgatattccccagtgggaaaggaaaaaagcaacaacctgggcccaaaggaaaataggcaacagaatattcctcctaaacccgtgctttggtttacgtaaatccaggattggattttcatttggaattggtaccagggaatggaaagttcggactgaaagagaaatcttggattttatcgagaaaatcttcttttgagattaagtcaggtaaacacttggtgcctgtgccttggtttgccctctgtaaattgggtagggaatactcttaattcccctggcttcctggtgctgccatttacacaaatgagaaaatgtgtgggttgtgcttcccctggagtcttttctttcctggagatgcattcgctctggggaaggagggatccagtgtataaattggaggtgattttccccctcccctagaagccttacctctttctct

SEQ ID NO: 313571 - DNA, 642 bp, Homo sapiens
gttctttggcctttgcattgaggggcttaagtgtaacagcagccacatgacaacttgagaaagcagctctggtaaattcttagcaagaatccttctgactaatgaggtaatgtgctcagcataacgaagaccgaaacatagaggatgggcctgcagtttccaagtggtaaataatgcagggtgatgaggtagatttataaactagcttggaaaagtggtttcttctcagggaactatgtgtacacctgtacctcatacctagatagtttcagctctgtgatgcaggacaccagaagcagttacctaagctcctgtgaatttgttttgtttactattttgaaggagacagttgtacttggaccccaatcttgactagagaactcttgctctgttagagtgtccatgaaacaccactcttaactcaaaaaaccaagacagccattagagaacatggtgctatgattgctcggtaattcattatagcaatgaattatgtttattctacagaacagagacaattatatccgttcctgtaaattgctacccgatggctgcactctcatagtgggaggggaagccagtactttgtccatttgggacctggcggctccaaccccgcgcatcaaggcggagctgacgtcc

SEQ ID NO: 313572 - DNA, 293 bp, Homo sapiens
ggagcaccaaggccaagcggacagaggggccatgggttgtaggattgaggaacggaatctgccgactcacatgacagcccattctttctttctgggtgatctggggatcacgccttgcccaagtgtgagattacctttctgttccttgcagttcacctcactttccgtcctttgtagagcagtggtgtctccaatgaacttgtttcctggttttgcatcttgtgaaatgtttttttgtatttttgttgaaggttaaacatttgtataaattgtaaatatatttggtttattac

SEQ ID NO: 313573 - DNA, 4191 bp, Homo sapiens
cccaacctcccgggctcacgtcccccgccggctccgcgctcgcgccccccgcccgaacggggctgggcggggccggcgctggttagctccggagtgtgaaaccgcgtgttaatgtaagcggcgcgagaggcgcgggcggcggcggcggtgggagcggcggctgcagaagcagcagcagcagaaacagcggcgggtactctgtgccccgcgtcccggaggcagccgactgcgccaccccaccctcgcacggccgggcgggacccgcgccaccagcccggacctccgtcgtcccgcggcgaccaaaacccccgctggccccaccgctgtgactactctggactcgcccgcagagtttgcccgccggggagggtggccgattggcggagcgcactcctgctgttttccccaccatctcgtggatgtcgtccctcgggtggtgagagaactttgcagtgggctggagcgccctttgcggagaagcacacgaaggtgaaggaaggaaagaaagaagaccgaggaagaaggagctcggaagaagggtccggagcggccggtccggccgtgcagggcgagtgcgcccgaggcgcggcgccctgatgctccccgggctcgaggagcattgggcacttgcgggactgctctcggtggagtagccccgtcgggcccggagggtttgtgcaaccgcggagaacaccgagtgctggtcgcacggggcgtgccgagccgcctcccggcgcgccctccgcactttccccgcctcgtcatccgtcgctccccggccaggagcctccgctgcgtcttcaacctcgctcccctttgcgtcccgggagcctgcgagcacccggccgaaggcgcagccgaatcttgcgggagtcgccccgaaagcgtcgggtttgtgtggggttagcgggggccgccgcgccacctgcacctcgcccgccgccgcctcggggaaagcccgaagaggaggcggaccaggagaagagcaaagaaaagcagtccgtctggatttgtttgcccaggactggcgccgcgcacgcggatcgccgaggggagtgcggtcggagtcaccgcgcccccgcctccccgcccgggcagctgaggccgggggttggagcgctgcccccgcgcacagtccccgagcgcccgacgtctccgcgcaggttcttgaagcagctgggcctggggcgcccactaatgtggccctgagggccggagcccgcaccgacgggagcgggagccggagcagctgcgggcgccgagtggccggtgcgcccggcggagcgcgcgtgcgtggccagcgcgctccccgcttctgcttggctttccggcttaattttcctcggcgggattaaagttggaaattgaccggagaattgagttgccggggaacagagccccggccgccgccagagcgatgttcccgcagagccggcacccgacgccgcaccaggctgcaggccagcccttcaagttcactatcccggagtccctggaccggattaaagaggaattccagttcctgcaggcgcagtatcacagccttaaattggaatgtgagaaactggcaagtgaaaagacagaaatgcagaggcactatgtgatgtattatgaaatgtcatatggattaaacattgaaatgcacaaacagactgaaatcgccaagagattgaatacgatttgtgcacaagtcatcccatttctgtctcaggaacatcaacaacaggtggcccaggctgttgaacgtgccaaacaggtgaccatggcagagttgaatgccatcatcgggcagcagcagttgcaagctcagcatctttctcatggccacggacccccagttccccttacgcctcacccttcgggacttcagcctcctggaatcccgcccctcgggggcagtgccggccttcttgcgctgtctagtgctctgagtgggcagtctcacttggcaataaaagatgacaagaagcaccacgatgcagagcaccacagagacagagagccgggcacaagtaattccctcctggtcccagacagtctaagaggcacagataaacgcagaaatggacctgaattttccaatgacatcaagaaaaggaaggtggatgataaggactccagccactatgacagtgatggtgacaaaagcgatgacaacttagttgtggatgtgtctaatgaggacccttcttctccgcgagcaagccctgcccactcgccccgggaaaatggaatcgacaaaaatcgcctgctaaagaaggatgcttctagcagtccagcttccacggcctcctcggcaagttccacttctttgaaatccaaagaaatgagcttgcatgaaaaagccagcacgcctgttctgaaatccagcacaccaacgcctcggagcgacatgccaacgccgggcaccagcgccactccaggcctccgtccaggtctcggcaagcctccagccatagaccccctcgttaaccaagcggcagctggcttgaggacacccctggcagtgcccggcccatatcctgctccttttgggatggtcccccacgctggcatgaacggcgagctgaccagcccaggcgctgcctacgccagtttacacaacatgtcgccccagatgagcgccgcagccgccgcggccgccgtggtggcctacgggcgctcccccatggtggggtttgatcctccccctcacatgagagtacctaccattcctccaaacctggcaggaatccctggggggaaacctgcatactccttccacgttactgcagacggtcagatgcagcctgtcccttttccccccgacgccctcatcggacccggaatcccccggcatgctcgccagatcaacaccctcaaccacggggaggtggtgtgcgctgtgaccatcagcaaccccacgagacacgtgtacacaggcgggaagggctgcgtcaaggtctgggacatcagccaccctggcaataagagccctgtctcccagctcgactgtctgaacagagacaattatatccgttcctgtaaattgctacccgatggctgcactctcatagtgggaggggaagccagtactttgtccatttgggacctggcggctccaaccccgcgcatcaaggcggagctgacgtcctcggcccccgcctgctacgccctggccatcagccccgattccaaggtctgcttctcatgctgcagcgacggcaacatcgctgtgtgggatctgcacaaccagacactagtgaggcaattccagggccacacagacggagccagctgtattgacatttctaatgatggcaccaagctctggacgggtggtttggacaacacagtcaggtcctgggacctgcgcgaggggcggcagctgcagcagcacgacttcacctcccagatcttctccctggggtactgccccaccggggagtggctggcagtgggcatggagagcagcaatgtggaggtgctgcacgtgaacaagcctgacaagtaccagctgcacctgcatgagagctgcgtgctgtccctgaaatttgcttactgtggtaaatggtttgtgagtactggaaaagataacctcctcaatgcttggcggaccccctatggagccagcatattccagtccaaagagtcctcgtcagtgcttagctgtgacatctctgtggatgataagtacatagtcactggctcgggggacaagaaggctacagtctatgaagtcatctactgaaaacattatgtggtttaacgtttatagttgaattgggccaaaatgtttcgaatttatagaaatagaaaagttgtaactttaaaagagaaaaaaaattacaaacacctgtttccaaaccttgacagactgtctacatagaccaaatggagcaccaaggccaagcggacagaggggccatgggttgtaggattgaggaacggaatctgccgactcacatgacagcccattctttctttctgggtgatctggggatcacgccttgcccaagtgtgagattacctttctgttccttgcagttcacctcactttccgtcctttgtagagcagtggtgtctccaatgaacttgtttcctggttttgcatcttgtgaaatgtttttttgtatttttgttgaaggttaaacatttgtataaattgtaaatatatttggtttattacagtaaaggctttagtaccaataa

SEQ ID NO: 313574 - DNA, 4023 bp, Homo sapiens
cccaacctcccgggctcacgtcccccgccggctccgcgctcgcgccccccgcccgaacggggctgggcggggccggcgctggttagctccggagtgtgaaaccgcgtgttaatgtaagcggcgcgagaggcgcgggcggcggcggcggtgggagcggcggctgcagaagcagcagcagcagaaacagcggcgggtactctgtgccccgcgtcccggaggcagccgactgcgccaccccaccctcgcacggccgggcgggacccgcgccaccagcccggacctccgtcgtcccgcggcgaccaaaacccccgctggccccaccgctgtgactactctggactcgcccgcagagtttgcccgccggggagggtggccgattggcggagcgcactcctgctgttttccccaccatctcgtggatgtcgtccctcgggtggtgagagaactttgcagtgggctggagcgccctttgcggagaagcacacgaaggtgaaggaaggaaagaaagaagaccgaggaagaaggagctcggaagaagggtccggagcggccggtccggccgtgcagggcgagtgcgcccgaggcgcggcgccctgatgctccccgggctcgaggagcattgggcacttgcgggactgctctcggtggagtagccccgtcgggcccggagggtttgtgcaaccgcggagaacaccgagtgctggtcgcacggggcgtgccgagccgcctcccggcgcgccctccgcactttccccgcctcgtcatccgtcgctccccggccaggagcctccgctgcgtcttcaacctcgctcccctttgcgtcccgggagcctgcgagcacccggccgaaggcgcagccgaatcttgcgggagtcgccccgaaagcgtcgggtttgtgtggggttagcgggggccgccgcgccacctgcacctcgcccgccgccgcctcggggaaagcccgaagaggaggcggaccaggagaagagcaaagaaaagcagtccgtctggatttgtttgcccaggactggcgccgcgcacgcggatcgccgaggggagtgcggtcggagtcaccgcgcccccgcctccccgcccgggcagctgaggccgggggttggagcgctgcccccgcgcacagtccccgagcgcccgacgtctccgcgcaggttcttgaagcagctgggcctggggcgcccactaatgtggccctgagggccggagcccgcaccgacgggagcgggagccggagcagctgcgggcgccgagtggccggtgcgcccggcggagcgcgcgtgcgtggccagcgcgctccccgcttctgcttggctttccggcttaattttcctcggcgggattaaagttggaaattgaccggagaattgagttgccggggaacagagccccggccgccgccagagcgatgttcccgcagagccggcacccgacgccgcaccaggctgcaggccagcccttcaagttcactatcccggagtccctggaccggattaaagaggaattccagttcctgcaggcgcagtatcacagccttaaattggaatgtgagaaactggcaagtgaaaagacagaaatgcagaggcactatgtgatgtattatgaaatgtcatatggattaaacattgaaatgcacaaacagactgaaatcgccaagagattgaatacgatttgtgcacaagtcatcccatttctgtctcaggaacatcaacaacaggtggcccaggctgttgaacgtgccaaacaggtgaccatggcagagttgaatgccatcatcgggagtaattccctcctggtcccagacagtctaagaggcacagataaacgcagaaatggacctgaattttccaatgacatcaagaaaaggaaggtggatgataaggactccagccactatgacagtgatggtgacaaaagcgatgacaacttagttgtggatgtgtctaatgaggacccttcttctccgcgagcaagccctgcccactcgccccgggaaaatggaatcgacaaaaatcgcctgctaaagaaggatgcttctagcagtccagcttccacggcctcctcggcaagttccacttctttgaaatccaaagaaatgagcttgcatgaaaaagccagcacgcctgttctgaaatccagcacaccaacgcctcggagcgacatgccaacgccgggcaccagcgccactccaggcctccgtccaggtctcggcaagcctccagccatagaccccctcgttaaccaagcggcagctggcttgaggacacccctggcagtgcccggcccatatcctgctccttttgggatggtcccccacgctggcatgaacggcgagctgaccagcccaggcgctgcctacgccagtttacacaacatgtcgccccagatgagcgccgcagccgccgcggccgccgtggtggcctacgggcgctcccccatggtggggtttgatcctccccctcacatgagagtacctaccattcctccaaacctggcaggaatccctggggggaaacctgcatactccttccacgttactgcagacggtcagatgcagcctgtcccttttccccccgacgccctcatcggacccggaatcccccggcatgctcgccagatcaacaccctcaaccacggggaggtggtgtgcgctgtgaccatcagcaaccccacgagacacgtgtacacaggcgggaagggctgcgtcaaggtctgggacatcagccaccctggcaataagagccctgtctcccagctcgactgtctgaacagagacaattatatccgttcctgtaaattgctacccgatggctgcactctcatagtgggaggggaagccagtactttgtccatttgggacctggcggctccaaccccgcgcatcaaggcggagctgacgtcctcggcccccgcctgctacgccctggccatcagccccgattccaaggtctgcttctcatgctgcagcgacggcaacatcgctgtgtgggatctgcacaaccagacactagtgaggcaattccagggccacacagacggagccagctgtattgacatttctaatgatggcaccaagctctggacgggtggtttggacaacacagtcaggtcctgggacctgcgcgaggggcggcagctgcagcagcacgacttcacctcccagatcttctccctggggtactgccccaccggggagtggctggcagtgggcatggagagcagcaatgtggaggtgctgcacgtgaacaagcctgacaagtaccagctgcacctgcatgagagctgcgtgctgtccctgaaatttgcttactgtggtaaatggtttgtgagtactggaaaagataacctcctcaatgcttggcggaccccctatggagccagcatattccagtccaaagagtcctcgtcagtgcttagctgtgacatctctgtggatgataagtacatagtcactggctcgggggacaagaaggctacagtctatgaagtcatctactgaaaacattatgtggtttaacgtttatagttgaattgggccaaaatgtttcgaatttatagaaatagaaaagttgtaactttaaaagagaaaaaaaattacaaacacctgtttccaaaccttgacagaaaactactttgagtctacaaagaggaggcgacaagtccatcagcagaaagtcacctgtctacatagaccaaatggagcaccaaggccaagcggacagaggggccatgggttgtaggattgaggaacggaatctgccgactcacatgacagcccattctttctttctgggtgatctggggatcacgccttgcccaagtgtgagattacctttctgttccttgcagttcacctcactttccgtcctttgtagagcagtggtgtctccaatgaacttgtttcctggttttgcatcttgtgaaatgtttttttgtatttttgttgaaggttaaacatttgtataaattgtaaatatatttggtttattacagtaaaggctttagtaccaataa

SEQ ID NO: 313575 - DNA, 4679 bp, Homo sapiens
cccaacctcccgggctcacgtcccccgccggctccgcgctcgcgccccccgcccgaacggggctgggcggggccggcgctggttagctccggagtgtgaaaccgcgtgttaatgtaagcggcgcgagaggcgcgggcggcggcggcggtgggagcggcggctgcagaagcagcagcagcagaaacagcggcgggtactctgtgccccgcgtcccggaggcagccgactgcgccaccccaccctcgcacggccgggcgggacccgcgccaccagcccggacctccgtcgtcccgcggcgaccaaaacccccgctggccccaccgctgtgactactctggactcgcccgcagagtttgcccgccggggagggtggccgattggcggagcgcactcctgctgttttccccaccatctcgtggatgtcgtccctcgggtggtgagagaactttgcagtgggctggagcgccctttgcggagaagcacacgaaggtgaaggaaggaaagaaagaagaccgaggaagaaggagctcggaagaagggtccggagcggccggtccggccgtgcagggcgagtgcgcccgaggcgcggcgccctgatgctccccgggctcgaggagcattgggcacttgcgggactgctctcggtggagtagccccgtcgggcccggagggtttgtgcaaccgcggagaacaccgagtgctggtcgcacggggcgtgccgagccgcctcccggcgcgccctccgcactttccccgcctcgtcatccgtcgctccccggccaggagcctccgctgcgtcttcaacctcgctcccctttgcgtcccgggagcctgcgagcacccggccgaaggcgcagccgaatcttgcgggagtcgccccgaaagcgtcgggtttgtgtggggttagcgggggccgccgcgccacctgcacctcgcccgccgccgcctcggggaaagcccgaagaggaggcggaccaggagaagagcaaagaaaagcagtccgtctggatttgtttgcccaggactggcgccgcgcacgcggatcgccgaggggagtgcggtcggagtcaccgcgcccccgcctccccgcccgggcagctgaggccgggggttggagcgctgcccccgcgcacagtccccgagcgcccgacgtctccgcgcaggttcttgaagcagctgggcctggggcgcccactaatgtggccctgagggccggagcccgcaccgacgggagcgggagccggagcagctgcgggcgccgagtggccggtgcgcccggcggagcgcgcgtgcgtggccagcgcgctccccgcttctgcttggctttccggcttaattttcctcggcgggattaaagttggaaattgaccggagaattgagttgccggggaacagagccccggccgccgccagagcgatgttcccgcagagccggcacccgacgccgcaccaggctgcaggccagcccttcaagttcactatcccggagtccctggaccggattaaagaggaattccagttcctgcaggcgcagtatcacagccttaaattggaatgtgagaaactggcaagtgaaaagacagaaatgcagaggcactatgtgatgtattatgaaatgtcatatggattaaacattgaaatgcacaaacagactgaaatcgccaagagattgaatacgatttgtgcacaagtcatcccatttctgtctcaggaacatcaacaacaggtggcccaggctgttgaacgtgccaaacaggtgaccatggcagagttgaatgccatcatcgggcagcagcagttgcaagctcagcatctttctcatggccacggacccccagttccccttacgcctcacccttcgggacttcagcctcctggaatcccgcccctcgggggcagtgccggccttcttgcgctgtctagtgctctgagtgggcagtctcacttggcaataaaagatgacaagaagcaccacgatgcagagcaccacagagacagagagccgggcacaagtaattccctcctggtcccagacagtctaagaggcacagataaacgcagaaatggacctgaattttccaatgacatcaagaaaaggaaggtggatgataaggactccagccactatgacagtgatggtgacaaaagcgatgacaacttagttgtggatgtgtctaatgaggacccttcttctccgcgagcaagccctgcccactcgccccgggaaaatggaatcgacaaaaatcgcctgctaaagaaggatgcttctagcagtccagcttccacggcctcctcggcaagttccacttctttgaaatccaaagaaatgagcttgcatgaaaaagccagcacgcctgttctgaaatccagcacaccaacgcctcggagcgacatgccaacgccgggcaccagcgccactccaggcctccgtccaggtctcggcaagcctccagccatagaccccctcgttaaccaagcgggattggattttcatttggaattggtaccagggaatggaaagttcggactgaaagagaaatcttggattttatcgagaaaatcttcttttgagattaagtcaggtaaacacttggtgcctgtgccttggtttgccctctgtaaattgggtagggaatactcttaattcccctggcttcctggtgctgccatttacacaaatgagaaaatgtgtgggttgtgcttcccctggagtcttttctttcctggagatgcattcgctctggggaaggagggatccagtgtataaattggaggtgattttccccctcccctagaagccttacctctttctctctccccatgagtgacactaacaaatgatgaggccagacttgctggtcaggtttgatggagtgggtcagttgaatgatgtgcggcttgtgtttcctttcagcagctggcttgaggacacccctggcagtgcccggcccatatcctgctccttttgggatggtcccccacgctggcatgaacggcgagctgaccagcccaggcgctgcctacgccagtttacacaacatgtcgccccagatgagcgccgcagccgccgcggccgccgtggtggcctacgggcgctcccccatggtggggtttgatcctccccctcacatgagagtacctaccattcctccaaacctggcaggaatccctggggggaaacctgcatactccttccacgttactgcagacggtcagatgcagcctgtcccttttccccccgacgccctcatcggacccggaatcccccggcatgctcgccagatcaacaccctcaaccacggggaggtggtgtgcgctgtgaccatcagcaaccccacgagacacgtgtacacaggcgggaagggctgcgtcaaggtctgggacatcagccaccctggcaataagagccctgtctcccagctcgactgtctgaacagagacaattatatccgttcctgtaaattgctacccgatggctgcactctcatagtgggaggggaagccagtactttgtccatttgggacctggcggctccaaccccgcgcatcaaggcggagctgacgtcctcggcccccgcctgctacgccctggccatcagccccgattccaaggtctgcttctcatgctgcagcgacggcaacatcgctgtgtgggatctgcacaaccagacactagtgaggcaattccagggccacacagacggagccagctgtattgacatttctaatgatggcaccaagctctggacgggtggtttggacaacacagtcaggtcctgggacctgcgcgaggggcggcagctgcagcagcacgacttcacctcccagatcttctccctggggtactgccccaccggggagtggctggcagtgggcatggagagcagcaatgtggaggtgctgcacgtgaacaagcctgacaagtaccagctgcacctgcatgagagctgcgtgctgtccctgaaatttgcttactgtggtaaatggtttgtgagtactggaaaagataacctcctcaatgcttggcggaccccctatggagccagcatattccagtccaaagagtcctcgtcagtgcttagctgtgacatctctgtggatgataagtacatagtcactggctcgggggacaagaaggctacagtctatgaagtcatctactgaaaacattatgtggtttaacgtttatagttgaattgggccaaaatgtttcgaatttatagaaatagaaaagttgtaactttaaaagagaaaaaaaattacaaacacctgtttccaaaccttgacagaaaactactttgagtctacaaagaggaggcgacaagtccatcagcagaaagtcacctgtctacatagaccaaatggagcaccaaggccaagcggacagaggggccatgggttgtaggattgaggaacggaatctgccgactcacatgacagcccattctttctttctgggtgatctggggatcacgccttgcccaagtgtgagattacctttctgttccttgcagttcacctcactttccgtcctttgtagagcagtggtgtctccaatgaacttgtttcctggttttgcatcttgtgaaatgtttttttgtatttttgttgaaggttaaacatttgtataaattgtaaatatatttggtttattacagtaaaggctttagtaccaataa

SEQ ID NO: 313576 - DNA, 4200 bp, Homo sapiens
cccaacctcccgggctcacgtcccccgccggctccgcgctcgcgccccccgcccgaacggggctgggcggggccggcgctggttagctccggagtgtgaaaccgcgtgttaatgtaagcggcgcgagaggcgcgggcggcggcggcggtgggagcggcggctgcagaagcagcagcagcagaaacagcggcgggtactctgtgccccgcgtcccggaggcagccgactgcgccaccccaccctcgcacggccgggcgggacccgcgccaccagcccggacctccgtcgtcccgcggcgaccaaaacccccgctggccccaccgctgtgactactctggactcgcccgcagagtttgcccgccggggagggtggccgattggcggagcgcactcctgctgttttccccaccatctcgtggatgtcgtccctcgggtggtgagagaactttgcagtgggctggagcgccctttgcggagaagcacacgaaggtgaaggaaggaaagaaagaagaccgaggaagaaggagctcggaagaagggtccggagcggccggtccggccgtgcagggcgagtgcgcccgaggcgcggcgccctgatgctccccgggctcgaggagcattgggcacttgcgggactgctctcggtggagtagccccgtcgggcccggagggtttgtgcaaccgcggagaacaccgagtgctggtcgcacggggcgtgccgagccgcctcccggcgcgccctccgcactttccccgcctcgtcatccgtcgctccccggccaggagcctccgctgcgtcttcaacctcgctcccctttgcgtcccgggagcctgcgagcacccggccgaaggcgcagccgaatcttgcgggagtcgccccgaaagcgtcgggtttgtgtggggttagcgggggccgccgcgccacctgcacctcgcccgccgccgcctcggggaaagcccgaagaggaggcggaccaggagaagagcaaagaaaagcagtccgtctggatttgtttgcccaggactggcgccgcgcacgcggatcgccgaggggagtgcggtcggagtcaccgcgcccccgcctccccgcccgggcagctgaggccgggggttggagcgctgcccccgcgcacagtccccgagcgcccgacgtctccgcgcaggttcttgaagcagctgggcctggggcgcccactaatgtggccctgagggccggagcccgcaccgacgggagcgggagccggagcagctgcgggcgccgagtggccggtgcgcccggcggagcgcgcgtgcgtggccagcgcgctccccgcttctgcttggctttccggcttaattttcctcggcgggattaaagttggaaattgaccggagaattgagttgccggggaacagagccccggccgccgccagagcgatgttcccgcagagccggcacccgacgccgcaccaggctgcaggccagcccttcaagttcactatcccggagtccctggaccggattaaagaggaattccagttcctgcaggcgcagtatcacagccttaaattggaatgtgagaaactggcaagtgaaaagacagaaatgcagaggcactatgtgatgtattatgaaatgtcatatggattaaacattgaaatgcacaaacagactgaaatcgccaagagattgaatacgatttgtgcacaagtcatcccatttctgtctcaggaacatcaacaacaggtggcccaggctgttgaacgtgccaaacaggtgaccatggcagagttgaatgccatcatcgggcagcagcagttgcaagctcagcatctttctcatggccacggacccccagttccccttacgcctcacccttcgggacttcagcctcctggaatcccgcccctcgggggcagtgccggccttcttgcgctgtctagtgctctgagtgggcagtctcacttggcaataaaagatgacaagaagcaccacgatgcagagcaccacagagacagagagccgggcacaagtaattccctcctggtcccagacagtctaagaggcacagataaacgcagaaatggacctgaattttccaatgacatcaagaaaaggaaggtggatgataaggactccagccactatgacagtgatggtgacaaaagcgatgacaacttagttgtggatgtgtctaatgaggacccttcttctccgcgagcaagccctgcccactcgccccgggaaaatggaatcgacaaaaatcgcctgctaaagaaggatgcttctagcagtccagcttccacggcctcctcggcaagttccacttctttgaaatccaaagaaatgagcttgcatgaaaaagccagcacgcctgttctgaaatccagcacaccaacgcctcggagcgacatgccaacgccgggcaccagcgccactccaggcctccgtccagcagctggcttgaggacacccctggcagtgcccggcccatatcctgctccttttgggatggtcccccacgctggcatgaacggcgagctgaccagcccaggcgctgcctacgccagtttacacaacatgtcgccccagatgagcgccgcagccgccgcggccgccgtggtggcctacgggcgctcccccatggtggggtttgatcctccccctcacatgagagtacctaccattcctccaaacctggcaggaatccctggggggaaacctgcatactccttccacgttactgcagacggtcagatgcagcctgtcccttttccccccgacgccctcatcggacccggaatcccccggcatgctcgccagatcaacaccctcaaccacggggaggtggtgtgcgctgtgaccatcagcaaccccacgagacacgtgtacacaggcgggaagggctgcgtcaaggtctgggacatcagccaccctggcaataagagccctgtctcccagctcgactgtctgaacagagacaattatatccgttcctgtaaattgctacccgatggctgcactctcatagtgggaggggaagccagtactttgtccatttgggacctggcggctccaaccccgcgcatcaaggcggagctgacgtcctcggcccccgcctgctacgccctggccatcagccccgattccaaggtctgcttctcatgctgcagcgacggcaacatcgctgtgtgggatctgcacaaccagacactagtgaggcaattccagggccacacagacggagccagctgtattgacatttctaatgatggcaccaagctctggacgggtggtttggacaacacagtcaggtcctgggacctgcgcgaggggcggcagctgcagcagcacgacttcacctcccagatcttctccctggggtactgccccaccggggagtggctggcagtgggcatggagagcagcaatgtggaggtgctgcacgtgaacaagcctgacaagtaccagctgcacctgcatgagagctgcgtgctgtccctgaaatttgcttactgtggtaaatggtttgtgagtactggaaaagataacctcctcaatgcttggcggaccccctatggagccagcatattccagtccaaagagtcctcgtcagtgcttagctgtgacatctctgtggatgataagtacatagtcactggctcgggggacaagaaggctacagtctatgaagtcatctactgaaaacattatgtggtttaacgtttatagttgaattgggccaaaatgtttcgaatttatagaaatagaaaagttgtaactttaaaagagaaaaaaaattacaaacacctgtttccaaaccttgacagaaaactactttgagtctacaaagaggaggcgacaagtccatcagcagaaagtcacctgtctacatagaccaaatggagcaccaaggccaagcggacagaggggccatgggttgtaggattgaggaacggaatctgccgactcacatgacagcccattctttctttctgggtgatctggggatcacgccttgcccaagtgtgagattacctttctgttccttgcagttcacctcactttccgtcctttgtagagcagtggtgtctccaatgaacttgtttcctggttttgcatcttgtgaaatgtttttttgtatttttgttgaaggttaaacatttgtataaattgtaaatatatttggtttattacagtaaaggctttagtaccaataa

SEQ ID NO: 313577 - DNA, 4060 bp, Homo sapiens
cccaacctcccgggctcacgtcccccgccggctccgcgctcgcgccccccgcccgaacggggctgggcggggccggcgctggttagctccggagtgtgaaaccgcgtgttaatgtaagcggcgcgagaggcgcgggcggcggcggcggtgggagcggcggctgcagaagcagcagcagcagaaacagcggcgggtactctgtgccccgcgtcccggaggcagccgactgcgccaccccaccctcgcacggccgggcgggacccgcgccaccagcccggacctccgtcgtcccgcggcgaccaaaacccccgctggccccaccgctgtgactactctggactcgcccgcagagtttgcccgccggggagggtggccgattggcggagcgcactcctgctgttttccccaccatctcgtggatgtcgtccctcgggtggtgagagaactttgcagtgggctggagcgccctttgcggagaagcacacgaaggtgaaggaaggaaagaaagaagaccgaggaagaaggagctcggaagaagggtccggagcggccggtccggccgtgcagggcgagtgcgcccgaggcgcggcgccctgatgctccccgggctcgaggagcattgggcacttgcgggactgctctcggtggagtagccccgtcgggcccggagggtttgtgcaaccgcggagaacaccgagtgctggtcgcacggggcgtgccgagccgcctcccggcgcgccctccgcactttccccgcctcgtcatccgtcgctccccggccaggagcctccgctgcgtcttcaacctcgctcccctttgcgtcccgggagcctgcgagcacccggccgaaggcgcagccgaatcttgcgggagtcgccccgaaagcgtcgggtttgtgtggggttagcgggggccgccgcgccacctgcacctcgcccgccgccgcctcggggaaagcccgaagaggaggcggaccaggagaagagcaaagaaaagcagtccgtctggatttgtttgcccaggactggcgccgcgcacgcggatcgccgaggggagtgcggtcggagtcaccgcgcccccgcctccccgcccgggcagctgaggccgggggttggagcgctgcccccgcgcacagtccccgagcgcccgacgtctccgcgcaggttcttgaagcagctgggcctggggcgcccactaatgtggccctgagggccggagcccgcaccgacgggagcgggagccggagcagctgcgggcgccgagtggccggtgcgcccggcggagcgcgcgtgcgtggccagcgcgctccccgcttctgcttggctttccggcttaattttcctcggcgggattaaagttggaaattgaccggagaattgagttgccggggaacagagccccggccgccgccagagcgatgttcccgcagagccggcacccgacgccgcaccaggctgcaggccagcccttcaagttcactatcccggagtccctggaccggattaaagaggaattccagttcctgcaggcgcagtatcacagccttaaattggaatgtgagaaactggcaagtgaaaagacagaaatgcagaggcactatgtgatgtattatgaaatgtcatatggattaaacattgaaatgcacaaacagactgaaatcgccaagagattgaatacgatttgtgcacaagtcatcccatttctgtctcaggaacatcaacaacaggtggcccaggctgttgaacgtgccaaacaggtgaccatggcagagttgaatgccatcatcgggcagcagcagttgcaagctcagcatctttctcatggccacggacccccagttccccttacgcctcacccttcgggacttcagcctcctggaatcccgcccctcgggggcagtgccggccttcttgcgctgtctagtgctctgagtgggcagtctcacttggcaataaaagatgacaagaagcaccacgatgcagagcaccacagagacagagagccgggcacaagtaattccctcctggtcccagacagtctaagaggcacagataaacgcagaaatggacctgaattttccaatgacatcaagaaaaggaaggtggatgataaggactccagccactatgacagtgatggtgacaaaagcgatgacaacttagttgtggatgtgtctaatgaggtaaccattcttttcatcaaacgacatgccaacgccgggcaccagcgccactccaggcctccgtccaggtctcggcaagcctccagccatagaccccctcgttaaccaagcggcagctggcttgaggacacccctggcagtgcccggcccatatcctgctccttttgggatggtcccccacgctggcatgaacggcgagctgaccagcccaggcgctgcctacgccagtttacacaacatgtcgccccagatgagcgccgcagccgccgcggccgccgtggtggcctacgggcgctcccccatggtggggtttgatcctccccctcacatgagagtacctaccattcctccaaacctggcaggaatccctggggggaaacctgcatactccttccacgttactgcagacggtcagatgcagcctgtcccttttccccccgacgccctcatcggacccggaatcccccggcatgctcgccagatcaacaccctcaaccacggggaggtggtgtgcgctgtgaccatcagcaaccccacgagacacgtgtacacaggcgggaagggctgcgtcaaggtctgggacatcagccaccctggcaataagagccctgtctcccagctcgactgtctgaacagagacaattatatccgttcctgtaaattgctacccgatggctgcactctcatagtgggaggggaagccagtactttgtccatttgggacctggcggctccaaccccgcgcatcaaggcggagctgacgtcctcggcccccgcctgctacgccctggccatcagccccgattccaaggtctgcttctcatgctgcagcgacggcaacatcgctgtgtgggatctgcacaaccagacactagtgaggcaattccagggccacacagacggagccagctgtattgacatttctaatgatggcaccaagctctggacgggtggtttggacaacacagtcaggtcctgggacctgcgcgaggggcggcagctgcagcagcacgacttcacctcccagatcttctccctggggtactgccccaccggggagtggctggcagtgggcatggagagcagcaatgtggaggtgctgcacgtgaacaagcctgacaagtaccagctgcacctgcatgagagctgcgtgctgtccctgaaatttgcttactgtggtaaatggtttgtgagtactggaaaagataacctcctcaatgcttggcggaccccctatggagccagcatattccagtccaaagagtcctcgtcagtgcttagctgtgacatctctgtggatgataagtacatagtcactggctcgggggacaagaaggctacagtctatgaagtcatctactgaaaacattatgtggtttaacgtttatagttgaattgggccaaaatgtttcgaatttatagaaatagaaaagttgtaactttaaaagagaaaaaaaattacaaacacctgtttccaaaccttgacagaaaactactttgagtctacaaagaggaggcgacaagtccatcagcagaaagtcacctgtctacatagaccaaatggagcaccaaggccaagcggacagaggggccatgggttgtaggattgaggaacggaatctgccgactcacatgacagcccattctttctttctgggtgatctggggatcacgccttgcccaagtgtgagattacctttctgttccttgcagttcacctcactttccgtcctttgtagagcagtggtgtctccaatgaacttgtttcctggttttgcatcttgtgaaatgtttttttgtatttttgttgaaggttaaacatttgtataaattgtaaatatatttggtttattacagtaaaggctttagtaccaataa

SEQ ID NO: 313578 - DNA, 2663 bp, Homo sapiens
cccaacctcccgggctcacgtcccccgccggctccgcgctcgcgccccccgcccgaacggggctgggcggggccggcgctggttagctccggagtgtgaaaccgcgtgttaatgtaagcggcgcgagaggcgcgggcggcggcggcggtgggagcggcggctgcagaagcagcagcagcagaaacagcggcgggtactctgtgccccgcgtcccggaggcagccgactgcgccaccccaccctcgcacggccgggcgggacccgcgccaccagcccggacctccgtcgtcccgcggcgaccaaaacccccgctggccccaccgctgtgactactctggactcgcccgcagagtttgcccgccggggagggtggccgattggcggagcgcactcctgctgttttccccaccatctcgtggatgtcgtccctcgggtggtgagagaactttgcagtgggctggagcgccctttgcggagaagcacacgaaggtgaaggaaggaaagaaagaagaccgaggaagaaggagctcggaagaagggtccggagcggccggtccggccgtgcagggcgagtgcgcccgaggcgcggcgccctgatgctccccgggctcgaggagcattgggcacttgcgggactgctctcggtggagtagccccgtcgggcccggagggtttgtgcaaccgcggagaacaccgagtgctggtcgcacggggcgtgccgagccgcctcccggcgcgccctccgcactttccccgcctcgtcatccgtcgctccccggccaggagcctccgctgcgtcttcaacctcgctcccctttgcgtcccgggagcctgcgagcacccggccgaaggcgcagccgaatcttgcgggagtcgccccgaaagcgtcgggtttgtgtggggttagcgggggccgccgcgccacctgcacctcgcccgccgccgcctcggggaaagcccgaagaggaggcggaccaggagaagagcaaagaaaagcagtccgtctggatttgtttgcccaggactggcgccgcgcacgcggatcgccgaggggagtgcggtcggagtcaccgcgcccccgcctccccgcccgggcagctgaggccgggggttggagcgctgcccccgcgcacagtccccgagcgcccgacgtctccgcgcaggttcttgaagcagctgggcctggggcgcccactaatgtggccctgagggccggagcccgcaccgacgggagcgggagccggagcagctgcgggcgccgagtggccggtgcgcccggcggagcgcgcgtgcgtggccagcgcgctccccgcttctgcttggctttccggcttaattttcctcggcgggattaaagttggaaattgaccggagaattgagttgccggggaacagagccccggccgccgccagagcgatgttcccgcagagccggcacccgacgccgcaccaggctgcaggccagcccttcaagttcactatcccggagtccctggaccggattaaagaggaattccagttcctgcaggcgcagtatcacagccttaaattggaatgtgagaaactggcaagtgaaaagacagaaatgcagaggcactatgtgatgtattatgaaatgtcatatggattaaacattgaaatgcacaaacagactgaaatcgccaagagattgaatacgatttgtgcacaagtcatcccatttctgtctcaggaacatcaacaacaggtggcccaggctgttgaacgtgccaaacaggtgaccatggcagagttgaatgccatcatcggggtacgtggcctaccaggtctacctcctacacagcagcagttgcaagctcagcatctttctcatggccacggacccccagttccccttacgcctcacccttcgggacttcagcctcctggaatcccgcccctcgggggcagtgccggccttcttgcgctgtctagtgctctgagtgggcagtctcacttggcaataaaagatgacaagaagcaccacgatgcagagcaccacagagacagagagccgggcacaagccagattaggactttgtcctcatactcttacagtgctgcaaagttgtgtgcatcgctaaagagagccccaacctatacagagagcaaacaatgagataagaggaactgtcgcaaagctttccactgaaacacaggtcaccctggaagtttgcagggtttgctgtgggcatctgtagatttctcgatctcgttagattgcaggcatcttgacatcttggcaactgcctagttaatgccagtggcctgtaccatattatggaaaactgttaactgcttaattgggtaattttcaaagaaagtaatgttgttaaatggggcgaaataagaagttaaatttgaaagtgaatgtgttcaaatgaaaggtttgataattgcatctgttactacttagtttcataggctttaattctagtatgcattaaatattgggcaaaattgcacttgactaattttttgaagaaaagtaatttattctgtcaagaaataaaaaaataggctttgtgtatggttaaactgtaaatcttatgtttacaaaatactgtaattttcaggaaatcactgtattaggaatgtgcaatgacttatataaataaaagccatttttaaaactgaaaaaaact

SEQ ID NO: 313579 - DNA, 2242 bp, Homo sapiens
tgctacgcctgcgcagtaggcctccggtcgccgttccccttccccggctctagcaggccggcttctctgtccaatgcccacccggagctgggaggaggagtctgcgtaatgtgcgtgtgaagagactgggggagctggccggggctcacggtgtttgacccgtcggtcgtgcgtgagaggaaagggaaggaggaggtcccgaatagcggtcgccgaaatgttccggtgtggaggcctggcggcgggtgctttgaagcagaagctggtgcccttggtgcggaccgtgtgcgtccgaagcccgaggcagaggaaccggctcccagttgtgcagtctcatcacctaggatccccttctagatcactagcatctacaggtgcttctgggaaagatggcagcaacctagtgtacttcttaattgtaggagcaacagtcactggggcaggagtttattatgcctacaagactatgaaagaggatgaaaaaagatacaatgaaagaatttcagggttagggctgacaccagaacagaaacagaaaaaggccgcgttatctgcttcagaaggagaggaagttcctcaagacaaggcgccaagtcatgttcctttcctgctaattggtggaggcacagctgcttttgctgcagccagatccatccgggctcgggatcctggggccagggtactgattgtatctgaagatcctgagctgccgtacatgcgacctcctctttcaaaagaactgtggttttcagatgacccaaatgtcacaaagacactgcgattcaaacagtggaatggaaaagagagaagcatatatttccagccaccttctttctatgtctctgctcaggacctgcctcatattgagaatggtggtgtggctgtcctcactgggaagaaggtagtacagctggatgtgagagacaacatggtgaaacttaatgatggctctcaaataacctatgaaaagtgcttgattgcaacaggaggtactccaagaagtctgtctgccattgatagggctggagcagaggtgaagagtagaacaacgcttttcagaaagattggagactttagaagcttggagaagatttcacgggaagtcaaatcaattacgattatcggtgggggcttccttggtagcgaactggcctgtgctcttggcagaaaggctcgagccttgggcacagaagtgattcaactcttccccgagaaaggaaatatgggaaagatcctccccgaatacctcagcaactggaccatggaaaaagtcagacgagagggggttaaggtgatgcccaatgctattgtgcaatccgttggagtcagcagtggcaagttacttatcaagctgaaagacggcaggaaggtagaaactgaccacatagtggcagctgtgggcctggagcccaatgttgagttggccaagactggtggcctggaaatagactcagattttggtggcttccgggtaaatgcagagctacaagcacgctctaacatctgggtggcaggagatgctgcatgcttctacgatataaagttgggaaggaggcgggtagagcaccatgatcacgctgttgtgagtggaagattggctggagaaaatatgactggagctgctaagccgtactggcatcagtcaatgttctggagtgatttgggccccgatgttggctatgaagctattggtcttgtggacagtagtttgcccacagttggtgtttttgcaaaagcaactgcacaagacaaccccaaatctgccacagagcagtcaggaactggtatccgatcagagagtgagacagagtccgaggcctcagaaattactattcctcccagcaccccggcagttccacaggctcccgtccagggggaggactacggcaaaggtgtcatcttctacctcagggacaaagtggtcgtggggattgtgctatggaacatctttaaccgaatgccaatagcaaggaagatcattaaggacggtgagcagcatgaagatctcaatgaagtagccaaactattcaacattcatgaagactgaagccccacagtggaattggcaaacccactgcagcccctgagaggaggtcgaatgggtaaaggagcatttttttattcagcagactttctctgtgtatgagtgtgaatgatcaagtcctttgtgaatattttcaactatgtaggtaaattcttaatgttcacatagtgaaataaattctgattcttctaaattaaa

SEQ ID NO: 313580 - DNA, 1393 bp, Homo sapiens
tgctacgcctgcgcagtaggcctccggtcgccgttccccttccccggctctagcaggccggcttctctgtccaatgcccacccggagctgggaggaggagtctgcgtaatgtgcgtgtgaagagactgggggagctggccggggctcacggtgtttgacccgtcggtcgtgcgtgagaggaaagggaaggaggaggtcccgaatagcggtcgccgaaatgttccggtgtggaggcctggcggcgggtgctttgaagcagaagctggtgcccttggtgcggaccgtgtgcgtccgaagcccgaggcagaggaaccggctcccagctcgagccttgggcacagaagtgattcaactcttccccgagaaaggaaatatgggaaagatcctccccgaatacctcagcaactggaccatggaaaaagtcagacgagagggggttaaggtgatgcccaatgctattgtgcaatccgttggagtcagcagtggcaagttacttatcaagctgaaagacggcaggaaggtagaaactgaccacatagtggcagctgtgggcctggagcccaatgttgagttggccaagactggtggcctggaaatagactcagattttggtggcttccgggtaaatgcagagctacaagcacgctctaacatctgggtggcaggagatgctgcatgcttctacgatataaagttgggaaggaggcgggtagagcaccatgatcacgctgttgtgagtggaagattggctggagaaaatatgactggagctgctaagccgtactggcatcagtcaatgttctggagtgatttgggccccgatgttggctatgaagctattggtcttgtggacagtagtttgcccacagttggtgtttttgcaaaagcaactgcacaagacaaccccaaatctgccacagagcagtcaggaactggtatccgatcagagagtgagacagagtccgaggcctcagaaattactattcctcccagcaccccggcagttccacaggctcccgtccagggggaggactacggcaaaggtgtcatcttctacctcagggacaaagtggtcgtggggattgtgctatggaacatctttaaccgaatgccaatagcaaggaagatcattaaggacggtgagcagcatgaagatctcaatgaagtagccaaactattcaacattcatgaagactgaagccccacagtggaattggcaaacccactgcagcccctgagaggaggtcgaatgggtaaaggagcatttttttattcagcagactttctctgtgtatgagtgtgaatgatcaagtcctttgtgaatattttcaactatgtaggtaaattcttaatgttcacatagtgaaataaattctgattcttctaaattaaa

SEQ ID NO: 313581 - DNA, 1277 bp, Homo sapiens
gttaaactagcatatctgcctttattgtgtttgtcattagcctgagtagaaaggcctttaaaatttttttagaaagcatttgaatgcattttgtttggtattgtatttattcaataaagtatttaattagtaaaaaaaaaaaaaaaaaaaaactcgagactagagatttcacgggaagtcaaatcaattacgattatcggtgggggcttccttggtagcgaactggcctgtgctcttggcagaaaggctcgagccttgggcacagaagtgattcaactcttccccgagaaaggaaatatgggaaagatcctccccgaatacctcagcaactggaccatggaaaaagtcagacgagtggagtcagcagtggcaagttacttatcaagctgaaagacggcaggaaggtagaaactgaccacatagtggcagctgtgggcctggagcccaatgttgagttggccaagactggtggcctggaaatagactcagattttggtggcttccgggtaaatgcagagctacaagcacgctctaacatctgggtggcaggagatgctgcatgcttctacgatataaagttgggaaggaggcgggtagagcaccatgatcacgctgttgtgagtggaagattggctggagaaaatatgactggagctgctaagccgtactggcatcagtcaatgttctggagtgatttgggccccgatgttggctatgaagctattggtcttgtggacagtagtttgcccacagttggtgtttttgcaaaagcaactgcacaagacaaccccaaatctgccacagagcagtcaggaactggtatccgatcagagagtgagacagagtccgaggcctcagaaattactattcctcccagcaccccggcagttccacaggctcccgtccagggggaggactacggcaaaggtgtcatcttctacctcagggacaaagtggtcgtggggattgtgctatggaacatctttaaccgaatgccaatagcaaggaagatcattaaggacggtgagcagcatgaagatctcaatgaagtagccaaactattcaacattcatgaagactgaagccccacagtggaattggcaaacccactgcagcccctgagaggaggtcgaatgggtaaaggagcatttttttattcagcagactttctctgtgtatgagtgtgaatgatcaagtcctttgtgaatattttcaactatgtaggtaaattcttaatgttcacatagtgaaataaattctgattcttctaaattaaa

SEQ ID NO: 313582 - DNA, 915 bp, Homo sapiens
gaaactgtggtaattgactgaattatttcttttttgcctcaggtagaaactgaccacatagtggcagctgtgggcctggagcccaatgttgagttggccaagactggtggcctggaaatagactcagattttggtggcttccgggtaaatgcagagctacaagcacgctctaacatctgggtggcaggagatgctgcatgcttctacgatataaagttgggaaggaggcgggtagagcaccatgatcacgctgttgtgagtggaagattggctggagaaaatatgactggagctgctaagccgtactggcatcagtcaatgttctggagtgatttgggccccgatgttggctatgaagctattggtcttgtggacagtagtttgcccacagttggtgtttttgcaaaagcaactgcacaagacaaccccaaatctgccacagagcagtcaggaactggtatccgatcagagagtgagacagagtccgaggcctcagaaattactattcctcccagcaccccggcagttccacaggctcccgtccagggggaggactacggcaaaggtgtcatcttctacctcagggacaaagtggtcgtggggattgtgctatggaacatctttaaccgaatgccaatagcaaggaagatcattaaggacggtgagcagcatgaagatctcaatgaagtagccaaactattcaacattcatgaagactgaagccccacagtggaattggcaaacccactgcagcccctgagaggaggtcgaatgggtaaaggagcatttttttattcagcagactttctctgtgtatgagtgtgaatgatcaagtcctttgtgaatattttcaactatgtaggtaaattcttaatgttcacatagtgaaataaattctgattcttctaaattaaa

SEQ ID NO: 313583 - DNA, 1511 bp, Homo sapiens
tgctacgcctgcgcagtaggcctccggtcgccgttccccttccccggctctagcaggccggcttctctgtccaatgcccacccggagctgggaggaggagtctgcgtaatgtgcgtgtgaagagactgggggagctggccggggctcacggtgtttgacccgtcggtcgtgcgtgagaggaaagggaaggaggaggtcccgaatagcggtcgccgaaatgttccggtgtggaggcctggcggcgggtgctttgaagcagaagctggtgcccttggtgcggaccgtgtgcgtccgaagcccgaggcagaggaaccggctcccaggcaacttgttccagcgatggcatgttcctctagaactccagatgacaagacaaatggctagctctggtgcatcagggggcaaaatcgataattctgtgttagtccttattgtgggcttatcaacagtaggagctggtgcctatgcctacaagactatgaaagaggatgaaaaaagatacaatgaaagaatttcagggttagggctgacaccagaacagaaacagaaaaaggccgcgttatctgcttcagaaggagaggaagttcctcaagacaaggcgccaagtcatgttcctttcctgctaattggtggaggcacagctgcttttgctgcagccagatccatccgggctcgggatcctggggccagggtactgattgtatctgaagatcctgagctgccgtacatgcgacctcctctttcaaaagaactgtggttttcagatgacccaaatgtcacaaagacactgcgattcaaacagtggaatggaaaagagagaagcatatatttccagccaccttctttctatgtctctgctcaggacctgcctcatattgagaatggtggtgtggctgtcctcactgggaagaaggtagtacagctggatgtgagagacaacatggtgaaacttaatgatggctctcaaataacctatgaaaagtgcttgattgcaacaggaggtactccaagaagtctgtctgccattgatagggctggagcagaggtgaagagtagaacaacgcttttcagaaagattggagactttagaagcttggagaagatttcacgggaagtcaaatcaattacgattatcggtgggggcttccttggtagcgaactggcctgtgctcttggcagaaaggctcgagccttgggcacagaagtgattcaactcttccccgagaaaggaaatatgggaaagatcctccccgaatacctcagcaactggaccatggaaaaagtcagacgagtggagtcagcagtggcaagttacttatcaagctgaaagacggcaggaaggtagaaactgaccacatagtggcagctgtgggcctggagcccaatgttgagttggccaagactggtggcctggaaatagactcagattttggtggcttccgggtaaatgcagagctacaagcacgctctaacatctgggtggtaagtgtgctacagcatgaccaggcata

SEQ ID NO: 313584 - DNA, 241 bp, Homo sapiens
atgatcacgctgttgtgagtggaagattggctggagaaaatatgactggagctgctaagccgtactggcatcagtcaatgttctggtaatagtggtgtgccttggagacccaactgattacaactcagtatctctaggaccataacacagagttatggtttggttttattatgagccagttagcttcatacagaagggaaaaaagtccatcttatgtccacacattctaccctcaggtagc

SEQ ID NO: 313585 - DNA, 890 bp, Homo sapiens
cagattcgcagtggtcgcttcttctcctggatttgttaaggattccaagtaactcttatttggagagaagacgatctgcacttcgcattttggcattgacatttaattttagggtcctttatatagaagggagagtaggagtgatttgggccccgatgttggctatgaagctattggtcttgtggacagtagtttgcccacagttggtgtttttgcaaaagcaactgcacaagacaaccccaaatctgccacagagcagtcaggaactggtatccgatcagagagtgagacagagtccgaggcctcagaaattactattcctcccagcaccccggcagttccacaggctcccgtccagggggaggactacggcaaaggtgtcatcttctacctcagggacaaagtggtcgtggggattgtgctatggaacatctttaaccgaatgccaatagcaaggaagatcattaaggacggtgagcagcatgaagatctcaatgaagtagccaaactattcaacattcatgaagactgaagccccacagtggaattggcaaacccactgcagcccctgagaggaggtcgaatgggtaaaggagcatttttttattcagcagactttctctgtgtatgagtgtgaatgatcaagtcctttgtgaatattttcaactatgtaggtaaattcttaatgttcacatagtgaaataaattctgattcttctaaattaaaaaaaaacaaaaaaaaaaaaaagggcggggggcaaaagttccccggagggcaaattacgcgtccccattttttacaaggggcctaggagggggttataaaaagggaggcggggttaaccggaggggaccgcttggactgggggaccatctgggggaatggacac

SEQ ID NO: 313586 - DNA, 2254 bp, Homo sapiens
tgctacgcctgcgcagtaggcctccggtcgccgttccccttccccggctctagcaggccggcttctctgtccaatgcccacccggagctgggaggaggagtctgcgtaatgtgcgtgtgaagagactgggggagctggccggggctcacggtgtttgacccgtcggtcgtgcgtgagaggaaagggaaggaggaggtcccgaatagcggtcgccgaaatgttccggtgtggaggcctggcggcgggtgctttgaagcagaagctggtgcccttggtgcggaccgtgtgcgtccgaagcccgaggcagaggaaccggctcccaggcaacttgttccagcgatggcatgttcctctagaactccagatgacaagacaaatggctagctctggtgcatcagggggcaaaatcgataattctgtgttagtccttattgtgggcttatcaacagtaggagctggtgcctatgcctacaagactatgaaagaggatgaaaaaagatacaatgaaagaatttcagggttagggctgacaccagaacagaaacagaaaaaggccgcgttatctgcttcagaaggagaggaagttcctcaagacaaggcgccaagtcatgttcctttcctgctaattggtggaggcacagctgcttttgctgcagccagatccatccgggctcgggatcctggggccagggtactgattgtatctgaagatcctgagctgccgtacatgcgacctcctctttcaaaagaactgtggttttcagatgacccaaatgtcacaaagacactgcgattcaaacagtggaatggaaaagagagaagcatatatttccagccaccttctttctatgtctctgctcaggacctgcctcatattgagaatggtggtgtggctgtcctcactgggaagaaggtagtacagctggatgtgagagacaacatggtgaaacttaatgatggctctcaaataacctatgaaaagtgcttgattgcaacaggaggtactccaagaagtctgtctgccattgatagggctggagcagaggtgaagagtagaacaacgcttttcagaaagattggagactttagaagcttggagaagatttcacgggaagtcaaatcaattacgattatcggtgggggcttccttggtagcgaactggcctgtgctcttggcagaaaggctcgagccttgggcacagaagtgattcaactcttccccgagaaaggaaatatgggaaagatcctccccgaatacctcagcaactggaccatggaaaaagtcagacgagagggggttaaggtgatgcccaatgctattgtgcaatccgttggagtcagcagtggcaagttacttatcaagctgaaagacggcaggaaggtagaaactgaccacatagtggcagctgtgggcctggagcccaatgttgagttggccaagactggtggcctggaaatagactcagattttggtggcttccgggtaaatgcagagctacaagcacgctctaacatctgggtggcaggagatgctgcatgcttctacgatataaagttgggaaggaggcgggtagagcaccatgatcacgctgttgtgagtggaagattggctggagaaaatatgactggagctgctaagccgtactggcatcagtcaatgttctggagtgatttgggccccgatgttggctatgaagctattggtcttgtggacagtagtttgcccacagttggtgtttttgcaaaagcaactgcacaagacaaccccaaatctgccacagagcagtcaggaactggtatccgatcagagagtgagacagagtccgaggcctcagaaattactattcctcccagcaccccggcagttccacaggctcccgtccagggggaggactacggcaaaggtgtcatcttctacctcagggacaaagtggtcgtggggattgtgctatggaacatctttaaccgaatgccaatagcaaggaagatcattaaggacggtgagcagcatgaagatctcaatgaagtagccaaactattcaacattcatgaagactgaagccccacagtggaattggcaaacccactgcagcccctgagaggaggtcgaatgggtaaaggagcatttttttattcagcagactttctctgtgtatgagtgtgaatgatcaagtcctttgtgaatattttcaactatgtaggtaaattcttaatgttcacatagtgaaataaattctgattcttctaaattaaa

SEQ ID NO: 313587 - DNA, 1603 bp, Homo sapiens
aaatattaaggaaagtgagttatgaagatgataagggcaatgcagactacagaattatgggtgtctttgaactgctgcttcctgtaaaatgccaaaaacttctttgggcacatgatggttcccagcttgagagatctgtgagctccagttggaatgtttcatggcaactagttttcttaatgttctttttcagatatatgaaatcagggcatcttttcaggaggatgcttcctattcagaggttgcaaagcacttatgtaagccttaggtgactgcatgggtggaagtgcacagagttcaccatctgaagcttaatctggggccagcagttctgatacctgttgtatttgcgttacaaatgaacttgagcaccgaggccctcatgcccactgtcctgtaagtgggcgctcggcctggattgcagctctgccctgtctgtagtgagggctgcctgctgctcctttacttctcttcctgtattcctaggattgacttttgcttcctgctgtaactactctgtttcttcttcccagctcgagccttgggcacagaagtgattcaactcttccccgagaaaggaaatatgggaaagatcctccccgaatacctcagcaactggaccatggaaaaagtcagacgagagggggttaaggtgatgcccaatgctattgtgcaatccgttggagtcagcagtggcaagttacttatcaagctgaaagacggcaggaaggtagaaactgaccacatagtggcagctgtgggcctggagcccaatgttgagttggccaagactggtggcctggaaatagactcagattttggtggcttccgggtaaatgcagagctacaagcacgctctaacatctgggtggcaggagatgctgcatgcttctacgatataaagttgggaaggaggcgggtagagcaccatgatcacgctgttgtgagtggaagattggctggagaaaatatgactggagctgctaagccgtactggcatcagtcaatgttctggagtgatttgggccccgatgttggctatgaagctattggtcttgtggacagtagtttgcccacagttggtgtttttgcaaaagcaactgcacaagacaaccccaaatctgccacagagcagtcaggaactggtatccgatcagagagtgagacagagtccgaggcctcagaaattactattcctcccagcaccccggcagttccacaggctcccgtccagggggaggactacggcaaaggtgtcatcttctacctcagggacaaagtggtcgtggggattgtgctatggaacatctttaaccgaatgccaatagcaaggaagatcattaaggacggtgagcagcatgaagatctcaatgaagtagccaaactattcaacattcatgaagactgaagccccacagtggaattggcaaacccactgcagcccctgagaggaggtcgaatgggtaaaggagcatttttttattcagcagactttctctgtgtatgagtgtgaatgatcaagtcctttgtgaatattttcaactatgtaggtaaattcttaatgttcacatagtgaaataaattctgattcttctaaattaaa

SEQ ID NO: 313588 - DNA, 951 bp, Homo sapiens
  misc_feature (42)..(42): n is a, c, g, or t
  misc_feature (47)..(47): n is a, c, g, or t
  misc_feature (57)..(57): n is a, c, g, or t
  misc_feature (65)..(65): n is a, c, g, or t
gggctgctgtcatgcagaagtgagcggggataacgacagtgntgctntttagtagangaatcatnccgcaaatatcaccaagaaactgaccacatagtggcagctgtgggcctggagcccaatgttgagttggccaagactggtggcctggaaatagactcagattttggtggcttccgggtaaatgcagagctacaagcacgctctaacatctgggtggcaggagatgctgcatgcttctacgatataaagttgggaaggaggcgggtagagcaccatgatcacgctgttgtgagtggaagattggctggagaaaatatgactggagctgctaagccgtactggcatcagtcaatgttctggagtgatttgggccccgatgttggctatgaagctattggtcttgtggacagtagtttgcccacagttggtgtttttgcaaaagcaactgcacaagacaaccccaaatctgccacagagcagtcaggaactggtatccgatcagagagtgagacagagtccgaggcctcagaaattactattcctcccagcaccccggcagttccacaggctcccgtccagggggaggactacggcaaaggtgtcatcttctacctcagggacaaagtggtcgtggggattgtgctatggaacatctttaaccgaatgccaatagcaaggaagatcattaaggacggtgagcagcatgaagatctcaatgaagtagccaaactattcaacattcatgaagactgaagccccacagtggaattggcaaacccactgcagcccctgagaggaggtcgaatgggtaaaggagcatttttttattcagcagactttctctgtgtatgagtgtgaatgatcaagtcctttgtgaatattttcaactatgtaggtaaattcttaatgttcacatagtgaaataaattctgattcttctaaattaaa

SEQ ID NO: 313589 - DNA, 2016 bp, Homo sapiens
  misc_feature (1673)..(1673): n is a, c, g, or t
  misc_feature (1701)..(1701): n is a, c, g, or t
  misc_feature (1705)..(1705): n is a, c, g, or t
  misc_feature (1786)..(1786): n is a, c, g, or t
  misc_feature (1802)..(1802): n is a, c, g, or t
  misc_feature (1817)..(1817): n is a, c, g, or t
  misc_feature (1851)..(1851): n is a, c, g, or t
  misc_feature (1864)..(1864): n is a, c, g, or t
  misc_feature (1872)..(1872): n is a, c, g, or t
tgctacgcctgcgcagtaggcctccggtcgccgttccccttccccggctctagcaggccggcttctctgtccaatgcccacccggagctgggaggaggagtctgcgtaatgtgcgtgtgaagagactgggggagctggccggggctcacggtgtttgacccgtcggtcgtgcgtgagaggaaagggaaggaggaggtcccgaatagcggtcgccgaaatgttccggtgtggaggcctggcggcgggtgctttgaagcagaagctggtgcccttggtgcggaccgtgtgcgtccgaagcccgaggcagaggaaccggctcccaggcaacttgttccagcgatggcatgttcctctagaactccagatgacaagacaaatggctagctctggtgcatcagggggcaaaatcgataattctgtgttagtccttattgtgggcttatcaacagtaggagctggtgcctatgcctacaagactatgaaagaggatgaaaaaagatacaatgaaagaatttcagggttagggctgacaccagaacagaaacagaaaaaggccgcgttatctgcttcagaaggagaggaagttcctcaagacaaggcgccaagtcatgttcctttcctgctaattggtggaggcacagctgcttttgctgcagccagatccatccgggctcgggatcctggggccagggtactgattgtatctgaagatcctgagctgccgtacatgcgacctcctctttcaaaagaactgtggttttcagatgacccaaatgtcacaaagacactgcgattcaaacagtggaatggaaaagagagaagcatatatttccagccaccttctttctatgtctctgctcaggacctgcctcatattgagaatggtggtgtggctgtcctcactgggaagaaggtagtacagctggatgtgagagacaacatggtgaaacttaatgatggctctcaaataacctatgaaaagtgcttgattgcaacaggaggtactccaagaagtctgtctgccattgatagggctggagcagaggtgaagagtagaacaacgcttttcagaaagattggagactttagaagcttggagaagatttcacgggaagtcaaatcaattacgattatcggtgggggcttccttggtagcgaactggcctgtgctcttggcagaaaggctcgagccttgggcacagaagtgattcaactcttccccgagaaaggaaatatgggaaagatcctccccgaatacctcagcaactggaccatggaaaaagtcagacgagagggggttaaggtgatgcccaatgctattgtgcaatccgttggagtcagcagtggcaagttacttatcaagctgaaagacggcaggaaggtagaaactgaccacatagtggcagctgtgggcctggagcccaatgttgagttggccaagactggtggcctggaaatagactcagattttggtggcttccgggtaaatgcagagctacaagcacgctctaacatctgggtggcaggagatgctgcatgcttctacgatataaagttgggaaggaggcgggtagagcaccatgatcacgctgttgtgagtggaagattggctggagaaaatatgactggagctgctaagccgtactggcatcagtcaatgttctgagtgattngggcccgatgttgctatgagctatggtnctgngacagtagttgccacagttgtgttttgaaagcactgacagacacccaattgcacaagcatcagactgtatcgtcaagaggnacagatcgagcctagntactatctcagaccngcagtccggtcgtcagggagctcggaagtgactnactaggcaatgcnggatgctngacttacgatcatcaggacctagcggcctaactatgagcactacattgacggcacgatgacctagcgagggaggaggtttcacttcgaggagcactgattcatgatatctgactgtcggcccccccttgttaaggtacggacgc

SEQ ID NO: 313590 - DNA, 1862 bp, Homo sapiens
tgctacgcctgcgcagtaggcctccggtcgccgttccccttccccggctctagcaggccggcttctctgtccaatgcccacccggagctgggaggaggagtctgcgtaatgtgcgtgtgaagagactgggggagctggccggggctcacggtgtttgacccgtcggtcgtgcgtgagaggaaagggaaggaggaggtcccgaatagcggtcgccgaaatgttccggtgtggaggcctggcggcgggtgctttgaagcagaagctggtgcccttggtgcggaccgtgtgcgtccgaagcccgaggcagaggaaccggctcccaggcaacttgttccagcgatggcatgttcctctagaactccagatgacaagacaaatggctagctctggtgcatcagggggcaaaatcgataattctgtgttagtccttattgtgggcttatcaacagtaggagctggtgcctatgcctacaagactatgaaagaggatgaaaaaagatacaatgaaagaatttcagggttagggctgacaccagaacagaaacagaaaaaggccgcgttatctgcttcagaaggagaggaagttcctcaagacaaggcgccaagtcatgttcctttcctgctaattggtggaggcacagctgcttttgctgcagccagatccatccgggctcgggatcctggggccagggtactgattgtatctgaagatcctgagctgccgtacatgcgacctcctctttcaaaagaactgtggttttcagatgacccaaatgtcacaaagacactgcgattcaaacagtggaatggaaaagagagaagcatatatttccagccaccttctttctatgtctctgctcaggacctgcctcatattgagaatggtggtgtggctgtcctcactgggaagaaggtagtacagctggatgtgagagacaacatggtgaaacttaatgatggctctcaaataacctatgaaaagtgcttgattgcaacaggaggtactccaagaagtctgtctgccattgatagggctggagcagaggtgaagagtagaacaacgcttttcagaaagattggagactttagaagcttggagaagatttcacgggaagtcaaatcaattacgattatcggtgggggcttccttggtagcgaactggcctgtgctcttggcagaaaggctcgagccttgggcacagaagtgattcaactcttccccgagaaaggaaatatgggaaagatcctccccgaatacctcagcaactggaccatggaaaaagtcagacgagagggggttaaggtgatgcccaatgctattgtgcaatccgttggagtcagcagtggcaagttacttatcaagctgaaagacggcaggaaggtagaaactgaccacatagtggcagctgtgggcctggagcccaatgttgagttggccaagactggtggcctggaaatagactcagattttggtggcttccgggtaaatgcagagctacaagcacgctctaacatctgggtggcaggagatgctgcatgcttctacgatataaagttgggaaggaggcgggtagagcaccatgatcacgctgttgtgagtggaagattggctggagaaaatatgactggagctgctaagccgtactggcatcagtcaatgttctggagtgatttgggccccgatgttggccaactcaacattgggctccaggcccacagctgccactgtgtggtcagtttctaccttcctgccgtctttcagcttgataagtaacttgccactgctgactccaacggattgcacaatagcattgggcatcaccttaaccccctctcgtctgactttttccatggtccagttg

SEQ ID NO: 313591 - DNA, 1054 bp, Homo sapiens
tgctacgcctgcgcagtaggcctccggtcgccgttccccttccccggctctagcaggccggcttctctgtccaatgcccacccggagctgggaggaggagtctgcgtaatgtgcgtgtgaagagactgggggagctggccggggctcacggtgtttgacccgtcggtcgtgcgtgagaggaaagggaaggaggaggtcccgaatagcggtcgccgaaatgttccggtgtggaggcctggcggcgggtgctttgaagcagaagctggtgcccttggtgcggaccgtgtgcgtccgaagcccgaggcagaggaaccggctcccaggcaacttgttccagcgatggcatgttcctctagaactccagatgacaagacaaatggctagctctggtgcatcagggggcaaaatcgataattctgtgttagtccttattgtgggcttatcaacagtaggagctggtgcctatgcctacaagactatgaaagaggatgaaaaaagatacaatgaaagaatttcagggttagggctgacaccagaacagaaacagaaaaaggccgcgttatctgcttcagaaggagaggaagttcctcaagacaaggcgccaagtcatgttcctttcctgctaattggtggaggcacagctgcttttgctgcagccagatccatccgggctcgggatcctggggccagggtactgattgtatctgaagatcctgagctgccgtacatgcgacctcctctttcaaaagaactgtggttttcagatgacccaaatgtcacaaagacactgcgattcaaacagtggaatggaaaagagagaagcatatatttccagccaccttctttctatgtctctgctcaggacctgcctcatattgagaatggtggtgtggctgtcctcactgggaagaaggtagtacagctggatgtgagagacaacatggtgaaacttaatgatggctctcaaataacctatggggctggagcagaggtgaagagtagaacaacgcttttcaggattggagactttagaagcttggaggatttccggggt

SEQ ID NO: 313592 - DNA, 2949 bp, Homo sapiens
agcgggggggggccagcggcgcgggcgggtgagaggccgcggcggcaggtccacctgggcttgcgaaggcacagattccccgtccacagctcacgaccagatgcaccagcaggagtccacatcgaggacgtcctccgggcactcccacgaccagtgaccaggagttaaactttgggatgtgcccgtgatgttggaccacaaggacttagaggccgaaatccaccccttgaaaaatgaagaaagaaaatcgcaggaaaatctgggaaatccatcaaaaaatgaggataacgtgaaaagcgcgcctccacagtcccggctctcccggtgccgagcggcggcgttttttctttcattgtttctctgcctttttgtggtgttcgtcgtctcattcgtcatcccgtgtccagaccggccggcgtcacagcgaatgtggaggatagactacagtgccgctgttatctatgactttctggctgtggatgatataaacggggacaggatccaagatgttctttttctttataaaaacaccaacagcagcaacaatttcagccgatcctgtgtggacgaaggcttttcctctccctgcacctttgcagctgctgtgtcgggggccaacggcagcacgctctgggagagacctgtggcccaagacgtggccctcgtggagtgtgctgtgccccagccaagaggcagtgaggcaccttctgcctgcatcctggtgggcagacccagttctttcattgcagtcaacttgttcacaggggaaaccctgtggaaccacagcagcagcttcagcgggaatgcgtccatcctgagccctctgctgcaggtgcctgatgtggacggcgatggggccccagacctgctggttctcacccaggagcgggaggaggttagtggccacctctactccggcagcaccgggcaccagattggcctcagaggcagccttggtgtggacggggaaagtggcttcctccttcacgtcaccaggacaggtgcccactacatcctctttccctgcgcaagctccctctgcggctgctctgtgaagggtctctacgagaaggtgaccgggagcggcggcccgttcaagagtgacccgcactgggagagcatgctcaatgccaccacccgcaggatgctttcccacagctctggagcagtgcgctacctgatgcatgtcccagggaacgccggtgcagatgtgcttcttgtgggctcagaggccttcgtgctgctggacgggcaggagctgacgcctcgctggacacccaaggcagcccatgtcctgagaaaacccatcttcggccgctacaaaccagacaccttggctgtagccgttgaaaacggaactggcaccgacagacagatcctgtttctggaccttggcactggagccgtcctgtgtagcctagccctcccgagcctccctgggggtccactgtccgccagcctgccgaccgcagaccaccgctcagccttcttcttctggggcctccacgagctggggagcaccagcgagacggagaccggggaggcccggcacagcctgtacatgttccaccccaccctgccgcgcgtgctgctggagctggccaatgtctctacccacattgtcgcctttgacgccgtcctgtttgagccaagccgccacgccgcctacatccttctgacaggcccggcagactcagaggcacccggcctggtctctgtgatcaagcacaaggtgcgggaccttgtcccaagcagcagggtggtccgcctgggtgagggtgggccagacagtgaccaagccatcagggaccggttctcccggctgcggtaccagagtgaggcgtagaggcacgccagccagagcctgtggagagactccgcctgctgacactaaacgtcctgggaagtgggcccttccctgggtctctgcactgactcccccactcctgaccctggtgatggtcgccactgggcagcagcagccttaccagtcctccatgatcacacccagggacctgcatgggtgaggggacaccctgggcctctctcccgcccagcatcctccctgagtccccacacagggcctcactctgcaccccaccagggtcccgctcacaccaggcagccttcatagtggtctccctggccaccttgggcagagctgggtcatgcagcaccccatccttacccggtgccctctccttgccagcttctccccaggccagagcggccatcgcgtagaaagaaccagggtgtccccgggacaggccgtcccccaccccatcctgtagaagtccattccccttttccctcctgtgctctgtcccccaaggagtcatggaactcagggtactgggcctcaacgggaacctgagacagctccagcttcgcagcccttcccggagctacagggggatcctctagcatggggggtgtgacttggttcctttgaccaggtcctgtgaggaagcctggagcaagggtctcccccagcaggatgggtggggcctgctctggagctgagcccgtggccgctcacaggtgtccttagtggtgttgcagctgtctactggctgcatgtgctgtgaatatcccaaggaactggctgtggaatgcgtgtttgggtcagtctgtgccctctcagtagacactggagctgctctgtccctgaagaggccccgtgccccaggcatggcaagcgcctgcctctccccttccggtgctcacacgcccacgccgtgccacccgatgcaggactcacctctgtgccttgctgctcctgaggcccaagggcagccatggtgctctgtactgctcgggccgcccaggtcacagagcctgagcttcgtagccaaagcagcctgatgacccacccaccaaggaagaaagcagaataaacatttttgcactgcctgaaaaaccccggtggtcaggcgtgagcctagcgtg

SEQ ID NO: 313593 - DNA, 526 bp, Homo sapiens
cacacctctcctaggccacagcccctcccgccaggtggatctcctgtatcttgcaggctcccggggctctaatgctgaccccacggggctcaggggccagggagaggtgtgaggaaaacagacctggaacagcacatgctggggctggccggcctgcctgcccagatggtgcaacagtgaggtgccggtgtctctccctacaggcttttcctctccctgcacctttgcagctgctgtgtcgggggccaacggcagcacgctctgggagagacctgtggcccaagacgtggccctcgtggagtgtgctgtgccccagccaagaggcagtgaggcaccttctgcctgcatcctggtgggcagacccagttctttcattgcagtcaacttgttcacaggtaggccagccaggcagcggggttctcactgagggcctctcacctgagccacctcaccctgagggctaatgccaggaggccgcgacgaggctcagccctgtgatcttgagggtggctggatgggaaggaag

SEQ ID NO: 313594 - DNA, 2922 bp, Homo sapiens
agcgggggggggccagcggcgcgggcgggtgagaggccgcggcggcaggtccacctgggcttgcgaaggcacagattccccgtccacagctcacgaccagatgcaccagcaggagtccacatcgaggacgtcctccgggcactcccacgaccagtgaccaggagttaaactttgggatgtgcccgtgatgttggaccacaaggacttagaggccgaaatccaccccttgaaaaatgaagaaagaaaatcgcaggaaaatctgggaaatccatcaaaaaatgaggataacgtgaaaagcgcgcctccacagtcccggctctcccggtgccgagcggcggcgttttttctttcattgtttctctgcctttttgtggtgttcgtcgtctcattcgtcatcccgtgtccagaccggccggcgtcacagcgaatgtggaggatagactacagtgccgctgttatctatgactttctggctgtggatgatataaacggggacaggatccaagatgttctttttctttataaaaacaccaacagcagcaacaatttcagccgatcctgtgtggacgaagctgctgtgtcgggggccaacggcagcacgctctgggagagacctgtggcccaagacgtggccctcgtggagtgtgctgtgccccagccaagaggcagtgaggcaccttctgcctgcatcctggtgggcagacccagttctttcattgcagtcaacttgttcacaggggaaaccctgtggaaccacagcagcagcttcagcgggaatgcgtccatcctgagccctctgctgcaggtgcctgatgtggacggcgatggggccccagacctgctggttctcacccaggagcgggaggaggttagtggccacctctactccggcagcaccgggcaccagattggcctcagaggcagccttggtgtggacggggaaagtggcttcctccttcacgtcaccaggacaggtgcccactacatcctctttccctgcgcaagctccctctgcggctgctctgtgaagggtctctacgagaaggtgaccgggagcggcggcccgttcaagagtgacccgcactgggagagcatgctcaatgccaccacccgcaggatgctttcccacagctctggagcagtgcgctacctgatgcatgtcccagggaacgccggtgcagatgtgcttcttgtgggctcagaggccttcgtgctgctggacgggcaggagctgacgcctcgctggacacccaaggcagcccatgtcctgagaaaacccatcttcggccgctacaaaccagacaccttggctgtagccgttgaaaacggaactggcaccgacagacagatcctgtttctggaccttggcactggagccgtcctgtgtagcctagccctcccgagcctccctgggggtccactgtccgccagcctgccgaccgcagaccaccgctcagccttcttcttctggggcctccacgagctggggagcaccagcgagacggagaccggggaggcccggcacagcctgtacatgttccaccccaccctgccgcgcgtgctgctggagctggccaatgtctctacccacattgtcgcctttgacgccgtcctgtttgagccaagccgccacgccgcctacatccttctgacaggcccggcagactcagaggcacccggcctggtctctgtgatcaagcacaaggtgcgggaccttgtcccaagcagcagggtggtccgcctgggtgagggtgggccagacagtgaccaagccatcagggaccggttctcccggctgcggtaccagagtgaggcgtagaggcacgccagccagagcctgtggagagactccgcctgctgacactaaacgtcctgggaagtgggcccttccctgggtctctgcactgactcccccactcctgaccctggtgatggtcgccactgggcagcagcagccttaccagtcctccatgatcacacccagggacctgcatgggtgaggggacaccctgggcctctctcccgcccagcatcctccctgagtccccacacagggcctcactctgcaccccaccagggtcccgctcacaccaggcagccttcatagtggtctccctggccaccttgggcagagctgggtcatgcagcaccccatccttacccggtgccctctccttgccagcttctccccaggccagagcggccatcgcgtagaaagaaccagggtgtccccgggacaggccgtcccccaccccatcctgtagaagtccattccccttttccctcctgtgctctgtcccccaaggagtcatggaactcagggtactgggcctcaacgggaacctgagacagctccagcttcgcagcccttcccggagctacagggggatcctctagcatggggggtgtgacttggttcctttgaccaggtcctgtgaggaagcctggagcaagggtctcccccagcaggatgggtggggcctgctctggagctgagcccgtggccgctcacaggtgtccttagtggtgttgcagctgtctactggctgcatgtgctgtgaatatcccaaggaactggctgtggaatgcgtgtttgggtcagtctgtgccctctcagtagacactggagctgctctgtccctgaagaggccccgtgccccaggcatggcaagcgcctgcctctccccttccggtgctcacacgcccacgccgtgccacccgatgcaggactcacctctgtgccttgctgctcctgaggcccaagggcagccatggtgctctgtactgctcgggccgcccaggtcacagagcctgagcttcgtagccaaagcagcctgatgacccacccaccaaggaagaaagcagaataaacatttttgcactgcctgaaaaaccccggtggtcaggcgtgagcctagcgtg

SEQ ID NO: 313595 - DNA, 3246 bp, Homo sapiens
agcgggggggggccagcggcgcgggcgggtgagaggccgcggcggcaggtccacctgggcttgcgaaggcacagattccccgtccacagctcacgaccagatgcaccagcaggagtccacatcgaggacgtcctccgggcactcccacgaccagtgaccaggagttaaactttgggatgtgcccgtgatgttggaccacaaggacttagaggccgaaatccaccccttgaaaaatgaagaaagaaaatcgcaggaaaatctgggaaatccatcaaaaaatgaggataacgtgaaaagcgcgcctccacagtcccggctctcccggtgccgagcggcggcgttttttctttcattgtttctctgcctttttgtggtgttcgtcgtctcattcgtcatcccgtgtccagaccggccggcgtcacagcgaatgtggaggatagactacagtgccgctgttatctatgactttctggctgtggatgatataaacggggacaggatccaagatgttctttttctttataaaaacaccaacagcagcaacaatttcagccgatcctgtgtggacgaaggcttttcctctccctgcacctttgcagctgctgtgtcgggggccaacggcagcacgctctgggagagacctgtggcccaagacgtggccctcgtggagtgtgctgtgccccagccaagaggcagtgaggcaccttctgcctgcatcctggtgggcagacccagttctttcattgcagtcaacttgttcacaggggaaaccctgtggaaccacagcagcagcttcagcgggaatgcgtccatcctgagccctctgctgcaggtgcctgatgtggacggcgatggggccccagacctgctggttctcacccaggagcgggaggaggttagtggccacctctactccggcagcaccgggcaccagattggcctcagaggcagccttggtgtggacggggaaagtggcttcctccttcacgtcaccaggacaggtgcccactacatcctctttccctgcgcaagctccctctgcggctgctctgtgaagggtctctacgagaaggtgaccgggagcggcggcccgttcaagagtgacccgcactgggagagcatgctcaatgccaccacccgcaggatgctttcccacagctctggagcagtgcgctacctgatgcatgtcccagggaacgccggtgcagatgtgcttcttgtgggctcagaggccttcgtgctgctggacgggcaggagctgacgcctcgctggacacccaaggcagcccatgtcctgaggtacagggtttccccaaggaccgcgcaggtgctgcaccccttcccggcatcccgggcacatcccgttggctggcgaggagacagcgctgggggtggggccggagccgtggtgctgctgcccgggcttcttgcctgtctctggtacttgccccttgccccagacgtcggctccgtgtcctgggccctggtccagatgtggccatgggagactgaggggcggacgtgttcctgggtgcttccttcatctcagtctcctcactgagacccctcgtgagcgcttcctccatattgttccagaaaacccatcttcggccgctacaaaccagacaccttggctgtagccgttgaaaacggaactggcaccgacagacagatcctgtttctggaccttggcactggagccgtcctgtgtagcctagccctcccgagcctccctgggggtccactgtccgccagcctgccgaccgcagaccaccgctcagccttcttcttctggggcctccacgagctggggagcaccagcgagacggagaccggggaggcccggcacagcctgtacatgttccaccccaccctgccgcgcgtgctgctggagctggccaatgtctctacccacattgtcgcctttgacgccgtcctgtttgagccaagccgccacgccgcctacatccttctgacaggcccggcagactcagaggcacccggcctggtctctgtgatcaagcacaaggtgcgggaccttgtcccaagcagcagggtggtccgcctgggtgagggtgggccagacagtgaccaagccatcagggaccggttctcccggctgcggtaccagagtgaggcgtagaggcacgccagccagagcctgtggagagactccgcctgctgacactaaacgtcctgggaagtgggcccttccctgggtctctgcactgactcccccactcctgaccctggtgatggtcgccactgggcagcagcagccttaccagtcctccatgatcacacccagggacctgcatgggtgaggggacaccctgggcctctctcccgcccagcatcctccctgagtccccacacagggcctcactctgcaccccaccagggtcccgctcacaccaggcagccttcatagtggtctccctggccaccttgggcagagctgggtcatgcagcaccccatccttacccggtgccctctccttgccagcttctccccaggccagagcggccatcgcgtagaaagaaccagggtgtccccgggacaggccgtcccccaccccatcctgtagaagtccattccccttttccctcctgtgctctgtcccccaaggagtcatggaactcagggtactgggcctcaacgggaacctgagacagctccagcttcgcagcccttcccggagctacagggggatcctctagcatggggggtgtgacttggttcctttgaccaggtcctgtgaggaagcctggagcaagggtctcccccagcaggatgggtggggcctgctctggagctgagcccgtggccgctcacaggtgtccttagtggtgttgcagctgtctactggctgcatgtgctgtgaatatcccaaggaactggctgtggaatgcgtgtttgggtcagtctgtgccctctcagtagacactggagctgctctgtccctgaagaggccccgtgccccaggcatggcaagcgcctgcctctccccttccggtgctcacacgcccacgccgtgccacccgatgcaggactcacctctgtgccttgctgctcctgaggcccaagggcagccatggtgctctgtactgctcgggccgcccaggtcacagagcctgagcttcgtagccaaagcagcctgatgacccacccaccaaggaagaaagcagaataaacatttttgcactgcctgaaaaaccccggtggtcaggcgtgagcctagcgtg

SEQ ID NO: 313596 - DNA, 3486 bp, Homo sapiens
agcgggggggggccagcggcgcgggcgggtgagaggccgcggcggcaggtccacctgggcttgcgaaggcacagattccccgtccacagctcacgaccagatgcaccagcaggagtccacatcgaggacgtcctccgggcactcccacgaccagtgaccaggagttaaactttgggatgtgcccgtgatgttggaccacaaggacttagaggccgaaatccaccccttgaaaaatgaagaaagaaaatcgcaggaaaatctgggaaatccatcaaaaaatgaggataacgtgaaaagcgcgcctccacagtcccggctctcccggtgccgagcggcggcgttttttctttcattgtttctctgcctttttgtggtgttcgtcgtctcattcgtcatcccgtgtccagaccggccggcgtcacagcgaatgtggaggatagactacagtgccgctgttatctatgactttctggctgtggatgatataaacggggacaggatccaagatgttctttttctttataaaaacaccaacagcagcaacaatttcagccgatcctgtgtggacgaaggcttttcctctccctgcacctttgcagctgctgtgtcgggggccaacggcagcacgctctgggagagacctgtggcccaagacgtggccctcgtggagtgtgctgtgccccagccaagaggcagtgaggcaccttctgcctgcatcctggtgggcagacccagttctttcattgcagtcaacttgttcacaggggaaaccctgtggaaccacagcagcagcttcagcgggaatgcgtccatcctgagccctctgctgcaggtgcctgatgtggacggcgatggggccccagacctgctggttctcacccaggagcgggaggaggttagtggccacctctactccggcagcaccgggcaccagattggcctcagaggcagccttggtgtggacggggaaagtggcttcctccttcacgtcaccaggacaggtgcccactacatcctctttccctgcgcaagctccctctgcggctgctctgtgaagggtctctacgagaaggtgaccgggagcggcggcccgttcaagagtgacccgcactgggagagcatgctcaatgccaccacccgcaggatgctttcccacagctctggagcagtgcgctacctgatgcatgtcccagggaacgccggtgcagatgtgcttcttgtgggctcagaggccttcgtgctgctggacgggcaggagctgacgcctcgctggacacccaaggcagcccatgtcctgaggtacagggtttccccaaggaccgcgcaggtgctgcaccccttcccggcatcccgggcacatcccgttggctggcgaggagacagcgctgggggtggggccggagccgtggtgctgctgcccgggcttcttgcctgtctctggtacttgccccttgccccagacgtcggctccgtgtcctgggccctggtccagatgtggccatgggagactgaggggcggacgtgttcctgggtgcttccttcatctcagtctcctcactgagacccctcgtgagcgcttcctccatattgttccagaaaacccatcttcggccgctacaaaccagacaccttggctgtagccgttgaaaacggaactggcaccgacagacaggttcgttgttcttccttcggaggtggcacctttgttcttagctgaggatagactggtctgaaagcagacggggctgcggcccaggaggctgctgccgtcagagctgctgagaaggttctgcctccctcagagcatctgcctccagggctggcatggctgagggcacgtgtgcctgtgcaagcctcgagcttttcccggtagcccccacgttggcccccacagtgtcccctccctccccagatcctgtttctggaccttggcactggagccgtcctgtgtagcctagccctcccgagcctccctgggggtccactgtccgccagcctgccgaccgcagaccaccgctcagccttcttcttctggggcctccacgagctggggagcaccagcgagacggagaccggggaggcccggcacagcctgtacatgttccaccccaccctgccgcgcgtgctgctggagctggccaatgtctctacccacattgtcgcctttgacgccgtcctgtttgagccaagccgccacgccgcctacatccttctgacaggcccggcagactcagaggcacccggcctggtctctgtgatcaagcacaaggtgcgggaccttgtcccaagcagcagggtggtccgcctgggtgagggtgggccagacagtgaccaagccatcagggaccggttctcccggctgcggtaccagagtgaggcgtagaggcacgccagccagagcctgtggagagactccgcctgctgacactaaacgtcctgggaagtgggcccttccctgggtctctgcactgactcccccactcctgaccctggtgatggtcgccactgggcagcagcagccttaccagtcctccatgatcacacccagggacctgcatgggtgaggggacaccctgggcctctctcccgcccagcatcctccctgagtccccacacagggcctcactctgcaccccaccagggtcccgctcacaccaggcagccttcatagtggtctccctggccaccttgggcagagctgggtcatgcagcaccccatccttacccggtgccctctccttgccagcttctccccaggccagagcggccatcgcgtagaaagaaccagggtgtccccgggacaggccgtcccccaccccatcctgtagaagtccattccccttttccctcctgtgctctgtcccccaaggagtcatggaactcagggtactgggcctcaacgggaacctgagacagctccagcttcgcagcccttcccggagctacagggggatcctctagcatggggggtgtgacttggttcctttgaccaggtcctgtgaggaagcctggagcaagggtctcccccagcaggatgggtggggcctgctctggagctgagcccgtggccgctcacaggtgtccttagtggtgttgcagctgtctactggctgcatgtgctgtgaatatcccaaggaactggctgtggaatgcgtgtttgggtcagtctgtgccctctcagtagacactggagctgctctgtccctgaagaggccccgtgccccaggcatggcaagcgcctgcctctccccttccggtgctcacacgcccacgccgtgccacccgatgcaggactcacctctgtgccttgctgctcctgaggcccaagggcagccatggtgctctgtactgctcgggccgcccaggtcacagagcctgagcttcgtagccaaagcagcctgatgacccacccaccaaggaagaaagcagaataaacatttttgcactgcctgaaaaaccccggtggtcaggcgtgagcctagcgtg

SEQ ID NO: 313597 - DNA, 2364 bp, Homo sapiens
cacgagcacaggagtgccgccctcccctcctgttggcatctgctctgagtgtgcagtgagccgtgggctcacgagggtgatgcctcaacaggagcctgcctgtcacaggccttgcagttgccgggctgctgttgaaggggactcagggccacgttccgtgaccgtgtgcttgattctaggggaaaccctgtggaaccacagcagcagcttcagcgggaatgcgtccatcctgagccctctgctgcaggtgcctgatgtggacggcgatggggccccagacctgctggttctcacccaggagcgggaggaggttagtggccacctctactccggcagcaccgggcaccagattggcctcagaggcagccttggtgtggacggggaaagtggcttcctccttcacgtcaccaggacaggtgcccactacatcctctttccctgcgcaagctccctctgcggctgctctgtgaagggtctctacgagaaggtgaccgggagcggcggcccgttcaagagtgacccgcactgggagagcatgctcaatgccaccacccgcaggatgctttcccacagctctggagcagtgcgctacctgatgcatgtcccagggaacgccggtgcagatgtgcttcttgtgggctcagaggccttcgtgctgctggacgggcaggagctgacgcctcgctggacacccaaggcagcccatgtcctgagaaaacccatcttcggccgctacaaaccagacaccttggctgtagccgttgaaaacggaactggcaccgacagacagatcctgtttctggaccttggcactggagccgtcctgtgtagcctagccctcccgagcctccctgggggtccactgtccgccagcctgccgaccgcagaccaccgctcagccttcttcttctggggcctccacgagctggggagcaccagcgagacggagaccggggaggcccggcacagcctgtacatgttccaccccaccctgccgcgcgtgctgctggagctggccaatgtctctacccacattgtcgcctttgacgccgtcctgtttgagccaagccgccacgccgcctacatccttctgacaggcccggcagactcagaggcacccggcctggtctctgtgatcaagcacaaggtgcgggaccttgtcccaagcagcagggtggtccgcctgggtgagggtgggccagacagtgaccaagccatcagggaccggttctcccggctgcggtaccagagtgaggcgtagaggcacgccagccagagcctgtggagagactccgcctgctgacactaaacgtcctgggaagtgggcccttccctgggtctctgcactgactcccccactcctgaccctggtgatggtcgccactgggcagcagcagccttaccagtcctccatgatcacacccagggacctgcatgggtgaggggacaccctgggcctctctcccgcccagcatcctccctgagtccccacacagggcctcactctgcaccccaccagggtcccgctcacaccaggcagccttcatagtggtctccctggccaccttgggcagagctgggtcatgcagcaccccatccttacccggtgccctctccttgccagcttctccccaggccagagcggccatcgcgtagaaagaaccagggtgtccccgggacaggccgtcccccaccccatcctgtagaagtccattccccttttccctcctgtgctctgtcccccaaggagtcatggaactcagggtactgggcctcaacgggaacctgagacagctccagcttcgcagcccttcccggagctacagggggatcctctagcatggggggtgtgacttggttcctttgaccaggtcctgtgaggaagcctggagcaagggtctcccccagcaggatgggtggggcctgctctggagctgagcccgtggccgctcacaggtgtccttagtggtgttgcagctgtctactggctgcatgtgctgtgaatatcccaaggaactggctgtggaatgcgtgtttgggtcagtctgtgccctctcagtagacactggagctgctctgtccctgaagaggccccgtgccccaggcatggcaagcgcctgcctctccccttccggtgctcacacgcccacgccgtgccacccgatgcaggactcacctctgtgccttgctgctcctgaggcccaagggcagccatggtgctctgtactgctcgggccgcccaggtcacagagcctgagcttcgtagccaaagcagcctgatgacccacccaccaaggaagaaagcagaataaacatttttgcactgcctgaaaaaccccggtggtcaggcgtgagcctagcgtg

SEQ ID NO: 313598 - DNA, 1901 bp, Homo sapiens
agcgggggggggccagcggcgcgggcgggtgagaggccgcggcggcaggtccacctgggcttgcgaaggcacagattccccgtccacagctcacgaccagatgcaccagcaggagtccacatcgaggacgtcctccgggcactcccacgaccagtgaccaggagttaaactttgggatgtgcccgtgatgttggaccacaaggacttagaggccgaaatccaccccttgaaaaatgaagaaagaaaatcgcaggaaaatctgggaaatccatcaaaaaatgaggataacgtgaaaagcgcgcctccacagtcccggctctcccggtgccgagcggcggcgttttttctttcattgtttctctgcctttttgtggtgttcgtcgtctcattcgtcatcccgtgtccagaccggccggcgtcacagcgaatgtggaggatagactacagtgccgctgttatctatgactttctggctgtggatgatataaacggggacaggatccaagatgttctttttctttataaaaacaccaacagcagcaacaatttcagccgatcctgtgtggacgaaggcttttcctctccctgcacctttgcagctgctgtgtcgggggccaacggcagcacgctctgggagagacctgtggcccaagacgtggccctcgtggagtgtgctgtgccccagccaagaggcagtgaggcaccttctgcctgcatcctggtgggcagacccagttctttcattgcagtcaacttgttcacaggggaaaccctgtggaaccacagcagcagcttcagcgggaatgcgtccatcctgagccctctgctgcaggtgcctgatgtggacggcgatggggccccagacctgctggttctcacccaggagcgggaggaggttagtggccacctctactccggcagcaccgggcaccagattggcctcagaggcagccttggtgtggacggggaaagtggcttcctccttcacgtcaccaggacaggtgcccactacatcctctttccctgcgcaagctccctctgcggctgctctgtgaagggtctctacgagaaggtgaccgggagcggcggcccgttcaagagtgacccgcactgggagagcatgctcaatgccaccacccgcaggatgctttcccacagctctggagcagtgcgctacctgatgcatgtcccagggaacgccggtgcagatgtgcttcttgtgggctcagaggccttcgtgctgctggacgggcaggagctgacgcctcgctggacacccaaggcagcccatgtcctgagaaaacccatcttcggccgctacaaaccagacaccttggctgtagccgttgaaaacggaactggcaccgacagacagatcctgtttctggaccttggcactggagccgtcctgtgtagcctagccctcccgagcctccctgggggtccactgtccgccagcctgccgaccgcagaccaccgctcagccttcttcttctggggcctccacgagctggggagcaccagcgagacggagaccggggaggcccggcacagcctgtacatgttccaccccaccctgccgcgcgtgctgctggagctggccaatgtctctacccacattgtcgcctttgacgccgtcctgtttgagccaagccgccacgccgcctacatccttctgacaggcccggcagactcagaggcacccggcctggtctctgtgccttgctgctcctgaggcccaagggcagccatggtgctctgtactgctcgggccgcccaggtcacagagcctgagcttcgtagccaaagcagcctgatgacccacccaccaaggaagaaagcagaataaacatttttgcactgcctgaaaaaccccggtggtcaggcgtgagcctagcgtg

SEQ ID NO: 313599 - DNA, 1827 bp, Homo sapiens
agcgggggggggccagcggcgcgggcgggtgagaggccgcggcggcaggtccacctgggcttgcgaaggcacagattccccgtccacagctcacgaccagatgcaccagcaggagtccacatcgaggacgtcctccgggcactcccacgaccagtgaccaggagttaaactttgggatgtgcccgtgatgttggaccacaaggacttagaggccgaaatccaccccttgaaaaatgaagaaagaaaatcgcaggaaaatctgggaaatccatcaaaaaatgaggataacgtgaaaagcgcgcctccacagtcccggctctcccggtgccgagcggcggcgttttttctttcattgtttctctgcctttttgtggtgttcgtcgtctcattcgtcatcccgtgtccagaccggccggcgtcacagcgaatgtggaggatagactacagtgccgctgttatctatgactttctggctgtggatgatataaacggggacaggatccaagatgttctttttctttataaaaacaccaacagcagcaacaatttcagccgatcctgtgtggacgaaggcttttcctctccctgcacctttgcagctgctgtgtcgggggccaacggcagcacgctctgggagagacctgtggcccaagacgtggccctcgtggagtgtgctgtgccccagccaagaggcagtgaggcaccttctgcctgcatcctggtgggcagacccagttctttcattgcagtcaacttgttcacaggggaaaccctgtggaaccacagcagcagcttcagcgggaatgcgtccatcctgagccctctgctgcaggtgcctgatgtggacggcgatggggccccagacctgctggttctcacccaggagcgggaggaggttagtggccacctctactccggcagcaccgggcaccagattggcctcagaggcagccttggtgtggacggggaaagtggcttcctccttcacgtcaccaggacaggtgcccactacatcctctttccctgcgcaagctccctctgcggctgctctgtgaagggtctctacgagaaggtgaccgggagcggcggcccgttcaagagtgacccgcactgggagagcatgctcaatgccaccacccgcaggatgctttcccacagctctggagcagtgcgctacctgatgcatgtcccagggaacgccggtgcagatgtgcttcttgtgggctcagaggccttcgtgctgctggacgggcaggagctgacgcctcgctggacacccaaggcagcccatgtcctgagaaaacccatcttcggccgctacaaaccagacaccttggctgtagccgttgaaaacggaactggcaccgacagacaggttcgttgttcttccttcggaggtggcacctttgttcttagctgaggatagactggtctgaaagcagacggggctgcggcccaggaggctgctgccgtcagagctgctgagaaggttctgcctccctcagagcatctgcctccagggctggcatggctgagggcacgtgtgcctgtgcaagcctcgagcttttcccggtagcccccacgttggcccccacagtgtcccctccctccccagatcctgtttctggaccttggcactggagccgtcctgtgtagcctagccctcccgagcctccctgggggtccactgtccgccagcctgccgaccgcagaccaccgctcagccttcttcttctggggcctccacgagctggggagcaccagcgagacggtacgggagccaccctcggagcagccatgctgggagccggggccagagacccaggc

SEQ ID NO: 313600 - DNA, 660 bp, Homo sapiens
agcgggggggggccagcggcgcgggcgggtgagaggccgcggcggcaggtccacctgggcttgcgaaggcacagattccccgtccacagctcacgaccagatgcaccagcaggagtccacatcgaggacgtcctccgggcactcccacgaccagtgaccaggagttaaactttgggatgtgcccgtgatgttggaccacaaggacttagaggccgaaatccaccccttgaaaaatgaagaaagaaaatcgcaggaaaatctgggaaatccatcaaaaaatgaggataacgtgaaaagcgcgcctccacagtcccggctctcccggtgccgagcggcggcgttttttctttcattgtttctctgcctttttgtggtgttcgtcgtctcattcgtcatcccgtgtccagaccggccggcgtcacagcgaatgtggaggatagactacagtgccgctgttatctatgactttctggctgtggatgatataaacggggacaggatccaagatgttctttttctttataaaaacaccaacagcagcaacaatttcagccgatcctgtgtggacgaaggtcacagagcctgagcttcgtagccaaagcagcctgatgacccacccaccaaggaagaaagcagaataaacatttttgcactgcctga

SEQ ID NO: 313601 - DNA, 524 bp, Homo sapiens
gagacccctcgtgagcgcttcctccatattgttccagaaaacccatcttcggccgctacaaaccagacaccttggctgtagccgttgaaaacggaactggcaccgacagacaggttcgttgttcttccttcggaggtggcacctttgttcttagctgaggatagactggtctgaaagcagacggggctgcggcccaggaggctgctgccgtcagagctgctgagaaggttctgcctccctcagagcatctgcctccagggctggcatggctgagggcacgtgtgcctgtgcaagcctcgagcttttcccggtagcccccacgttggcccccacagtgtcccctccctccccagatcctgtttctggaccttggcactggagccgtcctgtgtagcctagccctcccgagcctccctgggggtccactgtccgccagcctgccgaccgcagaccaccgctcagccttcttcttctggggcctccacgagctggggagcaccagcgagacggtacgggagccaccc

SEQ ID NO: 313602 - DNA, 2916 bp, Homo sapiens
agcgggggggggccagcggcgcgggcgggtgagaggccgcggcggcaggtccacctgggcttgcgaaggcacagattccccgtccacagctcacgaccagatgcaccagcaggagtccacatcgaggacgtcctccgggcactcccacgaccagtgaccaggagttaaactttgggatgtgcccgtgatgttggaccacaaggacttagaggccgaaatccaccccttgaaaaatgaagaaagaaaatcgcaggaaaatctgggaaatccatcaaaaaatgaggataacgtgaaaagcgcgcctccacagtcccggctctcccggtgccgagcggcggcgttttttctttcattgtttctctgcctttttgtggtgttcgtcgtctcattcgtcatcccgtgtccagaccggccggcgtcacagcgaatgtggaggatagactacagtgccgctgttatctatgactttctggctgtggatgatataaacggggacaggatccaagatgttctttttctttataaaaacaccaacagcagcaacaatttcagccgatcctgtgtggacgaaggcttttcctctccctgcacctttgcagctgctgtgtcgggggccaacggcagcacgctctgggagagacctgtggcccaagacgtggccctcgtggagtgtgctgtgccccagccaagaggcagtgaggcaccttctgcctgcatcctggtgggcagacccagttctttcattgcagtcaacttgttcacaggggaaaccctgtggaaccacagcagcagcttcagcgggaatgcgtccatcctgagccctctgctgcaggtgcctgatgtggacggcgatggggccccagacctgctggttctcacccaggagcgggaggaggttagtggccacctctactccggcagcaccgggcaccagattggcctcagaggcagccttggtgtggacggggaaagtggcttcctccttcacgtcaccaggacaggtgcccactacatcctctttccctgcgcaagctccctctgcggctgctctgtgaagggtctctacgagaaggtgaccgggagcggcggcccgttcaagagtgacccgcactgggagagcatgctcaatgccaccacccgcaggatgctttcccacagctctggagcagtgcgctacctgatgcatgtcccagggaacgccggtgcagatgtgcttcttgtgggctcagaggccttcgtgctgctggacgggcaggagctgacgcctcgctggacacccaaggcagcccatgtcctgagaaaacccatcttcggccgctacaaaccagacaccttggctgtagccgttgaaaacggaactggcaccgacagacagatcctgtttctggaccttggcactggagccgtcctgtgtagcctagccctcccgagcctccctgggggtccactgtccgccagcctgccgaccgcagaccaccgctcagccttcttcttctggggcctccacgagctggggagcaccagcgagacggagaccggggaggcccggcacagcctgtacatgttccaccccaccctgccgcgcgtgctgctggagctggccaatgtctctacccacattgtcgcctttgacgccgtcctgtttgagccaagccgccacgccgcctacatccttctgacaggcccggcagactcagaggcacccggcctggtctctgtgatcaagcacaaggtgcgggaccttgtcccaagcagcagggtggtccgcctgggtgagggtgggccagacagtgaccaagccatcagggaccggttctcccggctgcggtaccagagtgaggcgtagaggcacgccagccagagcctgtggagagactccgcctgctgacactaaacgtcctgggaagtgggcccttccctgggtctctgcactgactcccccactcctgaccctggtgatggtcgccactgggcagcagcagccttaccagtcctccatgatcacacccagggacctgcatgggtgaggggacaccctgggcctctctcccgcccagcatcctccctgagtccccacacagggcctcactctgcaccccaccagggtcccgctcacaccaggcagccttcatagtggtctccctggccaccttgggcagagctgggtcatgcagcaccccatccttacccggtgccctctccttgccagcttctccccaggccagagcggccatcgcgtagaaagaaccagggtgtccccgggacaggccgtcccccaccccatcctgtagaagtccattccccttttccctcctgtgctctgtcccccaaggagtcatggaactcagggtactgggcctcaacgggaacctgagacagctccagcttcgcagcccttcccggagctacagggggatcctctagcatggggggtgtgacttggttcctttgaccaggtcctgtgaggaagcctggagcaagggtctcccccagcaggatgggtggggcctgctctggagctgagcccgtggccgctcacaggtgtccttagtggtgttgcagctgtctactggctgcatgtgctgtgaatatcccaaggaactggctgtggaatgcgtgtttgggtcagtctgtgccctctcagtagacactggagctgctctgtccctgaagaggccccgtgccccaggcatggcaagcgcctgcctctccccttccggtgctcacacgcccacgccgtgccacccgatgcaggactcacctctgtgccttgctgctcctgaggcccaagggcagccatggtgctctgtactgctcgggccgcccaggtcacagagcctgagcttcgtagccaaagcagcctgatgacccacccaccaaggaagaaagcagaataaacatttttgcactgcctga

SEQ ID NO: 313603 - DNA, 3189 bp, Homo sapiens
agcgggggggggccagcggcgcgggcgggtgagaggccgcggcggcaggtccacctgggcttgcgaaggcacagattccccgtccacagctcacgaccagatgcaccagcaggagtccacatcgaggacgtcctccgggcactcccacgaccagtgaccaggagttaaactttgggatgtgcccgtgatgttggaccacaaggacttagaggccgaaatccaccccttgaaaaatgaagaaagaaaatcgcaggaaaatctgggaaatccatcaaaaaatgaggataacgtgaaaagcgcgcctccacagtcccggctctcccggtgccgagcggcggcgttttttctttcattgtttctctgcctttttgtggtgttcgtcgtctcattcgtcatcccgtgtccagaccggccggcgtcacagcgaatgtggaggatagactacagtgccgctgttatctatgactttctggctgtggatgatataaacggggacaggatccaagatgttctttttctttataaaaacaccaacagcagcaacaatttcagccgatcctgtgtggacgaaggcttttcctctccctgcacctttgcagctgctgtgtcgggggccaacggcagcacgctctgggagagacctgtggcccaagacgtggccctcgtggagtgtgctgtgccccagccaagaggcagtgaggcaccttctgcctgcatcctggtgggcagacccagttctttcattgcagtcaacttgttcacaggggaaaccctgtggaaccacagcagcagcttcagcgggaatgcgtccatcctgagccctctgctgcaggtgcctgatgtggacggcgatggggccccagacctgctggttctcacccaggagcgggaggaggttagtggccacctctactccggcagcaccgggcaccagattggcctcagaggcagccttggtgtggacggggaaagtggcttcctccttcacgtcaccaggacaggtgcccactacatcctctttccctgcgcaagctccctctgcggctgctctgtgaagggtctctacgagaaggtgaccgggagcggcggcccgttcaagagtgacccgcactgggagagcatgctcaatgccaccacccgcaggatgctttcccacagctctggagcagtgcgctacctgatgcatgtcccagggaacgccggtgcagatgtgcttcttgtgggctcagaggccttcgtgctgctggacgggcaggagctgacgcctcgctggacacccaaggcagcccatgtcctgagaaaacccatcttcggccgctacaaaccagacaccttggctgtagccgttgaaaacggaactggcaccgacagacaggttcgttgttcttccttcggaggtggcacctttgttcttagctgaggatagactggtctgaaagcagacggggctgcggcccaggaggctgctgccgtcagagctgctgagaaggttctgcctccctcagagcatctgcctccagggctggcatggctgagggcacgtgtgcctgtgcaagcctcgagcttttcccggtagcccccacgttggcccccacagtgtcccctccctccccagatcctgtttctggaccttggcactggagccgtcctgtgtagcctagccctcccgagcctccctgggggtccactgtccgccagcctgccgaccgcagaccaccgctcagccttcttcttctggggcctccacgagctggggagcaccagcgagacggagaccggggaggcccggcacagcctgtacatgttccaccccaccctgccgcgcgtgctgctggagctggccaatgtctctacccacattgtcgcctttgacgccgtcctgtttgagccaagccgccacgccgcctacatccttctgacaggcccggcagactcagaggcacccggcctggtctctgtgatcaagcacaaggtgcgggaccttgtcccaagcagcagggtggtccgcctgggtgagggtgggccagacagtgaccaagccatcagggaccggttctcccggctgcggtaccagagtgaggcgtagaggcacgccagccagagcctgtggagagactccgcctgctgacactaaacgtcctgggaagtgggcccttccctgggtctctgcactgactcccccactcctgaccctggtgatggtcgccactgggcagcagcagccttaccagtcctccatgatcacacccagggacctgcatgggtgaggggacaccctgggcctctctcccgcccagcatcctccctgagtccccacacagggcctcactctgcaccccaccagggtcccgctcacaccaggcagccttcatagtggtctccctggccaccttgggcagagctgggtcatgcagcaccccatccttacccggtgccctctccttgccagcttctccccaggccagagcggccatcgcgtagaaagaaccagggtgtccccgggacaggccgtcccccaccccatcctgtagaagtccattccccttttccctcctgtgctctgtcccccaaggagtcatggaactcagggtactgggcctcaacgggaacctgagacagctccagcttcgcagcccttcccggagctacagggggatcctctagcatggggggtgtgacttggttcctttgaccaggtcctgtgaggaagcctggagcaagggtctcccccagcaggatgggtggggcctgctctggagctgagcccgtggccgctcacaggtgtccttagtggtgttgcagctgtctactggctgcatgtgctgtgaatatcccaaggaactggctgtggaatgcgtgtttgggtcagtctgtgccctctcagtagacactggagctgctctgtccctgaagaggccccgtgccccaggcatggcaagcgcctgcctctccccttccggtgctcacacgcccacgccgtgccacccgatgcaggactcacctctgtgccttgctgctcctgaggcccaagggcagccatggtgctctgtactgctcgggccgcccaggtcacagagcctgagcttcgtagccaaagcagcctgatgacccacccaccaaggaagaaagcagaataaacatttttgcactgcctgaaaaaccccggtggtcaggcgtgagcctagcgtg

SEQ ID NO: 313604 - DNA, 2793 bp, Homo sapiens
agcgggggggggccagcggcgcgggcgggtgagaggccgcggcggcaggtccacctgggcttgcgaaggcacagattccccgtccacagctcacgaccagatgcaccagcaggagtccacatcgaggacgtcctccgggcactcccacgaccagtgaccaggagttaaactttgggatgtgcccgtgatgttggaccacaaggacttagaggccgaaatccaccccttgaaaaatgaagaaagaaaatcgcaggaaaatctgggaaatccatcaaaaaatgaggataacgtgaaaagcgcgcctccacagtcccggctctcccggtgccgagcggcggcgttttttctttcattgtttctctgcctttttgtggtgttcgtcgtctcattcgtcatcccgtgtccagaccggccggcgtcacagcgaatgtggaggatagactacagtgccgctgttatctatgactttctggctgtggatgatataaacggggacaggatccaagatgttctttttctttataaaaacaccaacagcagcaacaatttcagccgatcctgtgtggacgaaggcttttcctctccctgcacctttgcagctgctgtgtcgggggccaacggcagcacgctctgggagagacctgtggcccaagacgtggccctcgtggagtgtgctgtgccccagccaagaggcagtgaggcaccttctgcctgcatcctggtgggcagacccagttctttcattgcagtcaacttgttcacaggggaaaccctgtggaaccacagcagcagcttcagcgggaatgcgtccatcctgagccctctgctgcaggtgcctgatgtggacggcgatggggccccagacctgctggttctcacccaggagcgggaggaggttagtggccacctctactccggcagcaccgggcaccagattggcctcagaggcagccttggtgtggacggggaaagtggcttcctccttcacgtcaccaggacaggtgcccactacatcctctttccctgcgcaagctccctctgcggctgctctgtgaagggtctctacgagaaggtgaccgggagcggcggcccgttcaagagtgacccgcactgggagagcatgctcaatgccaccacccgcaggatgctttcccacagctctggagcagtgcgctacctgatgcatgtcccagggaacgccggtgcagatgtgcttcttgtgggctcagaggccttcgtgctgctggacgggcaggagctgacgcctcgctggacacccaaggcagcccatgtcctgagaaaacccatcttcggccgctacaaaccagacaccttggctgtagccgttgaaaacggaactggcaccgacagacaggagaccggggaggcccggcacagcctgtacatgttccaccccaccctgccgcgcgtgctgctggagctggccaatgtctctacccacattgtcgcctttgacgccgtcctgtttgagccaagccgccacgccgcctacatccttctgacaggcccggcagactcagaggcacccggcctggtctctgtgatcaagcacaaggtgcgggaccttgtcccaagcagcagggtggtccgcctgggtgagggtgggccagacagtgaccaagccatcagggaccggttctcccggctgcggtaccagagtgaggcgtagaggcacgccagccagagcctgtggagagactccgcctgctgacactaaacgtcctgggaagtgggcccttccctgggtctctgcactgactcccccactcctgaccctggtgatggtcgccactgggcagcagcagccttaccagtcctccatgatcacacccagggacctgcatgggtgaggggacaccctgggcctctctcccgcccagcatcctccctgagtccccacacagggcctcactctgcaccccaccagggtcccgctcacaccaggcagccttcatagtggtctccctggccaccttgggcagagctgggtcatgcagcaccccatccttacccggtgccctctccttgccagcttctccccaggccagagcggccatcgcgtagaaagaaccagggtgtccccgggacaggccgtcccccaccccatcctgtagaagtccattccccttttccctcctgtgctctgtcccccaaggagtcatggaactcagggtactgggcctcaacgggaacctgagacagctccagcttcgcagcccttcccggagctacagggggatcctctagcatggggggtgtgacttggttcctttgaccaggtcctgtgaggaagcctggagcaagggtctcccccagcaggatgggtggggcctgctctggagctgagcccgtggccgctcacaggtgtccttagtggtgttgcagctgtctactggctgcatgtgctgtgaatatcccaaggaactggctgtggaatgcgtgtttgggtcagtctgtgccctctcagtagacactggagctgctctgtccctgaagaggccccgtgccccaggcatggcaagcgcctgcctctccccttccggtgctcacacgcccacgccgtgccacccgatgcaggactcacctctgtgccttgctgctcctgaggcccaagggcagccatggtgctctgtactgctcgggccgcccaggtcacagagcctgagcttcgtagccaaagcagcctgatgacccacccaccaaggaagaaagcagaataaacatttttgcactgcctgaaaaaccccggtggtcaggcgtgagcctagcgtg

SEQ ID NO: 313605 - DNA, 1977 bp, Homo sapiens
taacctgcgcccttctcccaactcgcgtgcctcacagaacccaggtgctgcacagccccgagatgtggcccttcttcaggaaagagcaaataagttggtcaagtacttgatgcttaaggactacacaaaggtgcccatcaagcgctcagaaatgctgagagatatcatccgtgaatacactgatgtttatccagaaatcattgaactgatgcatgtcccagggaacgccggtgcagatgtgcttcttgtgggctcagaggccttcgtgctgctggacgggcaggagctgacgcctcgctggacacccaaggcagcccatgtcctgagaaaacccatcttcggccgctacaaaccagacaccttggctgtagccgttgaaaacggaactggcaccgacagacagatcctgtttctggaccttggcactggagccgtcctgtgtagcctagccctcccgagcctccctgggggtccactgtccgccagcctgccgaccgcagaccaccgctcagccttcttcttctggggcctccacgagctggggagcaccagcgagacggagaccggggaggcccggcacagcctgtacatgttccaccccaccctgccgcgcgtgctgctggagctggccaatgtctctacccacattgtcgcctttgacgccgtcctgtttgagccaagccgccacgccgcctacatccttctgacaggcccggcagactcagaggcacccggcctggtctctgtgatcaagcacaaggtgcgggaccttgtcccaagcagcagggtggtccgcctgggtgagggtgggccagacagtgaccaagccatcagggaccggttctcccggctgcggtaccagagtgaggcgtagaggcacgccagccagagcctgtggagagactccgcctgctgacactaaacgtcctgggaagtgggcccttccctgggtctctgcactgactcccccactcctgaccctggtgatggtcgccactgggcagcagcagccttaccagtcctccatgatcacacccagggacctgcatgggtgaggggacaccctgggcctctctcccgcccagcatcctccctgagtccccacacagggcctcactctgcaccccaccagggtcccgctcacaccaggcagccttcatagtggtctccctggccaccttgggcagagctgggtcatgcagcaccccatccttacccggtgccctctccttgccagcttctccccaggccagagcggccatcgcgtagaaagaaccagggtgtccccgggacaggccgtcccccaccccatcctgtagaagtccattccccttttccctcctgtgctctgtcccccaaggagtcatggaactcagggtactgggcctcaacgggaacctgagacagctccagcttcgcagcccttcccggagctacagggggatcctctagcatggggggtgtgacttggttcctttgaccaggtcctgtgaggaagcctggagcaagggtctcccccagcaggatgggtggggcctgctctggagctgagcccgtggccgctcacaggtgtccttagtggtgttgcagctgtctactggctgcatgtgctgtgaatatcccaaggaactggctgtggaatgcgtgtttgggtcagtctgtgccctctcagtagacactggagctgctctgtccctgaagaggccccgtgccccaggcatggcaagcgcctgcctctccccttccggtgctcacacgcccacgccgtgccacccgatgcaggactcacctctgtgccttgctgctcctgaggcccaagggcagccatggtgctctgtactgctcgggccgcccaggtcacagagcctgagcttcgtagccaaagcagcctgatgacccacccaccaaggaagaaagcagaataaacatttttgcactgcctgaaaaaccccggtggtcaggcgtgagcctagcgtg

SEQ ID NO: 313606 - DNA, 1135 bp, Homo sapiens
agcgggggggggccagcggcgcgggcgggtgagaggccgcggcggcaggtccacctgggcttgcgaaggcacagattccccgtccacagctcacgaccagatgcaccagcaggagtccacatcgaggacgtcctccgggcactcccacgaccagtgaccaggagttaaactttgggatgtgcccgtgatgttggaccacaaggacttagaggccgaaatccaccccttgaaaaatgaagaaagaaaatcgcaggaaaatctgggaaatccatcaaaaaatgaggataacgtgaaaagcgcgcctccacagtcccggctctcccggtgccgagcggcggcgttttttctttcattgtttctctgcctttttgtggtgttcgtcgtctcattcgtcatcccgtgtccagaccggccggcgtcacagcgaatgtggaggatagactacagtgccgctgttatctatgactttctggctgtggatgatataaacggggacaggatccaagatgttctttttctttataaaaacaccaacagcagcaacaatttcagccgatcctgtgtggacgaaggcttttcctctccctgcacctttgcagctgctgtgtcgggggccaacggcagcacgctctgggagagacctgtggcccaagacgtggccctcgtggagtgtgctgtgccccagccaagaggcagtgaggcaccttctgcctgcatcctggtgggcagacccagttctttcattgcagtcaacttgttcacaggggcagtccgatgtcacctgccatggggtagcagagaggaggagcggcttggcccccggctgctcctggggtgtcagtggtggcagtgcccagggcgagcccagaacatgaaccagcactcggcccgtcaggggagatcggggcctgtcagtgcccctaagcctgaaggtgcaggtctccgagccccagcggagccggcctcgtggaaggacgagggaaagaatgcgtggtgcacggggccatgtgtgtgtgtgggctccttgcacctcatcgcggtctggaagatttctgtgcctagatttggtgaatgttcatatttcccttacaagctgtcattttaaggatatggaggagaataaagagcaggctga

SEQ ID NO: 313607 - DNA, 908 bp, Homo sapiens
aagcaggggcggggcctctggtggcggtcgggaactcggtgggaggcggcaacattgtttcaagttggccaaattgacaagagcgagaggtatactgcgttccatcccgacccggggccacggtactgggccctgtttccccctcctcggcccccgagagccaggtccgccttctgcagggttcccaggcccccgctccagggccgggctgacccgactcgctggcgcttcatggagaacttccaaaaggtggaaaagatcggagagggcacgtacggagttgtgtacaaagccagaaacaagttgacgggagaggtggtggcgcttaagaaaatccgcctggacacgtgagtggcctctgtacccgggactcctaactggggacctccttgattgtcccccccaaccccccacgggcgggtagccgtccagggaccggaagagagcagggagggacttctttagaagtggagaggtgggttgggggccagtagaaggtgaagagtatacttatactccctggggagagtatagggtggtgtggaatccatggaaaactttcttcccaaactgagccggatcgtgcccccaaatgtgcgactacagactcggggagagaaaggaggtctctgagatgaggtccaagactctccatggagtggagttatgtgggaaccggcgagaatcgcctttctgaatgaagagccctcttcactgccccaccctcaccttagaattctctcctctttccaaagaatggcagttgaacctcactggcccctctggggaggctgggggctactcctgcattttttcccctccattacagtctccctgcttcaccttcaccaggcggctttacttacctacccctgggaaaagaggagataatggccttaatatatcca

SEQ ID NO: 313608 - DNA, 2190 bp, Homo sapiens
aagcaggggcggggcctctggtggcggtcgggaactcggtgggaggcggcaacattgtttcaagttggccaaattgacaagagcgagaggtatactgcgttccatcccgacccggggccacggtactgggccctgtttccccctcctcggcccccgagagccaggtccgccttctgcagggttcccaggcccccgctccagggccgggctgacccgactcgctggcgcttcatggagaacttccaaaaggtggaaaagatcggagagggcacgtacggagttgtgtacaaagccagaaacaagttgacgggagaggtggtggcgcttaagaaaatccgcctggacactgagactgagggtgtgcccagtactgccatccgagagatctctctgcttaaggagcttaaccatcctaatattgtcaagctgctggatgtcattcacacagaaaataaactctacctggtttttgaatttctgcaccaagatctcaagaaattcatggatgcctctgctctcactggcattcctcttcccctcatcaagagctatctgttccagctgctccagggcctagctttctgccattctcatcgggtcctccaccgagaccttaaacctcagaatctgcttattaacacagagggggccatcaagctagcagactttggactagccagagcttttggagtccctgttcgtacttacacccatgaggtgactcgccgggccctattccctggagattctgagattgaccagctcttccggatctttcggactctggggaccccagatgaggtggtgtggccaggagttacttctatgcctgattacaagccaagtttccccaagtgggcccggcaagattttagtaaagttgtacctcccctggatgaagatggacggagcttgttatcgcaaatgctgcactacgaccctaacaagcggatttcggccaaggcagccctggctcaccctttcttccaggatgtgaccaagccagtaccccatcttcgactctgatagccttcttgaagcccccagccctaatctcaccctctcctccagtgtgggcttgaccaggcttggccttgggctatttggactcaggtgggccctctgaacttgccttaaacactcaccttctagtcttggccagccaactctgggaatacaggggtgaaaggggggaaccagtgaaaatgaaaggaagtttcagtattagatgcacttaagttagcctccaccaccctttcccccttctcttagttattgctgaagagggttggtataaaaataattttaaaaaagccttcctacacgttagatttgccgtaccaatctctgaatgccccataattattatttccagtgtttgggatgaccaggatcccaagcctcctgctgccacaatgtttataaaggccaaatgatagcgggggctaagttggtgcttttgagaaccaagtaaaacaaaaccactgggaggagtctattttaaagaattcggttgaaaaaatagatccaatcagtttataccctagttagtgttttgcctcacctaataggctgggagactgaagactcagcccgggtggggctgcagaaaaatgattggccccagtccccttgtttgtcccttctacaggcatgaggaatctgggaggccctgagacagggattgtgcttcattccaatctattgcttcaccatggccttatgaggcaggtgagagatgtttgaatttttctcttccttttagtattcttagttgttcagttgccaaggatccctgatcccattttcctctgacgtccacctcctaccccataggagttagaagttagggtttaggcatcattttgagaatgctgacactttttcagggctgtgattgagtgagggcatgggtaaaaatatttctttaaaagaaggatgaacaattatatttatatttcaggttatatccaatagtagagttggctttttttttttttttttggtcatagtgggtggatttgttgccatgtgcaccttggggttttgtaatgacagtgctaaaaaaaaaaagcattttttttttatgatttgtctctgtcacccttgtccttgagtgctcttgctattaacgttatttgtaatttagtttgtagctcattaaaaaaatgtgcctagttttatagttca

SEQ ID NO: 313609 - DNA, 2271 bp, Homo sapiens
aagcaggggcggggcctctggtggcggtcgggaactcggtgggaggcggcaacattgtttcaagttggccaaattgacaagagcgagaggtatactgcgttccatcccgacccggggccacggtactgggccctgtttccccctcctcggcccccgagagccaggtccgccttctgcagggttcccaggcccccgctccagggccgggctgacccgactcgctggcgcttcatggagaacttccaaaaggtggaaaagatcggagagggcacgtacggagttgtgtacaaagccagaaacaagcttaagaaaatccgcctggacactgagactgagggtgtgcccagtactgccatccgagagatctctctgcttaaggagcttaaccatcctaatattgtcaagctgctggatgtcattcacacagaaaataaactctacctggtttttgaatttctgcaccaagatctcaagaaattcatggatgcctctgctctcactggcattcctcttcccctcatcaagagctatctgttccagctgctccagggcctagctttctgccattctcatcgggtcctccaccgagaccttaaacctcagaatctgcttattaacacagagggggccatcaagctagcagactttggactagccagagcttttggagtccctgttcgtacttacacccatgaggtggtgaccctgtggtaccgagctcctgaaatcctcctgggctgcaaatattattccacagctgtggacatctggagcctgggctgcatctttgctgagatggtgactcgccgggccctattccctggagattctgagattgaccagctcttccggatctttcggactctggggaccccagatgaggtggtgtggccaggagttacttctatgcctgattacaagccaagtttccccaagtgggcccggcaagattttagtaaagttgtacctcccctggatgaagatggacggagcttgttatcgcaaatgctgcactacgaccctaacaagcggatttcggccaaggcagccctggctcaccctttcttccaggatgtgaccaagccagtaccccatcttcgactctgatagccttcttgaagcccccagccctaatctcaccctctcctccagtgtgggcttgaccaggcttggccttgggctatttggactcaggtgggccctctgaacttgccttaaacactcaccttctagtcttggccagccaactctgggaatacaggggtgaaaggggggaaccagtgaaaatgaaaggaagtttcagtattagatgcacttaagttagcctccaccaccctttcccccttctcttagttattgctgaagagggttggtataaaaataattttaaaaaagccttcctacacgttagatttgccgtaccaatctctgaatgccccataattattatttccagtgtttgggatgaccaggatcccaagcctcctgctgccacaatgtttataaaggccaaatgatagcgggggctaagttggtgcttttgagaaccaagtaaaacaaaaccactgggaggagtctattttaaagaattcggttgaaaaaatagatccaatcagtttataccctagttagtgttttgcctcacctaataggctgggagactgaagactcagcccgggtggggctgcagaaaaatgattggccccagtccccttgtttgtcccttctacaggcatgaggaatctgggaggccctgagacagggattgtgcttcattccaatctattgcttcaccatggccttatgaggcaggtgagagatgtttgaatttttctcttccttttagtattcttagttgttcagttgccaaggatccctgatcccattttcctctgacgtccacctcctaccccataggagttagaagttagggtttaggcatcattttgagaatgctgacactttttcagggctgtgattgagtgagggcatgggtaaaaatatttctttaaaagaaggatgaacaattatatttatatttcaggttatatccaatagtagagttggctttttttttttttttttggtcatagtgggtggatttgttgccatgtgcaccttggggttttgtaatgacagtgctaaaaaaaaaaagcattttttttttatgatttgtctctgtcacccttgtccttgagtgctcttgctattaacgttatttgtaatttagtttgtagctcattaaaaaaatgtgcctagttttatagttca

SEQ ID NO: 313610 - DNA, 2292 bp, Homo sapiens
aagcaggggcggggcctctggtggcggtcgggaactcggtgggaggcggcaacattgtttcaagttggccaaattgacaagagcgagaggtatactgcgttccatcccgacccggggccacggtactgggccctgtttccccctcctcggcccccgagagccaggtccgccttctgcagggttcccaggcccccgctccagggccgggctgacccgactcgctggcgcttcatggagaacttccaaaaggtggaaaagatcggagagggcacgtacggagttgtgtacaaagccagaaacaagttgacgggagaggtggtggcgcttaagaaaatccgcctggacactgagactgagggtgtgcccagtactgccatccgagagatctctctgcttaaggagcttaaccatcctaatattgtcaagctgctggatgtcattcacacagaaaataaactctacctggtttttgaatttctgcaccaagatctcaagaaattcatggatgcctctgctctcactggcattcctcttcccctcatcaagagctatctgttccagctgctccagggcctagctttctgccattctcatcgggtcctccaccgagaccttaaacctcagaatctgcttattaacacagagggggccatcaagctagcagactttggactagccagagcttttggagtccctgttcgtacttacacccatgaggtggtgaccctgtggtaccgagctcctgaaatcctcctgggctgcaaatattattccacagctgtggacatctggagcctgggctgcatctttgctgagatggtgactcgccgggccctattccctggagattctgagattgaccagctcttccggatctttcggactctggggaccccagatgaggtggtgtggccaggagttacttctatgcctgattacaagccaagtttccccaagtgggcccggcaagattttagtaaagttgtacctcccctggatgaagatggacggagcttgttatcgcaaatgctgcactacgaccctaacaagcggatttcggccaaggcagccctggctcaccctttcttccaggatgtgaccaagccagtaccccatcttcgactctgatagccttcttgaagcccccagccctaatctcaccctctcctccagtgtgggcttgaccaggcttggccttgggctatttggactcaggtgggccctctgaacttgccttaaacactcaccttctagtcttggccagccaactctgggaatacaggggtgaaaggggggaaccagtgaaaatgaaaggaagtttcagtattagatgcacttaagttagcctccaccaccctttcccccttctcttagttattgctgaagagggttggtataaaaataattttaaaaaagccttcctacacgttagatttgccgtaccaatctctgaatgccccataattattatttccagtgtttgggatgaccaggatcccaagcctcctgctgccacaatgtttataaaggccaaatgatagcgggggctaagttggtgcttttgagaaccaagtaaaacaaaaccactgggaggagtctattttaaagaattcggttgaaaaaatagatccaatcagtttataccctagttagtgttttgcctcacctaataggctgggagactgaagactcagcccgggtggggctgcagaaaaatgattggccccagtccccttgtttgtcccttctacaggcatgaggaatctgggaggccctgagacagggattgtgcttcattccaatctattgcttcaccatggccttatgaggcaggtgagagatgtttgaatttttctcttccttttagtattcttagttgttcagttgccaaggatccctgatcccattttcctctgacgtccacctcctaccccataggagttagaagttagggtttaggcatcattttgagaatgctgacactttttcagggctgtgattgagtgagggcatgggtaaaaatatttctttaaaagaaggatgaacaattatatttatatttcaggttatatccaatagtagagttggctttttttttttttttttggtcatagtgggtggatttgttgccatgtgcaccttggggttttgtaatgacagtgctaaaaaaaaaaagcattttttttttatgatttgtctctgtcacccttgtccttgagtgctcttgctattaacgttatttgtaatttagtttgtagctcattaaaaaaatgtgcctagttttatagttca

SEQ ID NO: 313611 - DNA, 2201 bp, Homo sapiens
aagcaggggcggggcctctggtggcggtcgggaactcggtgggaggcggcaacattgtttcaagttggccaaattgacaagagcgagaggtatactgcgttccatcccgacccggggccacggtactgggccctgtttccccctcctcggcccccgagagccaggtccgccttctgcagggttcccaggcccccgctccagggccgggctgacccgactcgctggcgcttcatggagaacttccaaaaggtggaaaagatcggagagggcacgtacggagttgtgtacaaagccagaaacaagttgacgggagaggtggtggcgcttaagaaaatccgcctggacactgagactgagggtgtgcccagtactgccatccgagagatctctctgcttaaggagcttaaccatcctaatattgtcaagctgctggatgtcattcacacagaaaataaactctacctggtttttgaatttctgcaccaagatctcaagaaattcatggatgcctctgctctcactggcattcctcttcccctcatcaagagctatctgttccagctgctccagggcctagctttctgccattctcatcgggtcctccaccgagaccttaaacctcagaatctgcttattaacacagagggggccatcaagctagcagactttggactagccagagcttttggagtccctgttcgtacttacacccatgaggtggtgaccctgtggtaccgagctcctgaaatcctcctgggctgcaaatattattccacagctgtggacatctggagcctgggctgcatctttgctgagatggtgactcgccgggccctattccctggagattctgagattgaccagctcttccggatctttcggactctggggaccccagatgaggtggtgtggccaggagttacttctatgcctgattacaagccaagtttccccaagtgggcccggcaagattttagtaaagttgtacctcccctggatgaagatggacggagcttgttatcgcaaatgctgcactacgaccctaacaagcggatttcggccaaggcagccctggctcaccctttcttccaggatgtgaccaagccagtaccccatcttcgactctgatagccttcttgaagcccccagccctaatctcaccctctcctccagtgtgggcttgaccaggcttggccttgggctatttggactcaggtgggccctctgaacttgccttaaacactcaccttctagtcttggccagccaactctgggaatacaggggtgaaaggggggaaccagtgaaaatgaaaggaagtttcagtattagatgcacttaagttagcctccaccaccctttcccccttctcttagttattgctgaagagggttggtataaaaataattttaaaaaagccttcctacacgttagatttgccgtaccaatctctgaatgccccataattattatttccagtgtttgggatgaccaggatcccaagcctcctgctgccacaatgtttataaaggccaaatgatagcgggggctaagttggtgcttttgagaaccaagtaaaacaaaaccactgggaggagtctattttaaagaattcggttgaaaaaatagatccaatcagtttataccctagttagtgttttgcctcacctaataggctgggagactgaagactcagcccgggtggggctgcagaaaaatgattggccccagtccccttgtttgtcccttctacaggcatgaggaatctgggaggccctgagacagggattgtgcttcattccaatctattgcttcaccatggccttatgaggcaggtgagagatgtttgaatttttctcttccttttagtattcttagttgttcagttgccaaggatccctgatcccattttcctctgacgtccacctcctaccccataggagttagaagttagggtttaggcatcattttgagaatgctgacactttttcagggctgtgattgagtgagggcatgggtaaaaatatttctttaaaagaaggatgaacaattatatttatatttcaggttatatccaatagtagagttggctttttttttttttttttggtcatagtgggtggaatagcaggttatacccctttcactagtataagaaaagcacgtgtggcaaggggatagggtggtatcaggggtcccccga

SEQ ID NO: 313612 - DNA, 718 bp, Homo sapiens
aagcaggggcggggcctctggtggcggtcgggaactcggtgggaggcggcaacattgtttcaagttggccaaattgacaagagcgagaggtatactgcgttccatcccgacccggggccacggtactgggccctgtttccccctcctcggcccccgagagccaggtccgccttctgcagggttcccaggcccccgctccagggccgggctgacccgactcgctggcgcttcatggagaacttccaaaaggtggaaaagatcggagagggcacgtacggagttgtgtacaaagccagaaacaagttgacgggagaggtggtggcgcttaagaaaatccgcctggacactgagactgagggtgtgcccagtactgccatccgagagatctctctgcttaaggagcttaaccatcctaatattgtcaagtaagtatgcgtctgagagaaaatatttctttaaaagaaggatgaacaattatatttatatttcaggttatatccaatagtagagttggctttttttttttttttttggtcatagtgggtggatttgttgccatgtgcaccttggggttttgtaatgacagtgctaaaaaaaaaaagcattttttttttatgatttgtctctgtcacccttgtccttgagtgctcttgctattaacgttatttgtaatttagtttgtagctcattaaaaaaatgtgcctagttttatagttca

SEQ ID NO: 313613 - DNA, 1342 bp, Homo sapiens
tctttcaccccaaaatataaaatcctatgcttataattttaaaatcctcagtgagctatggaatattgtgcatatttaatacccaccagcaacctagaagtagatggcatccatgtgtctgtcacaccgactttccaaacaacctcattcacccattactgactgctctggccctgggcgctctgacttcctcagaaaccacctctttggaaccttcctttccacaactttttttttaaaacttcacctcgagctttctccatcatcccagcctctctgcctgattccatctcatgtaaagtaaactcgtctgagaacctgcgatcaccttttaccaagcacatgataagccgtagcaacctagggactatgataactctggccttggcctaagtttacataagaacatgatagtttgctgacctcgtggagggaaatctaaatgaaatcaatatcttataacaaaactagccaagatcaggtatttccattctgagtataaaagcaactgatcttaagcaacaggcagagatgttaatgcagaagatatatttgtacaatcaaactcttgtgtgctggtgaaagactttacccccaaagtcaagtcaagtcaagacaaaaccaaagcaaaatggagaatgagtcgatgtaacaatgcgataaaaagaacagcattcaagcttcttgctgcaaatactgaactggaatctttttctttacaagtttgactagaagacagcagtgacacttccctaataagggaataccttcaggccacacctgtgttctgaagcaattcaaagttcaaggaatattggggggtggaggtgggggctgatatacattttgtcagtgaaaatggcccaaaaaacccaaagtaccccagtcgacctaaagtcagtgattcaactggaaggaaacctcaatgctgcctccagagctttttggaaatactcagatcctggccgcctttgtaaccttctctaaacgtcaggcctggacttaaaagattttttaaaacctccataagtagtccaggggcggtggctcacgcctgtaatcccagcactttgggaggccgaggcaggcggatcacaaggtcaacgagatcgagaccatcctggccaacatggtgaaaccctgtctgtaccaaaaatacaaaaattaattgggcatggtggtggacacctgtaatcccagctactagggaggctgaggcaggagaattgcttgaacctgggaggcggaggttgcagtgagccactgcactccagcctgatgacagagcaagactcagtctcaaaaataaataaaaataataaaacctccataagtaatcctg

SEQ ID NO: 313614 - DNA, 5486 bp, Homo sapiens
  misc_feature (3276)..(3276): n is a, c, g, or t
ggcttgctcgcgcgtgcgcaccagaagccagcagtggggttgcacacgcgcctcttcacgaggtggaaacaagatggaggattcggcctcggcctcgctgtcttctgcagccgctactggaacctccacctcgactccagcggccccgacagcacggaagcagctggataaagaacaggttagaaaggcagtggacgctctcttgacgcattgcaagtccaggaaaaacaattatgggttgcttttgaatgagaatgaaagtttatttttaatggtggtattatggaaaattccaagtaaagaactgagggtcagattgaccttgcctcatagtattcgatcagattcagaagatatctgtttatttacgaaggatgaacccaattcaactcctgaaaagacagaacagttttatagaaagcttttaaacaagcatggaattaaaaccgtttctcagattatctccctccaaactctaaagaaggaatataaatcctatgaagccaagctccgccttctgagcagttttgatttcttccttactgatgccagaattaggcggctcttaccctcactcattgggagacatttctatcaaagaaagaaagttccagtatctgtaaaccttctgtccaagaatttatcaagagagatcaatgactgtataggtggaacggtcttaaacatttctaaaagtggttcttgcagtgctatacgtattggtcacgttggaatgcaaattgagcacatcattgaaaacattgttgctgtcaccaaaggactttcagaaaaattgccagagaagtgggagagcgtgaaactcctgtttgtgaaaactgagaaatcggctgcacttcccatcttttcctcgtttgtcagcaattgggatgaagccaccaaaagatctttgcttaataagaagaaaaaagaggcaaggagaaaacgaagagaaagaaattttgaaaaacaaaaggagaggaagaagaagaggcagcaggctaggaagactgcatcagttcttagtaaagatgatgtggcacctgaaagtggtgatactacagtgaagaaacctgaatcaaagaaggaacagaccccagagcatgggaagaaaaaacgtggcagaggaaaagcccaagttaaagcaacaaatgaatccgaagacgaaatcccacagctggtaccaataggaaagaagactccagctaatgaaaaagtagagattcaaaaacatgccacaggaaagaagtctccagcaaagagtcctaatcccagcacacctcgtgggaagaaaagaaaggctttgccagcatctgagaccccaaaagctgcagagtctgagaccccagggaaaagcccagagaagaagccaaaaatcaaagaagaggcagtgaaggaaaaaagtccttcgctggggaaaaaagatgcgagacagactccaaaaaagccagaggccaagtttttcaccactcctagtaaatctgtgagaaaagcttcccacacccccaaaaaatggcccaaaaaacccaaagtaccccagtcgacctaaagtcagtgattcaactggaaggaaacctcaatgctgcctccagagctttttggaaatactcagatcctggccgcctttgtaaccttctctaaacgtcaggcctggacttaaaagattttttaaaacctccataagtagtccaggggcggtggctcacgcctgtaatcccagcactttgggaggccgaggcaggcggatcacaaggtcaacgagatcgagaccatcctggccaacatggtgaaaccctgtctgtaccaaaaatacaaaaattaattgggcatggtggtggacacctgtaatcccagctactagggaggctgaggcaggagaattgcttgaacctgggaggcggaggttgcagtgagccactgcactccagcctgatgacagagcaagactcagtctcaaaaataaataaaaataataaaacctccataagtaatcctgacatatgttcctgggtataatctgtttctaaattgtccttctgtgtatttgctaatgtaatagagggaaaaatagagtgcttctctgtggttgttcagcactttaggtagccaaggtgagaggattgcttgaggccaggagtttgagactagcctgggcaacttggtaaaaccccatctctacaaaagaaaaaaaaaaattagtgtggcatggtggcatgcatctgtgctcccagctcctcacgaggctgaggtggaaggatcaagtgagcgcaagaggttgaggctccagtgagccacgatcaccccactgtgctgtagcctgggtgacagtgtgagattctgtctcagaaaaaacaaagtataacattgctttgcttctgagtatactgttggctttccaaatcagtgggtctgacttgaggtctgtgatgtgacccttttcctcacctgctcaaccattattcacatggactccatcatattcatttgtagtcattcccagagtggcccagtgagggtctcgctgtatgagagtcggctacggaatttaggagaaacagaagtttcttggctttcatgctgagcttgttggtctaagcttatgagtcactggattagcatccatatgggaagggaaattaacatggagtcatttatacagggactaaattgaatcctacctaccggaggcaagaacatgatttatcttccataagccttatcctcttcctccttattcctcagtccatatggatttgcttatgtatgacaactccaaggaatcttggaagagtagattgctaacgtttccacaattgtcaagtatattctgaggcagtaaacacctttttaggtacgtggcctttcactggttgtgaattggtatgcatccgtagtagtaagttcacagattcactgcagtgcaggaatgttcttgcatgccaaagactcaactgctttcaaagataatgtgggtgctagatgcagtggcttacatctgtaaccctgttagggtgaccagacccaacaccaggtcgtgggggtgacaaagtccagtggagtcaaaggattgagaaaaagacagtttgagagagaagtaggaccagcagaccatcgggatggtggaggctgtgaaggccgtgagctctgggagcccacactatttattggtaatccaacaaagaaacagatggtgagaatgtgaaggtcagaagggcaccttgcattaagcacatgatttacagctgtgatggtttagcatttgctctgctacttgagatnatggagagcaggttcttttaactcaagttacagtcgatcctgggagagcaaggagccagcaagtctagacattccagagccacaggccctggattctatccaagccacgagggattttatgccctgggcttagattatggtgcgtcagggcagccttccaccctttagcacagagcttggtgttccaaagaccacaaggggttttagacccttgaccctggacatattccaagactcttttacattatgtcagaatgcaagccctgcctcagcttctcccaacactcagcttttcgcaacataatcccagcactttggaacgctgggtggattgcttgaacccaggagttcgagaccatcctgggcaatatggcaaaaccccatctttaccaaaaataagctgggtgtggtggaacatgcctgtggtcccagcttcttgggaggctgaggtgggaggattgcttgaacccgggaggtagaggctgcaatgggccatgatcacgatcctgcactccagcctgggcaacagagagagacagtccctggcccactgcccccttccctggcccagtctcaaaaaaaatgaggctgggcgtggtggctcacatctgtaatcccagccaaggctggcagatcacttgaggccaggagttctgagaccagcctggcttacatggtgaaaccccatctctactaaaaatacaaaaactagccaggcatggtgggaggcacctgtaatcccagctacttgggaggctgaagcaggagaatcactttaacccgggaggtggaggttgcagtgagctgagatcacaccactgcactccagcctgggcggcagagcaaaactgaaaaaaagagaaaaaaaaaaacatctagctctccctgaaattagaggagtctagcctgcttttgctgtttttttggtagcgagagtagcgggcagtgggggagatggtcttactctgttccccaggctggagtgcactagtgtcatcacagctccagcctcaatttcctgggctcaaggcgatcttcccacctcagcctcccaagtagctcagactacaggggcatgccatcacagctggccagtttttacgtcttgcgtagagatgggttttccctgtgttccctaggctgggctcgaactcctgggctcaagtcctcctgcctcagcctcccaaaatgttcagattacaggcatgaggcagcatgccaatcctgtttttgcattttagtaacacaaattgtaatgttaactttttaaattatgaaagcatctaaaatataaaattatttgtaaccccactgtccttttgggcttctataaatgaatatacatctaaaatgtgggggtttagcttaattgattgttttccatagaaactaggttttatgggaagatggttggatagacttgtttcacttaaaggtctgatttgtgtaggacaaacccacatatgtaatcgtgccagtctgttctctgcatgacataattttccagcaatagctgtgtggtttttgtaatcctatcatctagtcagttcaagatcttgcaacactgtgtgattctttgctccgtagttcagtcttgttgaacatgacacaggtgtttactttcctgttcttgcatctagtttcattctaataatgttctctgttgaaaaagctggcttcaatttattgagcaagatgctggtgttatcatctaacataaaacctatcttataataaagtgttgacacatgtaatgagtactgtactgaaaaatggtggtatgtatatggtttgtactgattatgtatcgcttttataccatcaaaaagttgaaaaatcataaagttgaatcatcctaaaatgggtacattctgtactatgtttccaaggcttcggaagtgttgcatacacattcctagccagctgatagtgctaggagccaacagtagtctcccccgggggccaagaggagggcgaaatctctactatggtatatgatgttctcgtgggccaagtatgagggtgatatttcattgttggcactgggtttctggaatccatcctcttcaccagggagatttaatgaaccaaatgagatctgatgggagaaatttgagtgtaacgtttttgttctgaaggaagtaattgagttttagttcatttgttttttaggaatcgtaataattaaaatttcattttaaatgccatga

SEQ ID NO: 313615 - DNA, 2670 bp, Homo sapiens
  misc_feature (2222)..(2222): n is a, c, g, or t
ggcttgctcgcgcgtgcgcaccagaagccagcagtggggttgcacacgcgcctcttcacgaggtggaaacaagatggaggattcggcctcggcctcgctgtcttctgcagccgctactggaacctccacctcgactccagcggccccgacagcacggaagcagctggataaagaacaggttagaaaggcagtggacgctctcttgacgcattgcaagtccaggaaaaacaattatgggttgcttttgaatgagaatgaaagtttatttttaatggtggtattatggaaaattccaagtaaagaactgagggtcagattgaccttgcctcatagtattcgatcagattcagaagatatctgtttatttacgaaggatgaacccaattcaactcctgaaaagacagaacagttttatagaaagcttttaaacaagcatggaattaaaaccgtttctcagattatctccctccaaactctaaagaaggaatataaatcctatgaagccaagctccgccttctgagcagttttgatttcttccttactgatgccagaattaggcggctcttaccctcactcattgggagacatttctatcaaagaaagaaagttccagtatctgtaaaccttctgtccaagaatttatcaagagagatcaatgactgtataggtggaacggtcttaaacatttctaaaagtggttcttgcagtgctatacgtattggtcacgttggaatgcaaattgagcacatcattgaaaacattgttgctgtcaccaaaggactttcagaaaaattgccagagaagtgggagagcgtgaaactcctgtttgtgaaaactgagaaatcggctgcacttcccatcttttcctcgtttgtcagcaattgggatgaagccaccaaaagatctttgcttaataagaagaaaaaagaggcaaggagaaaacgaagagaaagaaattttgaaaaacaaaaggagaggaagaagaagaggcagcaggctaggaagactgcatcagttcttagtaaagatgatgtggcacctgaaagtggtgatactacagtgaagaaacctgaatcaaagaaggaacagaccccagagcatgggaagaaaaaacgtggcagaggaaaagcccaagttaaagcaacaaatgaatccgaagacgaaatcccacagctggtaccaataggaaagaagactccagctaatgaaaaagtagagattcaaaaacatgccacaggaaagaagtctccagcaaagagtcctaatcccagcacacctcgtgggaagaaaagaaaggctttgccagcatctgagaccccaaaagctgcagagtctgagaccccagggaaaagcccagagaagaagccaaaaatcaaagaagaggcagtgaaggaaaaaagtccttcgctggggaaaaaagatgcgagacagactccaaaaaagccagaggccaagtttttcaccactcctagtaaatctgtgagaaaagcttcccacacccccaaaaaatggcccaaaaaacccaaagtaccccagtcgacctaaagtcagtgattcaactggaaggaaacctcaatgctgcctccagagctttttggaaatactcagatcctggccgcctttgtaaccttctctaaacgtcaggcctggacttaaaagattttttaaaacctccataagtagtccaggggcggtggctcacgcctgtaatcccagcactttgggaggccgaggcaggcggatcacaaggtcaacgagatcgagaccatcctggccaacatggtgaaaccctgtctgtaccaaaaatacaaaaattaattgggcatggtggtggacacctgtaatcccagctactagggaggctgaggcaggagaattgcttgaacctgggaggcggaggttgcagtgagccactgcactccagcctgatgacagagcaagactcagtctcaaaaataaataaaaataataaaacctccataagtaatcctgacatatgttcctgggtataatctgtttctaaattgtccttctgtgtatttgctaatgtaatagagggaaaaatagagtgcttctctgtggtgatactacagtgaagaaacctgaatcaaagaaggaacagaccccagagcatgggaagaaaaaacgtggcagaggaaaagcccaagttaaagcaacaaatgaatccgaagacgaaatcccacagctggtaccaataggnaagaagactccagctaatgaaaaagtagagattcaaaatcatgccacaggaaagaagtctccagcaaagagtcctaatcccagcacacctcgtgggaagaaaagaaaggcttagccagcatctgagaccccaaaagctgcagagtttgagaccccagggaaaagcccagagaagaagccaaaaatcaaagaagaggcagtgaaggaaaaaagtccttcgctggggaaaaaaggtgcgagacagactccaaaaaaagccagaggccaagtctttcaccactcctagtaaatctgtgagaaaagcttcccacacccccaaaaaatggccaaaaaaacccaaagtaccccagtcgacctaaagtcagtgattcaactggaaggaaacctcaatgctgcctccagaagtgctgaaattacaggtgtgagccaccatccccagtcgtaataca

SEQ ID NO: 313616 - DNA, 5433 bp, Homo sapiens
  misc_feature (3223)..(3223): n is a, c, g, or t
ggcttgctcgcgcgtgcgcaccagaagccagcagtggggttgcacacgcgcctcttcacgaggtggaaacaagatggaggattcggcctcggcctcgctgtcttctgcagccgctactggaacctccacctcgactccagcggccccgacagcacggaagcagctggataaagaacaggttagaaaggcagtggacgctctcttgacgcattgcaagtccaggaaaaacaattatgggttgcttttgaatgagaatgaaagtttatttttaatggtggtattatggaaaattccaagtaaagaactgagggtcagattgaccttgcctcatagtattcgatcagattcagaagatatctgtttatttacgaaggatgaacccaattcaactcctgaaaagacagaacagttttatagaaagcttttaaacaagcatggaattaaaaccgtttctcagattatctccctccaaactctaaagaaggaatataaatcctatgaagccaagctccgccttctgagcagttttgatttcttccttactgatgccagaattaggcggctcttaccctcactcattgggagacatttctatcaaagaaagaaagttccagtatctgtaaaccttctgtccaagaatttatcaagagagatcaatgactgtataggtggaacggtcttaaacatttctaaaagtggttcttgcagtgctatacgtattggtcacgttggaatgcaaattgagcacatcattgaaaacattgttgctgtcaccaaaggactttcagaaaaattgccagagaagtgggagagcgtgaaactcctgtttgtgaaaactgagaaatcggctgcacttcccatcttttcctcgtttgtcagcaattgggatgaagccaccaaaagatctttgcttaataagaagaaaaaagaggcaaggagaaaacgaagagaaagaaattttgaaaaacaaaaggagaggaagaagaagaggcagcaggctaggaagactgcatcagttcttagtaaagatgatgtggcacctgaaagtggtgatactacagtgaagaaacctgaatcaaagaaggaacagaccccagagcatgggaagaaaaaacgtggcagaggaaaagcccaagttaaagcaacaaatgaatccgaagacgaaatcccacagctggtaccaataggaaagaagactccagctaatgaaaaagtagagattcaaaaacatgccacaggaaagaagtctccagcaaagagtcctaatcccagcacacctcgtgggaagaaaagaaaggctttgccagcatctgagaccccaaaagctgcagagtctgagaccccagggaaaagcccagagaagaagccaaaaatcaaagaagaggcagtgaaggaaaaaagtccttcgctggggaaaaaagatgcgagacagactccaaaaaagccagaggccaagtttttcaccactcctagtaaatctgtgagaaaagcttcccacacccccaaaaaatggcccaaaaaacccaaagtaccccagtcgacctaaagtcagtgattcaactggaaggaaacctcaatgctgcctccagagctttttggaaatactcagatcctggccgcctttgtaaccttctctaaacgtcaggcctggactgtaatcccagcactttgggaggccgaggcaggcggatcacaaggtcaacgagatcgagaccatcctggccaacatggtgaaaccctgtctgtaccaaaaatacaaaaattaattgggcatggtggtggacacctgtaatcccagctactagggaggctgaggcaggagaattgcttgaacctgggaggcggaggttgcagtgagccactgcactccagcctgatgacagagcaagactcagtctcaaaaataaataaaaataataaaacctccataagtaatcctgacatatgttcctgggtataatctgtttctaaattgtccttctgtgtatttgctaatgtaatagagggaaaaatagagtgcttctctgtggttgttcagcactttaggtagccaaggtgagaggattgcttgaggccaggagtttgagactagcctgggcaacttggtaaaaccccatctctacaaaagaaaaaaaaaaattagtgtggcatggtggcatgcatctgtgctcccagctcctcacgaggctgaggtggaaggatcaagtgagcgcaagaggttgaggctccagtgagccacgatcaccccactgtgctgtagcctgggtgacagtgtgagattctgtctcagaaaaaacaaagtataacattgctttgcttctgagtatactgttggctttccaaatcagtgggtctgacttgaggtctgtgatgtgacccttttcctcacctgctcaaccattattcacatggactccatcatattcatttgtagtcattcccagagtggcccagtgagggtctcgctgtatgagagtcggctacggaatttaggagaaacagaagtttcttggctttcatgctgagcttgttggtctaagcttatgagtcactggattagcatccatatgggaagggaaattaacatggagtcatttatacagggactaaattgaatcctacctaccggaggcaagaacatgatttatcttccataagccttatcctcttcctccttattcctcagtccatatggatttgcttatgtatgacaactccaaggaatcttggaagagtagattgctaacgtttccacaattgtcaagtatattctgaggcagtaaacacctttttaggtacgtggcctttcactggttgtgaattggtatgcatccgtagtagtaagttcacagattcactgcagtgcaggaatgttcttgcatgccaaagactcaactgctttcaaagataatgtgggtgctagatgcagtggcttacatctgtaaccctgttagggtgaccagacccaacaccaggtcgtgggggtgacaaagtccagtggagtcaaaggattgagaaaaagacagtttgagagagaagtaggaccagcagaccatcgggatggtggaggctgtgaaggccgtgagctctgggagcccacactatttattggtaatccaacaaagaaacagatggtgagaatgtgaaggtcagaagggcaccttgcattaagcacatgatttacagctgtgatggtttagcatttgctctgctacttgagatnatggagagcaggttcttttaactcaagttacagtcgatcctgggagagcaaggagccagcaagtctagacattccagagccacaggccctggattctatccaagccacgagggattttatgccctgggcttagattatggtgcgtcagggcagccttccaccctttagcacagagcttggtgttccaaagaccacaaggggttttagacccttgaccctggacatattccaagactcttttacattatgtcagaatgcaagccctgcctcagcttctcccaacactcagcttttcgcaacataatcccagcactttggaacgctgggtggattgcttgaacccaggagttcgagaccatcctgggcaatatggcaaaaccccatctttaccaaaaataagctgggtgtggtggaacatgcctgtggtcccagcttcttgggaggctgaggtgggaggattgcttgaacccgggaggtagaggctgcaatgggccatgatcacgatcctgcactccagcctgggcaacagagagagacagtccctggcccactgcccccttccctggcccagtctcaaaaaaaatgaggctgggcgtggtggctcacatctgtaatcccagccaaggctggcagatcacttgaggccaggagttctgagaccagcctggcttacatggtgaaaccccatctctactaaaaatacaaaaactagccaggcatggtgggaggcacctgtaatcccagctacttgggaggctgaagcaggagaatcactttaacccgggaggtggaggttgcagtgagctgagatcacaccactgcactccagcctgggcggcagagcaaaactgaaaaaaagagaaaaaaaaaaacatctagctctccctgaaattagaggagtctagcctgcttttgctgtttttttggtagcgagagtagcgggcagtgggggagatggtcttactctgttccccaggctggagtgcactagtgtcatcacagctccagcctcaatttcctgggctcaaggcgatcttcccacctcagcctcccaagtagctcagactacaggggcatgccatcacagctggccagtttttacgtcttgcgtagagatgggttttccctgtgttccctaggctgggctcgaactcctgggctcaagtcctcctgcctcagcctcccaaaatgttcagattacaggcatgaggcagcatgccaatcctgtttttgcattttagtaacacaaattgtaatgttaactttttaaattatgaaagcatctaaaatataaaattatttgtaaccccactgtccttttgggcttctataaatgaatatacatctaaaatgtgggggtttagcttaattgattgttttccatagaaactaggttttatgggaagatggttggatagacttgtttcacttaaaggtctgatttgtgtaggacaaacccacatatgtaatcgtgccagtctgttctctgcatgacataattttccagcaatagctgtgtggtttttgtaatcctatcatctagtcagttcaagatcttgcaacactgtgtgattctttgctccgtagttcagtcttgttgaacatgacacaggtgtttactttcctgttcttgcatctagtttcattctaataatgttctctgttgaaaaagctggcttcaatttattgagcaagatgctggtgttatcatctaacataaaacctatcttataataaagtgttgacacatgtaatgagtactgtactgaaaaatggtggtatgtatatggtttgtactgattatgtatcgcttttataccatcaaaaagttgaaaaatcataaagttgaatcatcctaaaatgggtacattctgtactatgtttccaaggcttcggaagtgttgcatacacattcctagccagctgatagtgctaggagccaacagtagtctcccccgggggccaagaggagggcgaaatctctactatggtatatgatgttctcgtgggccaagtatgagggtgatatttcattgttggcactgggtttctggaatccatcctcttcaccagggagatttaatgaaccaaatgagatctgatgggagaaatttgagtgtaacgtttttgttctgaaggaagtaattgagttttagttcatttgttttttaggaatcgtaataattaaaatttcattttaaatgccatga

SEQ ID NO: 313617 - DNA, 1834 bp, Homo sapiens
ggcttgctcgcgcgtgcgcaccagaagccagcagtggggttgcacacgcgcctcttcacgaggtggaaacaagatggaggattcggcctcggcctcgctgtcttctgcagccgctactggaacctccacctcgactccagcggccccgacagcacggaagcagctggataaagaacaggttagaaaggcagtggacgctctcttgacgcattgcaagtccaggaaaaacaattatgggttgcttttgaatgagaatgaaagtttatttttaatggtggtattatggaaaattccaagtaaagaactgagggtcagattgaccttgcctcatagtattcgatcagattcagaagatatctgtttatttacgaaggatgaacccaattcaactcctgaaaagacagaacagttttatagaaagcttttaaacaagcatggaattaaaaccgtttctcagattatctccctccaaactctaaagaaggaatataaatcctatgaagccaagctccgccttctgagcagttttgatttcttccttactgatgccagaattaggcggctcttaccctcactcattgggagacatttctatcaaagaaagaaagttccagtatctgtaaaccttctgtccaagaatttatcaagagagatcaatgactgtataggtggaacggtcttaaacatttctaaaagtggttcttgcagtgctatacgtattggtcacgttggaatgcaaattgagcacatcattgaaaacattgttgctgtcaccaaaggactttcagaaaaattgccagagaagtgggagagcgtgaaactcctgtttgtgaaaactgagaaatcggctgcacttcccatcttttcctcgtttgtcagcaattgggatgaagccaccaaaagatctttgcttaataagaagaaaaaagaggcaaggagaaaacgaagagaaagaaattttgaaaaacaaaaggagaggaagaagaagaggcagcaggctaggaagactgcatcagttcttagtaaagatgatgtggcacctgaaagtggtgatactacagtgaagaaacctgaatcaaagaaggaacagaccccagagcatgggaagaaaaaacgtggcagaggaaaagcccaagttaaagcaacaaatgaatccgaagacgaaatcccacagctggtaccaataggaaagaagactccagctaatgaaaaagtagagattcaaaaacatgccacaggaaagaagtctccagcaaagagtcctaatcccagcacacctcgtgggaagaaaagaaaggctttgccagcatctgagaccccaaaagctgcagagtctgagaccccagggaaaagcccagagaagaagccaaaaatcaaagaagaggcagtgaaggaaaaaagtccttcgctggggaaaaaagatgcgagacagactccaaaaaagccagaggccaagtttttcaccactcctagtaaatctgtgagaaaagcttcccacacccccaaaaaatggcccaaaaaacccaaagtaccccagtcgacctaaagtcagtgattcaactggaaggaaacctcaatgctgcctccagagctttttggaaatactcagatcctggccaacatggtgaaaccctgtctgtaccaaaaatacaaaaattaattgggcatggtggtggacacctgtaatcccagctactagggaggctgaggcaggagaattgcttgaacctgggaggcggaggttgcagtgagccactgcactccagcctgatgacagagcaagactcagtctcaaaaataaataaaaataataaaacctccataagtaatcctg

SEQ ID NO: 313618 - DNA, 1518 bp, Homo sapiens
ggcttgctcgcgcgtgcgcaccagaagccagcagtggggttgcacacgcgcctcttcacgaggtggaaacaagatggaggattcggcctcggcctcgctgtcttctgcagccgctactggaacctccacctcgactccagcggccccgacagcacggaagcagctggataaagaacaggttagaaaggcagtggacgctctcttgacgcattgcaagtccaggaaaaacaattatgggttgcttttgaatgagaatgaaagtttatttttaatggtggtattatggaaaattccaagtaaagaactgagggtcagattgaccttgcctcatagtattcgatcagattcagaagatatctgtttatttacgaaggatgaacccaattcaactcctgaaaagacagaacagttttatagaaagcttttaaacaagcatggaattaaaaccgtttctcagattatctccctccaaactctaaagaaggaatataaatcctatgaagccaagctccgccttctgagcagttttgatttcttccttactgatgccagaattaggcggctcttaccctcactcattgggagacatttctatcaaagaaagaaagttccagtatctgtaaaccttctgtccaagaatttatcaagagagatcaatgactgtataggtggaacggtcttaaacatttctaaaagtggttcttgcagtgctatacgtattggtcacgttggaatgcaaattgagcacatcattgaaaacattgttgctgtcaccaaaggactttcagaaaaattgccagagaagtgggagagcgtgaaactcctgtttgtgaaaactgagaaatcggctgcacttcccatcttttcctcgtttgtcagcaattgggatgaagccaccaaaagatctttgcttaataagaagaaaaaagaggcaaggagaaaacgaagagaaagaaattttgaaaaacaaaaggagaggaagaagaagaggcagcaggctaggaagactgcatcagttcttagtaaagatgatgtggcacctgaaagtggtgatactacagtgaagaaacctgaatcaaagaaggaacagaccccagagcatgggaagaaaaaacgtggcagaggaaaagcccaagttaaagcaacaaatgaatccgaagacgaaatcccacagctggtaccaataggaaagaagactccagctaatgaaaaagtagagattcaaaaacatgccacaggaaagaagtctccagcaaagagtcctaatcccagcacacctcgtgggaagaaaagaaaggctttgccagcatctgagaccccaaaagctgcagagtctgagaccccagggaaaagcccagagaagaagccaaaaatcaaagaagaggcagtgaaggaaaaaagtccttcgctggggaaaaaagatgcgagacagactccaaaaaagccagaggccaagtttttcaccatgttggccaggatggtctcgatctcgttgaccttgtgatccgcctgcctcgg

SEQ ID NO: 313619 - DNA, 2438 bp, Homo sapiens
ggcttgctcgcgcgtgcgcaccagaagccagcagtggggttgcacacgcgcctcttcacgaggtggaaacaagatggaggattcggcctcggcctcgctgtcttctgcagccgctactggaacctccacctcgactccagcggccccgacagcacggaagcagctggataaagaacaggttagaaaggcagtggacgctctcttgacgcattgcaagtccaggaaaaacaattatgggttgcttttgaatgagaatgaaagtttatttttaatggtggtattatggaaaattccaagtaaagaactgagggtcagattgaccttgcctcatagtattcgatcagattcagaagatatctgtttatttacgaaggatgaacccaattcaactcctgaaaagacagaacagttttatagaaagcttttaaacaagcatggaattaaaaccgtttctcagattatctccctccaaactctaaagaaggaatataaatcctatgaagccaagctccgccttctgagcagttttgatttcttccttactgatgccagaattaggcggctcttaccctcactcattgggagacatttctatcaaagaaagaaagttccagtatctgtaaaccttctgtccaagaatttatcaagagagatcaatgactgtataggtggaacggtcttaaacatttctaaaagtggttcttgcagtgctatacgtattggtcacgttggaatgcaaattgagcacatcattgaaaacattgttgctgtcaccaaaggactttcagaaaaattgccagagaagtgggagagcgtgaaactcctgtttgtgaaaactgagaaatcggctgcacttcccatcttttcctcgtttgtcagcaattgggatgaagccaccaaaagatctttgcttaataagaagaaaaaagaggcaaggagaaaacgaagagaaagaaattttgaaaaacaaaaggagaggaagaagaagagcaggagaatcactttaacccgggaggtggaggttgcagtgagctgagatcacaccactgcactccagcctgggcggcagagcaaaactgaaaaaaagagaaaaaaaaaaacatctagctctccctgaaattagaggagtctagcctgcttttgctgtttttttggtagcgagagtagcgggcagtgggggagatggtcttactctgttccccaggctggagtgcactagtgtcatcacagctccagcctcaatttcctgggctcaaggcgatcttcccacctcagcctcccaagtagctcagactacaggggcatgccatcacagctggccagtttttacgtcttgcgtagagatgggttttccctgtgttccctaggctgggctcgaactcctgggctcaagtcctcctgcctcagcctcccaaaatgttcagattacaggcatgaggcagcatgccaatcctgtttttgcattttagtaacacaaattgtaatgttaactttttaaattatgaaagcatctaaaatataaaattatttgtaaccccactgtccttttgggcttctataaatgaatatacatctaaaatgtgggggtttagcttaattgattgttttccatagaaactaggttttatgggaagatggttggatagacttgtttcacttaaaggtctgatttgtgtaggacaaacccacatatgtaatcgtgccagtctgttctctgcatgacataattttccagcaatagctgtgtggtttttgtaatcctatcatctagtcagttcaagatcttgcaacactgtgtgattctttgctccgtagttcagtcttgttgaacatgacacaggtgtttactttcctgttcttgcatctagtttcattctaataatgttctctgttgaaaaagctggcttcaatttattgagcaagatgctggtgttatcatctaacataaaacctatcttataataaagtgttgacacatgtaatgagtactgtactgaaaaatggtggtatgtatatggtttgtactgattatgtatcgcttttataccatcaaaaagttgaaaaatcataaagttgaatcatcctaaaatgggtacattctgtactatgtttccaaggcttcggaagtgttgcatacacattcctagccagctgatagtgctaggagccaacagtagtctcccccgggggccaagaggagggcgaaatctctactatggtatatgatgttctcgtgggccaagtatgagggtgatatttcattgttggcactgggtttctggaatccatcctcttcaccagggagatttaatgaaccaaatgagatctgatgggagaaatttgagtgtaacgtttttgttctgaaggaagtaattgagttttagttcatttgttttttaggaatcgtaataattaaaatttcattttaaatgccatga

SEQ ID NO: 313620 - DNA, 5430 bp, Homo sapiens
  misc_feature (3220)..(3220): n is a, c, g, or t
ttttctcttcgttttctccttgcctcttttttcttcttattaagcaaagatcttttggtggcttcatcccaattgctgacaaacgaggaaaagatgggaagtgcagccgatttctcagttttcacaaacaggagtttcacgctctcttgacgcattgcaagtccaggaaaaacaattatgggttgcttttgaatgagaatgaaagtttatttttaatggtggtattatggaaaattccaagtaaagaactgagggtcagattgaccttgcctcatagtattcgatcagattcagaagatatctgtttatttacgaaggatgaacccaattcaactcctgaaaagacagaacagttttatagaaagcttttaaacaagcatggaattaaaaccgtttctcagattatctccctccaaactctaaagaaggaatataaatcctatgaagccaagctccgccttctgagcagttttgatttcttccttactgatgccagaattaggcggctcttaccctcactcattgggagacatttctatcaaagaaagaaagttccagtatctgtaaaccttctgtccaagaatttatcaagagagatcaatgactgtataggtggaacggtcttaaacatttctaaaagtggttcttgcagtgctatacgtattggtcacgttggaatgcaaattgagcacatcattgaaaacattgttgctgtcaccaaaggactttcagaaaaattgccagagaagtgggagagcgtgaaactcctgtttgtgaaaactgagaaatcggctgcacttcccatcttttcctcgtttgtcagcaattgggatgaagccaccaaaagatctttgcttaataagaagaaaaaagaggcaaggagaaaacgaagagaaagaaattttgaaaaacaaaaggagaggaagaagaagaggcagcaggctaggaagactgcatcagttcttagtaaagatgatgtggcacctgaaagtggtgatactacagtgaagaaacctgaatcaaagaaggaacagaccccagagcatgggaagaaaaaacgtggcagaggaaaagcccaagttaaagcaacaaatgaatccgaagacgaaatcccacagctggtaccaataggaaagaagactccagctaatgaaaaagtagagattcaaaaacatgccacaggaaagaagtctccagcaaagagtcctaatcccagcacacctcgtgggaagaaaagaaaggctttgccagcatctgagaccccaaaagctgcagagtctgagaccccagggaaaagcccagagaagaagccaaaaatcaaagaagaggcagtgaaggaaaaaagtccttcgctggggaaaaaagatgcgagacagactccaaaaaagccagaggccaagtttttcaccactcctagtaaatctgtgagaaaagcttcccacacccccaaaaaatggcccaaaaaacccaaagtaccccagtcgacctaaagtcagtgattcaactggaaggaaacctcaatgctgcctccagagctttttggaaatactcagatcctggccgcctttgtaaccttctctaaacgtcaggcctggacttaaaagattttttaaaacctccataagtagtccaggggcggtggctcacgcctgtaatcccagcactttgggaggccgaggcaggcggatcacaaggtcaacgagatcgagaccatcctggccaacatggtgaaaccctgtctgtaccaaaaatacaaaaattaattgggcatggtggtggacacctgtaatcccagctactagggaggctgaggcaggagaattgcttgaacctgggaggcggaggttgcagtgagccactgcactccagcctgatgacagagcaagactcagtctcaaaaataaataaaaataataaaacctccataagtaatcctgacatatgttcctgggtataatctgtttctaaattgtccttctgtgtatttgctaatgtaatagagggaaaaatagagtgcttctctgtggttgttcagcactttaggtagccaaggtgagaggattgcttgaggccaggagtttgagactagcctgggcaacttggtaaaaccccatctctacaaaagaaaaaaaaaaattagtgtggcatggtggcatgcatctgtgctcccagctcctcacgaggctgaggtggaaggatcaagtgagcgcaagaggttgaggctccagtgagccacgatcaccccactgtgctgtagcctgggtgacagtgtgagattctgtctcagaaaaaacaaagtataacattgctttgcttctgagtatactgttggctttccaaatcagtgggtctgacttgaggtctgtgatgtgacccttttcctcacctgctcaaccattattcacatggactccatcatattcatttgtagtcattcccagagtggcccagtgagggtctcgctgtatgagagtcggctacggaatttaggagaaacagaagtttcttggctttcatgctgagcttgttggtctaagcttatgagtcactggattagcatccatatgggaagggaaattaacatggagtcatttatacagggactaaattgaatcctacctaccggaggcaagaacatgatttatcttccataagccttatcctcttcctccttattcctcagtccatatggatttgcttatgtatgacaactccaaggaatcttggaagagtagattgctaacgtttccacaattgtcaagtatattctgaggcagtaaacacctttttaggtacgtggcctttcactggttgtgaattggtatgcatccgtagtagtaagttcacagattcactgcagtgcaggaatgttcttgcatgccaaagactcaactgctttcaaagataatgtgggtgctagatgcagtggcttacatctgtaaccctgttagggtgaccagacccaacaccaggtcgtgggggtgacaaagtccagtggagtcaaaggattgagaaaaagacagtttgagagagaagtaggaccagcagaccatcgggatggtggaggctgtgaaggccgtgagctctgggagcccacactatttattggtaatccaacaaagaaacagatggtgagaatgtgaaggtcagaagggcaccttgcattaagcacatgatttacagctgtgatggtttagcatttgctctgctacttgagatnatggagagcaggttcttttaactcaagttacagtcgatcctgggagagcaaggagccagcaagtctagacattccagagccacaggccctggattctatccaagccacgagggattttatgccctgggcttagattatggtgcgtcagggcagccttccaccctttagcacagagcttggtgttccaaagaccacaaggggttttagacccttgaccctggacatattccaagactcttttacattatgtcagaatgcaagccctgcctcagcttctcccaacactcagcttttcgcaacataatcccagcactttggaacgctgggtggattgcttgaacccaggagttcgagaccatcctgggcaatatggcaaaaccccatctttaccaaaaataagctgggtgtggtggaacatgcctgtggtcccagcttcttgggaggctgaggtgggaggattgcttgaacccgggaggtagaggctgcaatgggccatgatcacgatcctgcactccagcctgggcaacagagagagacagtccctggcccactgcccccttccctggcccagtctcaaaaaaaatgaggctgggcgtggtggctcacatctgtaatcccagccaaggctggcagatcacttgaggccaggagttctgagaccagcctggcttacatggtgaaaccccatctctactaaaaatacaaaaactagccaggcatggtgggaggcacctgtaatcccagctacttgggaggctgaagcaggagaatcactttaacccgggaggtggaggttgcagtgagctgagatcacaccactgcactccagcctgggcggcagagcaaaactgaaaaaaagagaaaaaaaaaaacatctagctctccctgaaattagaggagtctagcctgcttttgctgtttttttggtagcgagagtagcgggcagtgggggagatggtcttactctgttccccaggctggagtgcactagtgtcatcacagctccagcctcaatttcctgggctcaaggcgatcttcccacctcagcctcccaagtagctcagactacaggggcatgccatcacagctggccagtttttacgtcttgcgtagagatgggttttccctgtgttccctaggctgggctcgaactcctgggctcaagtcctcctgcctcagcctcccaaaatgttcagattacaggcatgaggcagcatgccaatcctgtttttgcattttagtaacacaaattgtaatgttaactttttaaattatgaaagcatctaaaatataaaattatttgtaaccccactgtccttttgggcttctataaatgaatatacatctaaaatgtgggggtttagcttaattgattgttttccatagaaactaggttttatgggaagatggttggatagacttgtttcacttaaaggtctgatttgtgtaggacaaacccacatatgtaatcgtgccagtctgttctctgcatgacataattttccagcaatagctgtgtggtttttgtaatcctatcatctagtcagttcaagatcttgcaacactgtgtgattctttgctccgtagttcagtcttgttgaacatgacacaggtgtttactttcctgttcttgcatctagtttcattctaataatgttctctgttgaaaaagctggcttcaatttattgagcaagatgctggtgttatcatctaacataaaacctatcttataataaagtgttgacacatgtaatgagtactgtactgaaaaatggtggtatgtatatggtttgtactgattatgtatcgcttttataccatcaaaaagttgaaaaatcataaagttgaatcatcctaaaatgggtacattctgtactatgtttccaaggcttcggaagtgttgcatacacattcctagccagctgatagtgctaggagccaacagtagtctcccccgggggccaagaggagggcgaaatctctactatggtatatgatgttctcgtgggccaagtatgagggtgatatttcattgttggcactgggtttctggaatccatcctcttcaccagggagatttaatgaaccaaatgagatctgatgggagaaatttgagtgtaacgtttttgttctgaaggaagtaattgagttttagttcatttgttttttaggaatcgtaataattaaaatttcattttaaatgccatga

SEQ ID NO: 313621 - DNA, 5384 bp, Homo sapiens
  misc_feature (3174)..(3174): n is a, c, g, or t
ggcttgctcgcgcgtgcgcaccagaagccagcagtggggttgcacacgcgcctcttcacgaggtggaaacaagatggaggattcggcctcggcctcgctgtcttctgcagccgctactggaacctccacctcgactccagcggccccgacagcacggaagcagctggataaagaacaggttagaaaggcagtggacgctctcttgacgcattgcaagtccaggaaaaacaattatgggttgcttttgaatgagaatgaaagtttatttttaatggtggtattatggaaaattccaagtaaagaactgagggtcagattgaccttgcctcatagtattcgatcagattcagaagatatctgtttatttacgaaggatgaacccaattcaactcctgaaaagacagaacagttttatagaaagcttttaaacaagcatggaattaaaaccgtttctcagattatctccctccaaactctaaagaaggaatataaatcctatgaagccaagctccgccttctgagcagttttgatttcttccttactgatgccagaattaggcggctcttaccctcactcattgggagacatttctatcaaagaaagaatgctatacgtattggtcacgttggaatgcaaattgagcacatcattgaaaacattgttgctgtcaccaaaggactttcagaaaaattgccagagaagtgggagagcgtgaaactcctgtttgtgaaaactgagaaatcggctgcacttcccatcttttcctcgtttgtcagcaattgggatgaagccaccaaaagatctttgcttaataagaagaaaaaagaggcaaggagaaaacgaagagaaagaaattttgaaaaacaaaaggagaggaagaagaagaggcagcaggctaggaagactgcatcagttcttagtaaagatgatgtggcacctgaaagtggtgatactacagtgaagaaacctgaatcaaagaaggaacagaccccagagcatgggaagaaaaaacgtggcagaggaaaagcccaagttaaagcaacaaatgaatccgaagacgaaatcccacagctggtaccaataggaaagaagactccagctaatgaaaaagtagagattcaaaaacatgccacaggaaagaagtctccagcaaagagtcctaatcccagcacacctcgtgggaagaaaagaaaggctttgccagcatctgagaccccaaaagctgcagagtctgagaccccagggaaaagcccagagaagaagccaaaaatcaaagaagaggcagtgaaggaaaaaagtccttcgctggggaaaaaagatgcgagacagactccaaaaaagccagaggccaagtttttcaccactcctagtaaatctgtgagaaaagcttcccacacccccaaaaaatggcccaaaaaacccaaagtaccccagtcgacctaaagtcagtgattcaactggaaggaaacctcaatgctgcctccagagctttttggaaatactcagatcctggccgcctttgtaaccttctctaaacgtcaggcctggacttaaaagattttttaaaacctccataagtagtccaggggcggtggctcacgcctgtaatcccagcactttgggaggccgaggcaggcggatcacaaggtcaacgagatcgagaccatcctggccaacatggtgaaaccctgtctgtaccaaaaatacaaaaattaattgggcatggtggtggacacctgtaatcccagctactagggaggctgaggcaggagaattgcttgaacctgggaggcggaggttgcagtgagccactgcactccagcctgatgacagagcaagactcagtctcaaaaataaataaaaataataaaacctccataagtaatcctgacatatgttcctgggtataatctgtttctaaattgtccttctgtgtatttgctaatgtaatagagggaaaaatagagtgcttctctgtggttgttcagcactttaggtagccaaggtgagaggattgcttgaggccaggagtttgagactagcctgggcaacttggtaaaaccccatctctacaaaagaaaaaaaaaaattagtgtggcatggtggcatgcatctgtgctcccagctcctcacgaggctgaggtggaaggatcaagtgagcgcaagaggttgaggctccagtgagccacgatcaccccactgtgctgtagcctgggtgacagtgtgagattctgtctcagaaaaaacaaagtataacattgctttgcttctgagtatactgttggctttccaaatcagtgggtctgacttgaggtctgtgatgtgacccttttcctcacctgctcaaccattattcacatggactccatcatattcatttgtagtcattcccagagtggcccagtgagggtctcgctgtatgagagtcggctacggaatttaggagaaacagaagtttcttggctttcatgctgagcttgttggtctaagcttatgagtcactggattagcatccatatgggaagggaaattaacatggagtcatttatacagggactaaattgaatcctacctaccggaggcaagaacatgatttatcttccataagccttatcctcttcctccttattcctcagtccatatggatttgcttatgtatgacaactccaaggaatcttggaagagtagattgctaacgtttccacaattgtcaagtatattctgaggcagtaaacacctttttaggtacgtggcctttcactggttgtgaattggtatgcatccgtagtagtaagttcacagattcactgcagtgcaggaatgttcttgcatgccaaagactcaactgctttcaaagataatgtgggtgctagatgcagtggcttacatctgtaaccctgttagggtgaccagacccaacaccaggtcgtgggggtgacaaagtccagtggagtcaaaggattgagaaaaagacagtttgagagagaagtaggaccagcagaccatcgggatggtggaggctgtgaaggccgtgagctctgggagcccacactatttattggtaatccaacaaagaaacagatggtgagaatgtgaaggtcagaagggcaccttgcattaagcacatgatttacagctgtgatggtttagcatttgctctgctacttgagatnatggagagcaggttcttttaactcaagttacagtcgatcctgggagagcaaggagccagcaagtctagacattccagagccacaggccctggattctatccaagccacgagggattttatgccctgggcttagattatggtgcgtcagggcagccttccaccctttagcacagagcttggtgttccaaagaccacaaggggttttagacccttgaccctggacatattccaagactcttttacattatgtcagaatgcaagccctgcctcagcttctcccaacactcagcttttcgcaacataatcccagcactttggaacgctgggtggattgcttgaacccaggagttcgagaccatcctgggcaatatggcaaaaccccatctttaccaaaaataagctgggtgtggtggaacatgcctgtggtcccagcttcttgggaggctgaggtgggaggattgcttgaacccgggaggtagaggctgcaatgggccatgatcacgatcctgcactccagcctgggcaacagagagagacagtccctggcccactgcccccttccctggcccagtctcaaaaaaaatgaggctgggcgtggtggctcacatctgtaatcccagccaaggctggcagatcacttgaggccaggagttctgagaccagcctggcttacatggtgaaaccccatctctactaaaaatacaaaaactagccaggcatggtgggaggcacctgtaatcccagctacttgggaggctgaagcaggagaatcactttaacccgggaggtggaggttgcagtgagctgagatcacaccactgcactccagcctgggcggcagagcaaaactgaaaaaaagagaaaaaaaaaaacatctagctctccctgaaattagaggagtctagcctgcttttgctgtttttttggtagcgagagtagcgggcagtgggggagatggtcttactctgttccccaggctggagtgcactagtgtcatcacagctccagcctcaatttcctgggctcaaggcgatcttcccacctcagcctcccaagtagctcagactacaggggcatgccatcacagctggccagtttttacgtcttgcgtagagatgggttttccctgtgttccctaggctgggctcgaactcctgggctcaagtcctcctgcctcagcctcccaaaatgttcagattacaggcatgaggcagcatgccaatcctgtttttgcattttagtaacacaaattgtaatgttaactttttaaattatgaaagcatctaaaatataaaattatttgtaaccccactgtccttttgggcttctataaatgaatatacatctaaaatgtgggggtttagcttaattgattgttttccatagaaactaggttttatgggaagatggttggatagacttgtttcacttaaaggtctgatttgtgtaggacaaacccacatatgtaatcgtgccagtctgttctctgcatgacataattttccagcaatagctgtgtggtttttgtaatcctatcatctagtcagttcaagatcttgcaacactgtgtgattctttgctccgtagttcagtcttgttgaacatgacacaggtgtttactttcctgttcttgcatctagtttcattctaataatgttctctgttgaaaaagctggcttcaatttattgagcaagatgctggtgttatcatctaacataaaacctatcttataataaagtgttgacacatgtaatgagtactgtactgaaaaatggtggtatgtatatggtttgtactgattatgtatcgcttttataccatcaaaaagttgaaaaatcataaagttgaatcatcctaaaatgggtacattctgtactatgtttccaaggcttcggaagtgttgcatacacattcctagccagctgatagtgctaggagccaacagtagtctcccccgggggccaagaggagggcgaaatctctactatggtatatgatgttctcgtgggccaagtatgagggtgatatttcattgttggcactgggtttctggaatccatcctcttcaccagggagatttaatgaaccaaatgagatctgatgggagaaatttgagtgtaacgtttttgttctgaaggaagtaattgagttttagttcatttgttttttaggaatcgtaataattaaaatttcattttaaatgccatga

SEQ ID NO: 313622 - DNA, 4885 bp, Homo sapiens
  misc_feature (2675)..(2675): n is a, c, g, or t
ggcttgctcgcgcgtgcgcaccagaagccagcagtggggttgcacacgcgcctcttcacgaggtggaaacaagatggaggattcggcctcggcctcgctgtcttctgcagccgctactggaacctccacctcgactccagcggccccgacagcacggaagcagctggataaagaacaggactttcagaaaaattgccagagaagtgggagagcgtgaaactcctgtttgtgaaaactgagaaatcggctgcacttcccatcttttcctcgtttgtcagcaattgggatgaagccaccaaaagatctttgcttaataagaagaaaaaagaggcaaggagaaaacgaagagaaagaaattttgaaaaacaaaaggagaggaagaagaagaggcagcaggctaggaagactgcatcagttcttagtaaagatgatgtggcacctgaaagtggtgatactacagtgaagaaacctgaatcaaagaaggaacagaccccagagcatgggaagaaaaaacgtggcagaggaaaagcccaagttaaagcaacaaatgaatccgaagacgaaatcccacagctggtaccaataggaaagaagactccagctaatgaaaaagtagagattcaaaaacatgccacaggaaagaagtctccagcaaagagtcctaatcccagcacacctcgtgggaagaaaagaaaggctttgccagcatctgagaccccaaaagctgcagagtctgagaccccagggaaaagcccagagaagaagccaaaaatcaaagaagaggcagtgaaggaaaaaagtccttcgctggggaaaaaagatgcgagacagactccaaaaaagccagaggccaagtttttcaccactcctagtaaatctgtgagaaaagcttcccacacccccaaaaaatggcccaaaaaacccaaagtaccccagtcgacctaaagtcagtgattcaactggaaggaaacctcaatgctgcctccagagctttttggaaatactcagatcctggccgcctttgtaaccttctctaaacgtcaggcctggacttaaaagattttttaaaacctccataagtagtccaggggcggtggctcacgcctgtaatcccagcactttgggaggccgaggcaggcggatcacaaggtcaacgagatcgagaccatcctggccaacatggtgaaaccctgtctgtaccaaaaatacaaaaattaattgggcatggtggtggacacctgtaatcccagctactagggaggctgaggcaggagaattgcttgaacctgggaggcggaggttgcagtgagccactgcactccagcctgatgacagagcaagactcagtctcaaaaataaataaaaataataaaacctccataagtaatcctgacatatgttcctgggtataatctgtttctaaattgtccttctgtgtatttgctaatgtaatagagggaaaaatagagtgcttctctgtggttgttcagcactttaggtagccaaggtgagaggattgcttgaggccaggagtttgagactagcctgggcaacttggtaaaaccccatctctacaaaagaaaaaaaaaaattagtgtggcatggtggcatgcatctgtgctcccagctcctcacgaggctgaggtggaaggatcaagtgagcgcaagaggttgaggctccagtgagccacgatcaccccactgtgctgtagcctgggtgacagtgtgagattctgtctcagaaaaaacaaagtataacattgctttgcttctgagtatactgttggctttccaaatcagtgggtctgacttgaggtctgtgatgtgacccttttcctcacctgctcaaccattattcacatggactccatcatattcatttgtagtcattcccagagtggcccagtgagggtctcgctgtatgagagtcggctacggaatttaggagaaacagaagtttcttggctttcatgctgagcttgttggtctaagcttatgagtcactggattagcatccatatgggaagggaaattaacatggagtcatttatacagggactaaattgaatcctacctaccggaggcaagaacatgatttatcttccataagccttatcctcttcctccttattcctcagtccatatggatttgcttatgtatgacaactccaaggaatcttggaagagtagattgctaacgtttccacaattgtcaagtatattctgaggcagtaaacacctttttaggtacgtggcctttcactggttgtgaattggtatgcatccgtagtagtaagttcacagattcactgcagtgcaggaatgttcttgcatgccaaagactcaactgctttcaaagataatgtgggtgctagatgcagtggcttacatctgtaaccctgttagggtgaccagacccaacaccaggtcgtgggggtgacaaagtccagtggagtcaaaggattgagaaaaagacagtttgagagagaagtaggaccagcagaccatcgggatggtggaggctgtgaaggccgtgagctctgggagcccacactatttattggtaatccaacaaagaaacagatggtgagaatgtgaaggtcagaagggcaccttgcattaagcacatgatttacagctgtgatggtttagcatttgctctgctacttgagatnatggagagcaggttcttttaactcaagttacagtcgatcctgggagagcaaggagccagcaagtctagacattccagagccacaggccctggattctatccaagccacgagggattttatgccctgggcttagattatggtgcgtcagggcagccttccaccctttagcacagagcttggtgttccaaagaccacaaggggttttagacccttgaccctggacatattccaagactcttttacattatgtcagaatgcaagccctgcctcagcttctcccaacactcagcttttcgcaacataatcccagcactttggaacgctgggtggattgcttgaacccaggagttcgagaccatcctgggcaatatggcaaaaccccatctttaccaaaaataagctgggtgtggtggaacatgcctgtggtcccagcttcttgggaggctgaggtgggaggattgcttgaacccgggaggtagaggctgcaatgggccatgatcacgatcctgcactccagcctgggcaacagagagagacagtccctggcccactgcccccttccctggcccagtctcaaaaaaaatgaggctgggcgtggtggctcacatctgtaatcccagccaaggctggcagatcacttgaggccaggagttctgagaccagcctggcttacatggtgaaaccccatctctactaaaaatacaaaaactagccaggcatggtgggaggcacctgtaatcccagctacttgggaggctgaagcaggagaatcactttaacccgggaggtggaggttgcagtgagctgagatcacaccactgcactccagcctgggcggcagagcaaaactgaaaaaaagagaaaaaaaaaaacatctagctctccctgaaattagaggagtctagcctgcttttgctgtttttttggtagcgagagtagcgggcagtgggggagatggtcttactctgttccccaggctggagtgcactagtgtcatcacagctccagcctcaatttcctgggctcaaggcgatcttcccacctcagcctcccaagtagctcagactacaggggcatgccatcacagctggccagtttttacgtcttgcgtagagatgggttttccctgtgttccctaggctgggctcgaactcctgggctcaagtcctcctgcctcagcctcccaaaatgttcagattacaggcatgaggcagcatgccaatcctgtttttgcattttagtaacacaaattgtaatgttaactttttaaattatgaaagcatctaaaatataaaattatttgtaaccccactgtccttttgggcttctataaatgaatatacatctaaaatgtgggggtttagcttaattgattgttttccatagaaactaggttttatgggaagatggttggatagacttgtttcacttaaaggtctgatttgtgtaggacaaacccacatatgtaatcgtgccagtctgttctctgcatgacataattttccagcaatagctgtgtggtttttgtaatcctatcatctagtcagttcaagatcttgcaacactgtgtgattctttgctccgtagttcagtcttgttgaacatgacacaggtgtttactttcctgttcttgcatctagtttcattctaataatgttctctgttgaaaaagctggcttcaatttattgagcaagatgctggtgttatcatctaacataaaacctatcttataataaagtgttgacacatgtaatgagtactgtactgaaaaatggtggtatgtatatggtttgtactgattatgtatcgcttttataccatcaaaaagttgaaaaatcataaagttgaatcatcctaaaatgggtacattctgtactatgtttccaaggcttcggaagtgttgcatacacattcctagccagctgatagtgctaggagccaacagtagtctcccccgggggccaagaggagggcgaaatctctactatggtatatgatgttctcgtgggccaagtatgagggtgatatttcattgttggcactgggtttctggaatccatcctcttcaccagggagatttaatgaaccaaatgagatctgatgggagaaatttgagtgtaacgtttttgttctgaaggaagtaattgagttttagttcatttgttttttaggaatcgtaataattaaaatttcattttaaatgccatga

SEQ ID NO: 313623 - DNA, 4831 bp, Homo sapiens
  misc_feature (2621)..(2621): n is a, c, g, or t
cagactgtgtttcacaaaagtctcttaactgtatactttagatagtcagattctgaaatgccggtatataatttactgcataaaatgcatgtttggctgtgagtcaaaaactgcggttgaggttccagtgctggttagggagtttgttctctgtatagatcgaggtccatttaggggcttatggataatcaaaactgcacgtggtacatctatgccgtttgttaaccaacagaactgttcctgctaaaatgtttgtatggtgttttttggtaggaggcaaggagaaaacgaagagaaagaaattttgaaaaacaaaaggagaggaagaagaagaggcagcaggctaggaagactgcatcagttcttagtaaagatgatgtggcacctgaaagtggtgatactacagtgaagaaacctgaatcaaagaaggaacagaccccagagcatgggaagaaaaaacgtggcagaggaaaagcccaagttaaagcaacaaatgaatccgaagacgaaatcccacagctggtaccaataggaaagaagactccagctaatgaaaaagtagagattcaaaaacatgccacaggaaagaagtctccagcaaagagtcctaatcccagcacacctcgtgggaagaaaagaaaggctttgccagcatctgagaccccaaaagctgcagagtctgagaccccagggaaaagcccagagaagaagccaaaaatcaaagaagaggcagtgaaggaaaaaagtccttcgctggggaaaaaagatgcgagacagactccaaaaaagccagaggccaagtttttcaccactcctagtaaatctgtgagaaaagcttcccacacccccaaaaaatggcccaaaaaacccaaagtaccccagtcgacctaaagtcagtgattcaactggaaggaaacctcaatgctgcctccagagctttttggaaatactcagatcctggccgcctttgtaaccttctctaaacgtcaggcctggacttaaaagattttttaaaacctccataagtagtccaggggcggtggctcacgcctgtaatcccagcactttgggaggccgaggcaggcggatcacaaggtcaacgagatcgagaccatcctggccaacatggtgaaaccctgtctgtaccaaaaatacaaaaattaattgggcatggtggtggacacctgtaatcccagctactagggaggctgaggcaggagaattgcttgaacctgggaggcggaggttgcagtgagccactgcactccagcctgatgacagagcaagactcagtctcaaaaataaataaaaataataaaacctccataagtaatcctgacatatgttcctgggtataatctgtttctaaattgtccttctgtgtatttgctaatgtaatagagggaaaaatagagtgcttctctgtggttgttcagcactttaggtagccaaggtgagaggattgcttgaggccaggagtttgagactagcctgggcaacttggtaaaaccccatctctacaaaagaaaaaaaaaaattagtgtggcatggtggcatgcatctgtgctcccagctcctcacgaggctgaggtggaaggatcaagtgagcgcaagaggttgaggctccagtgagccacgatcaccccactgtgctgtagcctgggtgacagtgtgagattctgtctcagaaaaaacaaagtataacattgctttgcttctgagtatactgttggctttccaaatcagtgggtctgacttgaggtctgtgatgtgacccttttcctcacctgctcaaccattattcacatggactccatcatattcatttgtagtcattcccagagtggcccagtgagggtctcgctgtatgagagtcggctacggaatttaggagaaacagaagtttcttggctttcatgctgagcttgttggtctaagcttatgagtcactggattagcatccatatgggaagggaaattaacatggagtcatttatacagggactaaattgaatcctacctaccggaggcaagaacatgatttatcttccataagccttatcctcttcctccttattcctcagtccatatggatttgcttatgtatgacaactccaaggaatcttggaagagtagattgctaacgtttccacaattgtcaagtatattctgaggcagtaaacacctttttaggtacgtggcctttcactggttgtgaattggtatgcatccgtagtagtaagttcacagattcactgcagtgcaggaatgttcttgcatgccaaagactcaactgctttcaaagataatgtgggtgctagatgcagtggcttacatctgtaaccctgttagggtgaccagacccaacaccaggtcgtgggggtgacaaagtccagtggagtcaaaggattgagaaaaagacagtttgagagagaagtaggaccagcagaccatcgggatggtggaggctgtgaaggccgtgagctctgggagcccacactatttattggtaatccaacaaagaaacagatggtgagaatgtgaaggtcagaagggcaccttgcattaagcacatgatttacagctgtgatggtttagcatttgctctgctacttgagatnatggagagcaggttcttttaactcaagttacagtcgatcctgggagagcaaggagccagcaagtctagacattccagagccacaggccctggattctatccaagccacgagggattttatgccctgggcttagattatggtgcgtcagggcagccttccaccctttagcacagagcttggtgttccaaagaccacaaggggttttagacccttgaccctggacatattccaagactcttttacattatgtcagaatgcaagccctgcctcagcttctcccaacactcagcttttcgcaacataatcccagcactttggaacgctgggtggattgcttgaacccaggagttcgagaccatcctgggcaatatggcaaaaccccatctttaccaaaaataagctgggtgtggtggaacatgcctgtggtcccagcttcttgggaggctgaggtgggaggattgcttgaacccgggaggtagaggctgcaatgggccatgatcacgatcctgcactccagcctgggcaacagagagagacagtccctggcccactgcccccttccctggcccagtctcaaaaaaaatgaggctgggcgtggtggctcacatctgtaatcccagccaaggctggcagatcacttgaggccaggagttctgagaccagcctggcttacatggtgaaaccccatctctactaaaaatacaaaaactagccaggcatggtgggaggcacctgtaatcccagctacttgggaggctgaagcaggagaatcactttaacccgggaggtggaggttgcagtgagctgagatcacaccactgcactccagcctgggcggcagagcaaaactgaaaaaaagagaaaaaaaaaaacatctagctctccctgaaattagaggagtctagcctgcttttgctgtttttttggtagcgagagtagcgggcagtgggggagatggtcttactctgttccccaggctggagtgcactagtgtcatcacagctccagcctcaatttcctgggctcaaggcgatcttcccacctcagcctcccaagtagctcagactacaggggcatgccatcacagctggccagtttttacgtcttgcgtagagatgggttttccctgtgttccctaggctgggctcgaactcctgggctcaagtcctcctgcctcagcctcccaaaatgttcagattacaggcatgaggcagcatgccaatcctgtttttgcattttagtaacacaaattgtaatgttaactttttaaattatgaaagcatctaaaatataaaattatttgtaaccccactgtccttttgggcttctataaatgaatatacatctaaaatgtgggggtttagcttaattgattgttttccatagaaactaggttttatgggaagatggttggatagacttgtttcacttaaaggtctgatttgtgtaggacaaacccacatatgtaatcgtgccagtctgttctctgcatgacataattttccagcaatagctgtgtggtttttgtaatcctatcatctagtcagttcaagatcttgcaacactgtgtgattctttgctccgtagttcagtcttgttgaacatgacacaggtgtttactttcctgttcttgcatctagtttcattctaataatgttctctgttgaaaaagctggcttcaatttattgagcaagatgctggtgttatcatctaacataaaacctatcttataataaagtgttgacacatgtaatgagtactgtactgaaaaatggtggtatgtatatggtttgtactgattatgtatcgcttttataccatcaaaaagttgaaaaatcataaagttgaatcatcctaaaatgggtacattctgtactatgtttccaaggcttcggaagtgttgcatacacattcctagccagctgatagtgctaggagccaacagtagtctcccccgggggccaagaggagggcgaaatctctactatggtatatgatgttctcgtgggccaagtatgagggtgatatttcattgttggcactgggtttctggaatccatcctcttcaccagggagatttaatgaaccaaatgagatctgatgggagaaatttgagtgtaacgtttttgttctgaaggaagtaattgagttttagttcatttgttttttaggaatcgtaataattaaaatttcattttaaatgccatga

SEQ ID NO: 313624 - DNA, 564 bp, Homo sapiens
ggcttgctcgcgcgtgcgcaccagaagccagcagtggggttgcacacgcgcctcttcacgaggtggaaacaagatggaggattcggcctcggcctcgctgtcttctgcagccgctactggaacctccacctcgactccagcggccccgacagcacggaagcagctggataaagaacaggttagaaaggcagtggacgctctcttgacgcattgcaagtccaggaaaaacaattatgggttgcttttgaatgagaatgaaagtttatttttaatggtggtattatggaaaattccaagtaaagaactgagggtcagattagacgagatcttgcgctgttgcccagctggagtacaatagtgagatctgtgttcactgcaacctcaacctccctgacctgactcaagtgatcctcccacctcagctactagggaggctgaggcaggagaattgcttgaacctgggaggcggaggttgcagtgagccactgcactccagcctgatgacagagcaagactcagtctcaaaaataaataaaaataataaaacctccataagtaatcctg

SEQ ID NO: 313625 - DNA, 1993 bp, Homo sapiens
ggcttgctcgcgcgtgcgcaccagaagccagcagtggggttgcacacgcgcctcttcacgaggtggaaacaagatggaggattcggcctcggcctcgctgtcttctgcagccgctactggaacctccacctcgactccagcggccccgacagcacggaagcagctggataaagaacaggttagaaaggcagtggacgctctcttgacgcattgcaagtccaggaaaaacaattatgggttgcttttgaatgagaatgaaagtttatttttaatggtggtattatggaaaattccaagtaaagaactgagggtcagattgaccttgcctcatagtattcgatcagattcagaagatatctgtttatttacgaaggatgaacccaattcaactcctgaaaagacagaacagttttatagaaagcttttaaacaagcatggaattaaaaccgtttctcagattatctccctccaaactctaaagaaggaatataaatcctatgaagccaagctccgccttctgagcagttttgatttcttccttactgatgccagaattaggcggctcttaccctcactcattgggagacatttctatcaaagaaagaaagttccagtatctgtaaaccttctgtccaagaatttatcaagagagatcaatgactgtataggtggaacggtcttaaacatttctaaaagtggttcttgcagtgctatacgtattggtcacgttggaatgcaaattgagcacatcattgaaaacattgttgctgtcaccaaaggactttcagaaaaattgccagagaagtgggagagcgtgaaactcctgtttgtgaaaactgagaaatcggctgcacttcccatcttttcctcgtttgtcagcaattgggatgaagccaccaaaagatctttgcttaataagaagaaaaaagaggcaaggagaaaacgaagagaaagaaattttgaaaaacaaaaggagaggaagaagaagaggcagcaggctaggaagactgcatcagttcttagtaaagatgatgtggcacctgaaagtggtgatactacagtgaagaaacctgaatcaaagaaggaacagaccccagagcatgggaagaaaaaacgtggcagaggaaaagcccaagttaaagcaacaaatgaatccgaagacgaaatcccacagctggtaccaataggaaagaagactccagctaatgaaaaagtagagattcaaaaacatgccacaggaaagaagtctccagcaaagagtcctaatcccagcacacctcgtgggaagaaaagaaaggctttgccagcatctgagaccccaaaagctgcagagtctgagaccccagggaaaagcccagagaagaagccaaaaatcaaagaagaggcagtgaaggaaaaaagtccttcgctggggaaaaaagatgcgagacagactccaaaaaagccagaggccaagtttttcaccactcctagtaaatctgtgagaaaagcttcccacacccccaaaaaatggcccaaaaaacccaaagtaccccagtcgacctaaagtcagtgattcaactggaaggaaacctcaatgctgcctccagagctttttggaaatactcagatcctggccgcctttgtaaccttctctaaacgtcaggcctggacttaaaagattttttaaaacctccataagtagtccaggggcggtggctcacgcctgtaatcccagcactttgggaggccgaggcaggcggatcacaaggtcaacgagatcgagaccatcctggccaacatggtgaaaccctgtctgtaccaaaaatacaaaaattaattgggcatggtggtggacacctgtaatcccagctactagggaggctgaggcaggagaattgcttgaacctgggaggcggaggttgcagtgagccactgcactccagcctgatgacagagcaagactcagtctcaaaaataaataaaaataataaaacctccataagtaatcctg

SEQ ID NO: 313626 - DNA, 5175 bp, Homo sapiens
  misc_feature (3276)..(3276): n is a, c, g, or t
ggcttgctcgcgcgtgcgcaccagaagccagcagtggggttgcacacgcgcctcttcacgaggtggaaacaagatggaggattcggcctcggcctcgctgtcttctgcagccgctactggaacctccacctcgactccagcggccccgacagcacggaagcagctggataaagaacaggttagaaaggcagtggacgctctcttgacgcattgcaagtccaggaaaaacaattatgggttgcttttgaatgagaatgaaagtttatttttaatggtggtattatggaaaattccaagtaaagaactgagggtcagattgaccttgcctcatagtattcgatcagattcagaagatatctgtttatttacgaaggatgaacccaattcaactcctgaaaagacagaacagttttatagaaagcttttaaacaagcatggaattaaaaccgtttctcagattatctccctccaaactctaaagaaggaatataaatcctatgaagccaagctccgccttctgagcagttttgatttcttccttactgatgccagaattaggcggctcttaccctcactcattgggagacatttctatcaaagaaagaaagttccagtatctgtaaaccttctgtccaagaatttatcaagagagatcaatgactgtataggtggaacggtcttaaacatttctaaaagtggttcttgcagtgctatacgtattggtcacgttggaatgcaaattgagcacatcattgaaaacattgttgctgtcaccaaaggactttcagaaaaattgccagagaagtgggagagcgtgaaactcctgtttgtgaaaactgagaaatcggctgcacttcccatcttttcctcgtttgtcagcaattgggatgaagccaccaaaagatctttgcttaataagaagaaaaaagaggcaaggagaaaacgaagagaaagaaattttgaaaaacaaaaggagaggaagaagaagaggcagcaggctaggaagactgcatcagttcttagtaaagatgatgtggcacctgaaagtggtgatactacagtgaagaaacctgaatcaaagaaggaacagaccccagagcatgggaagaaaaaacgtggcagaggaaaagcccaagttaaagcaacaaatgaatccgaagacgaaatcccacagctggtaccaataggaaagaagactccagctaatgaaaaagtagagattcaaaaacatgccacaggaaagaagtctccagcaaagagtcctaatcccagcacacctcgtgggaagaaaagaaaggctttgccagcatctgagaccccaaaagctgcagagtctgagaccccagggaaaagcccagagaagaagccaaaaatcaaagaagaggcagtgaaggaaaaaagtccttcgctggggaaaaaagatgcgagacagactccaaaaaagccagaggccaagtttttcaccactcctagtaaatctgtgagaaaagcttcccacacccccaaaaaatggcccaaaaaacccaaagtaccccagtcgacctaaagtcagtgattcaactggaaggaaacctcaatgctgcctccagagctttttggaaatactcagatcctggccgcctttgtaaccttctctaaacgtcaggcctggacttaaaagattttttaaaacctccataagtagtccaggggcggtggctcacgcctgtaatcccagcactttgggaggccgaggcaggcggatcacaaggtcaacgagatcgagaccatcctggccaacatggtgaaaccctgtctgtaccaaaaatacaaaaattaattgggcatggtggtggacacctgtaatcccagctactagggaggctgaggcaggagaattgcttgaacctgggaggcggaggttgcagtgagccactgcactccagcctgatgacagagcaagactcagtctcaaaaataaataaaaataataaaacctccataagtaatcctgacatatgttcctgggtataatctgtttctaaattgtccttctgtgtatttgctaatgtaatagagggaaaaatagagtgcttctctgtggttgttcagcactttaggtagccaaggtgagaggattgcttgaggccaggagtttgagactagcctgggcaacttggtaaaaccccatctctacaaaagaaaaaaaaaaattagtgtggcatggtggcatgcatctgtgctcccagctcctcacgaggctgaggtggaaggatcaagtgagcgcaagaggttgaggctccagtgagccacgatcaccccactgtgctgtagcctgggtgacagtgtgagattctgtctcagaaaaaacaaagtataacattgctttgcttctgagtatactgttggctttccaaatcagtgggtctgacttgaggtctgtgatgtgacccttttcctcacctgctcaaccattattcacatggactccatcatattcatttgtagtcattcccagagtggcccagtgagggtctcgctgtatgagagtcggctacggaatttaggagaaacagaagtttcttggctttcatgctgagcttgttggtctaagcttatgagtcactggattagcatccatatgggaagggaaattaacatggagtcatttatacagggactaaattgaatcctacctaccggaggcaagaacatgatttatcttccataagccttatcctcttcctccttattcctcagtccatatggatttgcttatgtatgacaactccaaggaatcttggaagagtagattgctaacgtttccacaattgtcaagtatattctgaggcagtaaacacctttttaggtacgtggcctttcactggttgtgaattggtatgcatccgtagtagtaagttcacagattcactgcagtgcaggaatgttcttgcatgccaaagactcaactgctttcaaagataatgtgggtgctagatgcagtggcttacatctgtaaccctgttagggtgaccagacccaacaccaggtcgtgggggtgacaaagtccagtggagtcaaaggattgagaaaaagacagtttgagagagaagtaggaccagcagaccatcgggatggtggaggctgtgaaggccgtgagctctgggagcccacactatttattggtaatccaacaaagaaacagatggtgagaatgtgaaggtcagaagggcaccttgcattaagcacatgatttacagctgtgatggtttagcatttgctctgctacttgagatnatggagagcaggttcttttaactcaagttacagtcgatcctgggagagcaaggagccagcaagtctagacattccagagccacaggccctggattctatccaagccacgagggattttatgccctgggcttagattatggtgcgtcagggcagccttccaccctttagcacagagcttggtgttccaaagaccacaaggggttttagacccttgaccctggacatattccaagactcttttacattatgtcagaatgcaagccctgcctcagcttctcccaacactcagcttttcgcaacataatcccagcactttggaacgctgggtggattgcttgaacccaggagttcgagaccatcctgggcaatatggcaaaaccccatctttaccaaaaataagctgggtgtggtggaacatgcctgtggtcccagcttcttgggaggctgaggtgggaggattgcttgaacccgggaggtagaggctgcaatgggccatgatcacgatcctgcactccagcctgggcaacagagagagacagtccctggcccactgcccccttccctggcccagtctcaaaaaaaatgaggctgggcgtggtggctcacatctgtaatcccagccaaggctggcagatcacttgaggccaggagttctgagaccagcctggcttacatggtgaaaccccatctctactaaaaatacaaaaactagccaggcatggtgggaggcacctgtaatcccaagtagctcagactacaggggcatgccatcacagctggccagtttttacgtcttgcgtagagatgggttttccctgtgttccctaggctgggctcgaactcctgggctcaagtcctcctgcctcagcctcccaaaatgttcagattacaggcatgaggcagcatgccaatcctgtttttgcattttagtaacacaaattgtaatgttaactttttaaattatgaaagcatctaaaatataaaattatttgtaaccccactgtccttttgggcttctataaatgaatatacatctaaaatgtgggggtttagcttaattgattgttttccatagaaactaggttttatgggaagatggttggatagacttgtttcacttaaaggtctgatttgtgtaggacaaacccacatatgtaatcgtgccagtctgttctctgcatgacataattttccagcaatagctgtgtggtttttgtaatcctatcatctagtcagttcaagatcttgcaacactgtgtgattctttgctccgtagttcagtcttgttgaacatgacacaggtgtttactttcctgttcttgcatctagtttcattctaataatgttctctgttgaaaaagctggcttcaatttattgagcaagatgctggtgttatcatctaacataaaacctatcttataataaagtgttgacacatgtaatgagtactgtactgaaaaatggtggtatgtatatggtttgtactgattatgtatcgcttttataccatcaaaaagttgaaaaatcataaagttgaatcatcctaaaatgggtacattctgtactatgtttccaaggcttcggaagtgttgcatacacattcctagccagctgatagtgctaggagccaacagtagtctcccccgggggccaagaggagggcgaaatctctactatggtatatgatgttctcgtgggccaagtatgagggtgatatttcattgttggcactgggtttctggaatccatcctcttcaccagggagatttaatgaaccaaatgagatctgatgggagaaatttgagtgtaacgtttttgttctgaaggaagtaattgagttttagttcatttgttttttaggaatcgtaataattaaaatttcattttaaatgccatga

SEQ ID NO: 313627 - DNA, 5327 bp, Homo sapiens
  misc_feature (3117)..(3117): n is a, c, g, or t
ggcttgctcgcgcgtgcgcaccagaagccagcagtggggttgcacacgcgcctcttcacgaggtggaaacaagatggaggattcggcctcggcctcgctgtcttctgcagccgctactggaacctccacctcgactccagcggccccgacagcacggaagcagctggataaagaacaggttagaaaggcagtggacgctctcttgacgcattgcaagtccaggaaaaacaattatgggttgcttttgaatgagaatgaaagtttatttttaatggtggtattatggaaaattccaagtaaagaactgagggtcagattgaccttgcctcatagtattcgatcagattcagaagatatctgtttatttacgaaggatgaacccaattcaactcctgaaaagacagaacagttttatagaaagcttttaaacaagcatggaattaaaaccgtttctcagattatctccctccaaactctaaagaaggaatataaatcctatgaagccaagctccgccttctgagcagttttgatttcttccttactgatgccagaattaggcggctcttaccctcactcattgggagacatttctatcaaagaaagaaagttccagtatctgtaaaccttctgtccaagaatttatcaagagagatcaatgactgtataggtggaacggtcttaaacatttctaaaagtggttcttgcagtgctatacgtattggtcacgttggaatgcaaattgagcacatcattgaaaacattgttgctgtcaccaaaggactttcagaaaaattgccagagaagtgggagagcgtgaaactcctgtttgtgaaaactgagaaatcggctgcacttcccatcttttcctcgtttgtcagcaattgggatgaagccaccaaaagatctttgcttaataagaagaaaaaagaggcaaggagaaaacgaagagaaagaaattttgaaaaacaaaaggagaggaagaagaagaggcagcaggctaggaagactgcatcagttcttagtaaagatgatgtggcacctgaaagtggtgatactacagtgaagaaacctgaatcaaagaaggaacagaccccagagcatgggaagaaaaaacgtggcagaggaaaagcccaagttaaagcaacaaatgaatccgaagacgaaatcccacagctggtaccaataggaaagaagactccagctaatgaaaaagtagagattcaaaaacatgccacaggaaagaagtctccagcaaagagtcctaatcccagcacacctcgtgggaagaaaagaaaggctttgccagcatctgagaccccaaaagctgcagagtctgagaccccagggaaaagcccagagaagaagccaaaaatcaaagaagaggcagtgaaggaaaaaagtccttcgctggggaaaaaagatgcgagacagactccaaaaaagccagaggccaagtttttcaccactcctagtaaatctgtgagaaaagcttcccacacccccaaaaaatggcccaaaaaacccaaagtaccccagtcgacctaaagtcagtgattcaactggaaggaaacctcaatgctgcctccagagctttttggaaatactcagatcctggccaacatggtgaaaccctgtctgtaccaaaaatacaaaaattaattgggcatggtggtggacacctgtaatcccagctactagggaggctgaggcaggagaattgcttgaacctgggaggcggaggttgcagtgagccactgcactccagcctgatgacagagcaagactcagtctcaaaaataaataaaaataataaaacctccataagtaatcctgacatatgttcctgggtataatctgtttctaaattgtccttctgtgtatttgctaatgtaatagagggaaaaatagagtgcttctctgtggttgttcagcactttaggtagccaaggtgagaggattgcttgaggccaggagtttgagactagcctgggcaacttggtaaaaccccatctctacaaaagaaaaaaaaaaattagtgtggcatggtggcatgcatctgtgctcccagctcctcacgaggctgaggtggaaggatcaagtgagcgcaagaggttgaggctccagtgagccacgatcaccccactgtgctgtagcctgggtgacagtgtgagattctgtctcagaaaaaacaaagtataacattgctttgcttctgagtatactgttggctttccaaatcagtgggtctgacttgaggtctgtgatgtgacccttttcctcacctgctcaaccattattcacatggactccatcatattcatttgtagtcattcccagagtggcccagtgagggtctcgctgtatgagagtcggctacggaatttaggagaaacagaagtttcttggctttcatgctgagcttgttggtctaagcttatgagtcactggattagcatccatatgggaagggaaattaacatggagtcatttatacagggactaaattgaatcctacctaccggaggcaagaacatgatttatcttccataagccttatcctcttcctccttattcctcagtccatatggatttgcttatgtatgacaactccaaggaatcttggaagagtagattgctaacgtttccacaattgtcaagtatattctgaggcagtaaacacctttttaggtacgtggcctttcactggttgtgaattggtatgcatccgtagtagtaagttcacagattcactgcagtgcaggaatgttcttgcatgccaaagactcaactgctttcaaagataatgtgggtgctagatgcagtggcttacatctgtaaccctgttagggtgaccagacccaacaccaggtcgtgggggtgacaaagtccagtggagtcaaaggattgagaaaaagacagtttgagagagaagtaggaccagcagaccatcgggatggtggaggctgtgaaggccgtgagctctgggagcccacactatttattggtaatccaacaaagaaacagatggtgagaatgtgaaggtcagaagggcaccttgcattaagcacatgatttacagctgtgatggtttagcatttgctctgctacttgagatnatggagagcaggttcttttaactcaagttacagtcgatcctgggagagcaaggagccagcaagtctagacattccagagccacaggccctggattctatccaagccacgagggattttatgccctgggcttagattatggtgcgtcagggcagccttccaccctttagcacagagcttggtgttccaaagaccacaaggggttttagacccttgaccctggacatattccaagactcttttacattatgtcagaatgcaagccctgcctcagcttctcccaacactcagcttttcgcaacataatcccagcactttggaacgctgggtggattgcttgaacccaggagttcgagaccatcctgggcaatatggcaaaaccccatctttaccaaaaataagctgggtgtggtggaacatgcctgtggtcccagcttcttgggaggctgaggtgggaggattgcttgaacccgggaggtagaggctgcaatgggccatgatcacgatcctgcactccagcctgggcaacagagagagacagtccctggcccactgcccccttccctggcccagtctcaaaaaaaatgaggctgggcgtggtggctcacatctgtaatcccagccaaggctggcagatcacttgaggccaggagttctgagaccagcctggcttacatggtgaaaccccatctctactaaaaatacaaaaactagccaggcatggtgggaggcacctgtaatcccagctacttgggaggctgaagcaggagaatcactttaacccgggaggtggaggttgcagtgagctgagatcacaccactgcactccagcctgggcggcagagcaaaactgaaaaaaagagaaaaaaaaaaacatctagctctccctgaaattagaggagtctagcctgcttttgctgtttttttggtagcgagagtagcgggcagtgggggagatggtcttactctgttccccaggctggagtgcactagtgtcatcacagctccagcctcaatttcctgggctcaaggcgatcttcccacctcagcctcccaagtagctcagactacaggggcatgccatcacagctggccagtttttacgtcttgcgtagagatgggttttccctgtgttccctaggctgggctcgaactcctgggctcaagtcctcctgcctcagcctcccaaaatgttcagattacaggcatgaggcagcatgccaatcctgtttttgcattttagtaacacaaattgtaatgttaactttttaaattatgaaagcatctaaaatataaaattatttgtaaccccactgtccttttgggcttctataaatgaatatacatctaaaatgtgggggtttagcttaattgattgttttccatagaaactaggttttatgggaagatggttggatagacttgtttcacttaaaggtctgatttgtgtaggacaaacccacatatgtaatcgtgccagtctgttctctgcatgacataattttccagcaatagctgtgtggtttttgtaatcctatcatctagtcagttcaagatcttgcaacactgtgtgattctttgctccgtagttcagtcttgttgaacatgacacaggtgtttactttcctgttcttgcatctagtttcattctaataatgttctctgttgaaaaagctggcttcaatttattgagcaagatgctggtgttatcatctaacataaaacctatcttataataaagtgttgacacatgtaatgagtactgtactgaaaaatggtggtatgtatatggtttgtactgattatgtatcgcttttataccatcaaaaagttgaaaaatcataaagttgaatcatcctaaaatgggtacattctgtactatgtttccaaggcttcggaagtgttgcatacacattcctagccagctgatagtgctaggagccaacagtagtctcccccgggggccaagaggagggcgaaatctctactatggtatatgatgttctcgtgggccaagtatgagggtgatatttcattgttggcactgggtttctggaatccatcctcttcaccagggagatttaatgaaccaaatgagatctgatgggagaaatttgagtgtaacgtttttgttctgaaggaagtaattgagttttagttcatttgttttttaggaatcgtaataattaaaatttcattttaaatgccatga

SEQ ID NO: 313628 - DNA, 1636 bp, Homo sapiens
ggcttgctcgcgcgtgcgcaccagaagccagcagtggggttgcacacgcgcctcttcacgaggtggaaacaagatggaggattcggcctcggcctcgctgtcttctgcagccgctactggaacctccacctcgactccagcggccccgacagcacggaagcagctggataaagaacaggttagaaaggcagtggacgctctcttgacgcattgcaagtccaggaaaaacaattatgggttgcttttgaatgagaatgaaagtttatttttaatggtggtattatggaaaattccaagtaaagaactgagggtcagattgaccttgcctcatagtattcgatcagattcagaagatatctgtttatttacgaaggatgaacccaattcaactcctgaaaagacagaacagttttatagaaagcttttaaacaagcatggaattaaaaccgtttctcagattatctccctccaaactctaaagaaggaatataaatcctatgaagccaagctccgccttctgagcagttttgatttcttccttactgatgccagaattaggcggctcttaccctcactcattgggagacatttctatcaaagaaagaaagttccagtatctgtaaaccttctgtccaagaatttatcaagagagatcaatgactgtataggtggaacggtcttaaacatttctaaaagtggttcttgcagtgctatacgtattggtcacgttggaatgcaaattgagcacatcattgaaaacattgttgctgtcaccaaaggactttcagaaaaattgccagagaagtgggagagcgtgaaactcctgtttgtgaaaactgagaaatcggctgcacttcccatcttttcctcgtttgtcagcaattgggatgaagccaccaaaagatctttgcttaataagaagaaaaaagaggcaaggagaaaacgaagagaaagaaattttgaaaaacaaaaggagaggaagaagaagaggcagcaggctaggaagactgcatcagttcttagtaaagatgatgtggcacctgaaagtggtgatactacagtgaagaaacctgaatcaaagaaggaacagaccccagagcatgggaagaaaaaacgtggcagaggaaaagcccaagttaaagcaacaaatgaatccgaagacgaaatcccacagctggtaccaataggaaagaagactccagctaatgaaaaagtagagattcaaaaacatgccacaggaaagaagtctccagcaaagagtcctaatcccagcacacctcgtgggaagaaaagaaaggctttgccagcatctgagaccccaaaagctgcagagtctgagaccccagggaaaagcccagagaagaagccaaaaatcaaagaagaggcagtgaaggaaaaaagtccttcgctggggaaaaaagatgcgagacagactccaaaaaagccagaggccaagtttttcaccactcctagtaaatctgtgagaaaagcttcccacacccccaaaaaatggcccaaaaaacccaaagtaccccagtcgacctaaagtcagtgattcaactggaaggaaacctcaatgctgcctccagaagtgctgaaattacaggtgtgagccaccatccccagtcgtaataca

SEQ ID NO: 313629 - DNA, 1271 bp, Homo sapiens
ggcttgctcgcgcgtgcgcaccagaagccagcagtggggttgcacacgcgcctcttcacgaggtggaaacaagatggaggattcggcctcggcctcgctgtcttctgcagccgctactggaacctccacctcgactccagcggccccgacagcacggaagcagctggataaagaacaggttagaaaggcagtggacgctctcttgacgcattgcaagtccaggaaaaacaattatgggttgcttttgaatgagaatgaaagtttatttttaatggtggtattatggaaaattccaagtaaagaactgagggtcagattgaccttgcctcatagtattcgatcagattcagaagatatctgtttatttacgaaggatgaacccaattcaactcctgaaaagacagaacagttttatagaaagcttttaaacaagcatggaattaaaaccgtttctcagattatctccctccaaactctaaagaaggaatataaatcctatgaagccaagctccgccttctgagcagttttgatttcttccttactgatgccagaattaggcggctcttaccctcactcattgggagacatttctatcaaagaaagaaagttccagtatctgtaaaccttctgtccaagaatttatcaagagagatcaatgactgtataggtggaacggtcttaaacatttctaaaagtggttcttgcagtgctatacgtattggtcacgttggaatgcaaattgagcacatcattgaaaacattgttgctgtcaccaaaggactttcagaaaaattgccagagaagtgggagagcgtgaaactcctgtttgtgaaaactgagaaatcggctgcacttcccatcttttcctcgtttgtcagcaattgggatgaagccaccaaaagatctttgcttaataagaagaaaaaagaggcaaggagaaaacgaagagaaagaaattttgaaaaacaaaaggagaggaagaagaagaggcagcaggctaggaagactgcatcagttcttagtaaagatgatgtggcacctgaaagtggtgatactacagtgaagaaacctgaatcaaagaaggaacagaccccagagcatgggaagaaaaaacgtggcagaggaaaagcccaagttaaagcaacaaatgaatccgaagacgaaatcccacagctggtaccaataggaaagaagactccagctaatgaaaaagtagagattcaaaaacataccacagtaaatgttccaactacagaagtctcaccactgt

SEQ ID NO: 313630 - DNA, 5346 bp, Homo sapiens
  misc_feature (3136)..(3136): n is a, c, g, or t
ggcttgctcgcgcgtgcgcaccagaagccagcagtggggttgcacacgcgcctcttcacgaggtggaaacaagatggaggattcggcctcggcctcgctgtcttctgcagccgctactggaacctccacctcgactccagcggccccgacagcacggaagcagctggataaagaacaggaccttgcctcatagtattcgatcagattcagaagatatctgtttatttacgaaggatgaacccaattcaactcctgaaaagacagaacagttttatagaaagcttttaaacaagcatggaattaaaaccgtttctcagattatctccctccaaactctaaagaaggaatataaatcctatgaagccaagctccgccttctgagcagttttgatttcttccttactgatgccagaattaggcggctcttaccctcactcattgggagacatttctatcaaagaaagaaagttccagtatctgtaaaccttctgtccaagaatttatcaagagagatcaatgactgtataggtggaacggtcttaaacatttctaaaagtggttcttgcagtgctatacgtattggtcacgttggaatgcaaattgagcacatcattgaaaacattgttgctgtcaccaaaggactttcagaaaaattgccagagaagtgggagagcgtgaaactcctgtttgtgaaaactgagaaatcggctgcacttcccatcttttcctcgtttgtcagcaattgggatgaagccaccaaaagatctttgcttaataagaagaaaaaagaggcaaggagaaaacgaagagaaagaaattttgaaaaacaaaaggagaggaagaagaagaggcagcaggctaggaagactgcatcagttcttagtaaagatgatgtggcacctgaaagtggtgatactacagtgaagaaacctgaatcaaagaaggaacagaccccagagcatgggaagaaaaaacgtggcagaggaaaagcccaagttaaagcaacaaatgaatccgaagacgaaatcccacagctggtaccaataggaaagaagactccagctaatgaaaaagtagagattcaaaaacatgccacaggaaagaagtctccagcaaagagtcctaatcccagcacacctcgtgggaagaaaagaaaggctttgccagcatctgagaccccaaaagctgcagagtctgagaccccagggaaaagcccagagaagaagccaaaaatcaaagaagaggcagtgaaggaaaaaagtccttcgctggggaaaaaagatgcgagacagactccaaaaaagccagaggccaagtttttcaccactcctagtaaatctgtgagaaaagcttcccacacccccaaaaaatggcccaaaaaacccaaagtaccccagtcgacctaaagtcagtgattcaactggaaggaaacctcaatgctgcctccagagctttttggaaatactcagatcctggccgcctttgtaaccttctctaaacgtcaggcctggacttaaaagattttttaaaacctccataagtagtccaggggcggtggctcacgcctgtaatcccagcactttgggaggccgaggcaggcggatcacaaggtcaacgagatcgagaccatcctggccaacatggtgaaaccctgtctgtaccaaaaatacaaaaattaattgggcatggtggtggacacctgtaatcccagctactagggaggctgaggcaggagaattgcttgaacctgggaggcggaggttgcagtgagccactgcactccagcctgatgacagagcaagactcagtctcaaaaataaataaaaataataaaacctccataagtaatcctgacatatgttcctgggtataatctgtttctaaattgtccttctgtgtatttgctaatgtaatagagggaaaaatagagtgcttctctgtggttgttcagcactttaggtagccaaggtgagaggattgcttgaggccaggagtttgagactagcctgggcaacttggtaaaaccccatctctacaaaagaaaaaaaaaaattagtgtggcatggtggcatgcatctgtgctcccagctcctcacgaggctgaggtggaaggatcaagtgagcgcaagaggttgaggctccagtgagccacgatcaccccactgtgctgtagcctgggtgacagtgtgagattctgtctcagaaaaaacaaagtataacattgctttgcttctgagtatactgttggctttccaaatcagtgggtctgacttgaggtctgtgatgtgacccttttcctcacctgctcaaccattattcacatggactccatcatattcatttgtagtcattcccagagtggcccagtgagggtctcgctgtatgagagtcggctacggaatttaggagaaacagaagtttcttggctttcatgctgagcttgttggtctaagcttatgagtcactggattagcatccatatgggaagggaaattaacatggagtcatttatacagggactaaattgaatcctacctaccggaggcaagaacatgatttatcttccataagccttatcctcttcctccttattcctcagtccatatggatttgcttatgtatgacaactccaaggaatcttggaagagtagattgctaacgtttccacaattgtcaagtatattctgaggcagtaaacacctttttaggtacgtggcctttcactggttgtgaattggtatgcatccgtagtagtaagttcacagattcactgcagtgcaggaatgttcttgcatgccaaagactcaactgctttcaaagataatgtgggtgctagatgcagtggcttacatctgtaaccctgttagggtgaccagacccaacaccaggtcgtgggggtgacaaagtccagtggagtcaaaggattgagaaaaagacagtttgagagagaagtaggaccagcagaccatcgggatggtggaggctgtgaaggccgtgagctctgggagcccacactatttattggtaatccaacaaagaaacagatggtgagaatgtgaaggtcagaagggcaccttgcattaagcacatgatttacagctgtgatggtttagcatttgctctgctacttgagatnatggagagcaggttcttttaactcaagttacagtcgatcctgggagagcaaggagccagcaagtctagacattccagagccacaggccctggattctatccaagccacgagggattttatgccctgggcttagattatggtgcgtcagggcagccttccaccctttagcacagagcttggtgttccaaagaccacaaggggttttagacccttgaccctggacatattccaagactcttttacattatgtcagaatgcaagccctgcctcagcttctcccaacactcagcttttcgcaacataatcccagcactttggaacgctgggtggattgcttgaacccaggagttcgagaccatcctgggcaatatggcaaaaccccatctttaccaaaaataagctgggtgtggtggaacatgcctgtggtcccagcttcttgggaggctgaggtgggaggattgcttgaacccgggaggtagaggctgcaatgggccatgatcacgatcctgcactccagcctgggcaacagagagagacagtccctggcccactgcccccttccctggcccagtctcaaaaaaaatgaggctgggcgtggtggctcacatctgtaatcccagccaaggctggcagatcacttgaggccaggagttctgagaccagcctggcttacatggtgaaaccccatctctactaaaaatacaaaaactagccaggcatggtgggaggcacctgtaatcccagctacttgggaggctgaagcaggagaatcactttaacccgggaggtggaggttgcagtgagctgagatcacaccactgcactccagcctgggcggcagagcaaaactgaaaaaaagagaaaaaaaaaaacatctagctctccctgaaattagaggagtctagcctgcttttgctgtttttttggtagcgagagtagcgggcagtgggggagatggtcttactctgttccccaggctggagtgcactagtgtcatcacagctccagcctcaatttcctgggctcaaggcgatcttcccacctcagcctcccaagtagctcagactacaggggcatgccatcacagctggccagtttttacgtcttgcgtagagatgggttttccctgtgttccctaggctgggctcgaactcctgggctcaagtcctcctgcctcagcctcccaaaatgttcagattacaggcatgaggcagcatgccaatcctgtttttgcattttagtaacacaaattgtaatgttaactttttaaattatgaaagcatctaaaatataaaattatttgtaaccccactgtccttttgggcttctataaatgaatatacatctaaaatgtgggggtttagcttaattgattgttttccatagaaactaggttttatgggaagatggttggatagacttgtttcacttaaaggtctgatttgtgtaggacaaacccacatatgtaatcgtgccagtctgttctctgcatgacataattttccagcaatagctgtgtggtttttgtaatcctatcatctagtcagttcaagatcttgcaacactgtgtgattctttgctccgtagttcagtcttgttgaacatgacacaggtgtttactttcctgttcttgcatctagtttcattctaataatgttctctgttgaaaaagctggcttcaatttattgagcaagatgctggtgttatcatctaacataaaacctatcttataataaagtgttgacacatgtaatgagtactgtactgaaaaatggtggtatgtatatggtttgtactgattatgtatcgcttttataccatcaaaaagttgaaaaatcataaagttgaatcatcctaaaatgggtacattctgtactatgtttccaaggcttcggaagtgttgcatacacattcctagccagctgatagtgctaggagccaacagtagtctcccccgggggccaagaggagggcgaaatctctactatggtatatgatgttctcgtgggccaagtatgagggtgatatttcattgttggcactgggtttctggaatccatcctcttcaccagggagatttaatgaaccaaatgagatctgatgggagaaatttgagtgtaacgtttttgttctgaaggaagtaattgagttttagttcatttgttttttaggaatcgtaataattaaaatttcattttaaatgccatga

SEQ ID NO: 313631 - DNA, 4956 bp, Homo sapiens
  misc_feature (2746)..(2746): n is a, c, g, or t
ggcttgctcgcgcgtgcgcaccagaagccagcagtggggttgcacacgcgcctcttcacgaggtggaaacaagatggaggattcggcctcggcctcgctgtcttctgcagccgctactggaacctccacctcgactccagcggccccgacagcacggaagcagctggataaagaacagtgctatacgtattggtcacgttggaatgcaaattgagcacatcattgaaaacattgttgctgtcaccaaaggactttcagaaaaattgccagagaagtgggagagcgtgaaactcctgtttgtgaaaactgagaaatcggctgcacttcccatcttttcctcgtttgtcagcaattgggatgaagccaccaaaagatctttgcttaataagaagaaaaaagaggcaaggagaaaacgaagagaaagaaattttgaaaaacaaaaggagaggaagaagaagaggcagcaggctaggaagactgcatcagttcttagtaaagatgatgtggcacctgaaagtggtgatactacagtgaagaaacctgaatcaaagaaggaacagaccccagagcatgggaagaaaaaacgtggcagaggaaaagcccaagttaaagcaacaaatgaatccgaagacgaaatcccacagctggtaccaataggaaagaagactccagctaatgaaaaagtagagattcaaaaacatgccacaggaaagaagtctccagcaaagagtcctaatcccagcacacctcgtgggaagaaaagaaaggctttgccagcatctgagaccccaaaagctgcagagtctgagaccccagggaaaagcccagagaagaagccaaaaatcaaagaagaggcagtgaaggaaaaaagtccttcgctggggaaaaaagatgcgagacagactccaaaaaagccagaggccaagtttttcaccactcctagtaaatctgtgagaaaagcttcccacacccccaaaaaatggcccaaaaaacccaaagtaccccagtcgacctaaagtcagtgattcaactggaaggaaacctcaatgctgcctccagagctttttggaaatactcagatcctggccgcctttgtaaccttctctaaacgtcaggcctggacttaaaagattttttaaaacctccataagtagtccaggggcggtggctcacgcctgtaatcccagcactttgggaggccgaggcaggcggatcacaaggtcaacgagatcgagaccatcctggccaacatggtgaaaccctgtctgtaccaaaaatacaaaaattaattgggcatggtggtggacacctgtaatcccagctactagggaggctgaggcaggagaattgcttgaacctgggaggcggaggttgcagtgagccactgcactccagcctgatgacagagcaagactcagtctcaaaaataaataaaaataataaaacctccataagtaatcctgacatatgttcctgggtataatctgtttctaaattgtccttctgtgtatttgctaatgtaatagagggaaaaatagagtgcttctctgtggttgttcagcactttaggtagccaaggtgagaggattgcttgaggccaggagtttgagactagcctgggcaacttggtaaaaccccatctctacaaaagaaaaaaaaaaattagtgtggcatggtggcatgcatctgtgctcccagctcctcacgaggctgaggtggaaggatcaagtgagcgcaagaggttgaggctccagtgagccacgatcaccccactgtgctgtagcctgggtgacagtgtgagattctgtctcagaaaaaacaaagtataacattgctttgcttctgagtatactgttggctttccaaatcagtgggtctgacttgaggtctgtgatgtgacccttttcctcacctgctcaaccattattcacatggactccatcatattcatttgtagtcattcccagagtggcccagtgagggtctcgctgtatgagagtcggctacggaatttaggagaaacagaagtttcttggctttcatgctgagcttgttggtctaagcttatgagtcactggattagcatccatatgggaagggaaattaacatggagtcatttatacagggactaaattgaatcctacctaccggaggcaagaacatgatttatcttccataagccttatcctcttcctccttattcctcagtccatatggatttgcttatgtatgacaactccaaggaatcttggaagagtagattgctaacgtttccacaattgtcaagtatattctgaggcagtaaacacctttttaggtacgtggcctttcactggttgtgaattggtatgcatccgtagtagtaagttcacagattcactgcagtgcaggaatgttcttgcatgccaaagactcaactgctttcaaagataatgtgggtgctagatgcagtggcttacatctgtaaccctgttagggtgaccagacccaacaccaggtcgtgggggtgacaaagtccagtggagtcaaaggattgagaaaaagacagtttgagagagaagtaggaccagcagaccatcgggatggtggaggctgtgaaggccgtgagctctgggagcccacactatttattggtaatccaacaaagaaacagatggtgagaatgtgaaggtcagaagggcaccttgcattaagcacatgatttacagctgtgatggtttagcatttgctctgctacttgagatnatggagagcaggttcttttaactcaagttacagtcgatcctgggagagcaaggagccagcaagtctagacattccagagccacaggccctggattctatccaagccacgagggattttatgccctgggcttagattatggtgcgtcagggcagccttccaccctttagcacagagcttggtgttccaaagaccacaaggggttttagacccttgaccctggacatattccaagactcttttacattatgtcagaatgcaagccctgcctcagcttctcccaacactcagcttttcgcaacataatcccagcactttggaacgctgggtggattgcttgaacccaggagttcgagaccatcctgggcaatatggcaaaaccccatctttaccaaaaataagctgggtgtggtggaacatgcctgtggtcccagcttcttgggaggctgaggtgggaggattgcttgaacccgggaggtagaggctgcaatgggccatgatcacgatcctgcactccagcctgggcaacagagagagacagtccctggcccactgcccccttccctggcccagtctcaaaaaaaatgaggctgggcgtggtggctcacatctgtaatcccagccaaggctggcagatcacttgaggccaggagttctgagaccagcctggcttacatggtgaaaccccatctctactaaaaatacaaaaactagccaggcatggtgggaggcacctgtaatcccagctacttgggaggctgaagcaggagaatcactttaacccgggaggtggaggttgcagtgagctgagatcacaccactgcactccagcctgggcggcagagcaaaactgaaaaaaagagaaaaaaaaaaacatctagctctccctgaaattagaggagtctagcctgcttttgctgtttttttggtagcgagagtagcgggcagtgggggagatggtcttactctgttccccaggctggagtgcactagtgtcatcacagctccagcctcaatttcctgggctcaaggcgatcttcccacctcagcctcccaagtagctcagactacaggggcatgccatcacagctggccagtttttacgtcttgcgtagagatgggttttccctgtgttccctaggctgggctcgaactcctgggctcaagtcctcctgcctcagcctcccaaaatgttcagattacaggcatgaggcagcatgccaatcctgtttttgcattttagtaacacaaattgtaatgttaactttttaaattatgaaagcatctaaaatataaaattatttgtaaccccactgtccttttgggcttctataaatgaatatacatctaaaatgtgggggtttagcttaattgattgttttccatagaaactaggttttatgggaagatggttggatagacttgtttcacttaaaggtctgatttgtgtaggacaaacccacatatgtaatcgtgccagtctgttctctgcatgacataattttccagcaatagctgtgtggtttttgtaatcctatcatctagtcagttcaagatcttgcaacactgtgtgattctttgctccgtagttcagtcttgttgaacatgacacaggtgtttactttcctgttcttgcatctagtttcattctaataatgttctctgttgaaaaagctggcttcaatttattgagcaagatgctggtgttatcatctaacataaaacctatcttataataaagtgttgacacatgtaatgagtactgtactgaaaaatggtggtatgtatatggtttgtactgattatgtatcgcttttataccatcaaaaagttgaaaaatcataaagttgaatcatcctaaaatgggtacattctgtactatgtttccaaggcttcggaagtgttgcatacacattcctagccagctgatagtgctaggagccaacagtagtctcccccgggggccaagaggagggcgaaatctctactatggtatatgatgttctcgtgggccaagtatgagggtgatatttcattgttggcactgggtttctggaatccatcctcttcaccagggagatttaatgaaccaaatgagatctgatgggagaaatttgagtgtaacgtttttgttctgaaggaagtaattgagttttagttcatttgttttttaggaatcgtaataattaaaatttcattttaaatgccatga

SEQ ID NO: 313632 - DNA, 4428 bp, Homo sapiens
agcgggcggccgagggaatgcgcgcagctcacaggccctgggagtgagctggtgcccggcgacctggcacccgcgcctggatatggggcgtctacatcgtcccaggagcagcaccagctacaggaacctgccgcatctgtttctgtttttcctcttcgtgggacccttcagctgcctcgggagttacagccgggccaccgagcttctgtacagcctaaacgagggactacccgcgggggtgctcatcggcagcctggccgaggacctgcggctgctgcccaggtctgcagggaggccggacccgcagtcgcagctgccagagcgcaccggtgctgagtggaacccccctctctccttcagcctggcctcccggggactgagtggccagtacgtgaccctagacaaccgctctggggagctgcacacttcagctcaggagatcgacagggaggccctgtgtgttgaagggggtggagggactgcgtggagcggcagcgtttccatctcctcctctccttctgactcttgtcttttgctgctggatgtgcttgtcctgcctcaggaatacttcaggtttgtgaaggtgaagatcgccatcagagacatcaatgacaacgccccgcagttccctgtttcccagatctcggtgtgggtcccggaaaatgcacctgtaaacacccgactggccatagagcatcctgctgtggacccagatgtaggcattaatgggggtacagacctatcgcttactggactaccatggtatgttcaccctggacgtggaggagaatgagaatggggagcgcaccccctacctaattgtcatgggtgctttggacagggaaacccaggaccagtatgtgagcatcatcacagctgaggatggtgggtctccaccacttttgggcagtgccactctcaccattggcatcagtgacattaatgacaattgccctctcttcacagactcacaaatcaatgtcactgtgtatgggaatgctacagtgggcaccccaattgcagctgtccaggctgtggataaagacttggggaccaatgctcaaattacttattcttacagtcagaaagttccacaagcatctaaggatttatttcacctggatgaaaacactggagtcattaaacttttcagtaagattggaggaagtgttctggagtcccacaagctcaccatccttgctaatggaccaggctgcatccctgctgtaatcactgctcttgtgtccattattaaagttattttcagaccccctgaaattgtccctcgttacatagcaaacgagatagatggtgttgtttatctgaaagaactggaacccgttaacactcccattgcgtttttcaccataagagatccagaaggtaaatacaaggttaactgctacctggatggtgaagggccgtttaggttatcaccttacaaaccatacaataatgaatatttactagagaccacaaaacctatggactatgagctacagcagttctatgaagtagctgtggtggcttggaactctgagggatttcatgtcaaaagggtcattaaagtgcaacttttagatgacaatgataatgctccaattttccttcaacccttaatagaactaaccatcgaagagaacaactcacccaatgcctttttgactaagctgtatgctacagatgccgacagcgaggagagaggccaagtttcatattttctgggacctgatgctccatcatatttttccttagacagtgtcacaggaattctgacagtttctactcagctggaccgagaagagaaagaaaagtacagatacactgtcagagctgttgactgtgggaagccacccagagaatcagtagccactgtggccctcacagtgttggataaaaatgacaacagtcctcggtttatcaacaaggacttcagcttttttgtgcctgaaaactttccaggctatggtgagattggagtaattagtgtaacagatgctgacgctggacgaaatggatgggtcgccctctctgtggtgaaccagagtgatatttttgtcatagatacaggaaagggtatgctgagggctaaagtctctttggacagagagcagcaaagctcctatactttgtgggttgaagctgttgatgggggtgagcctgccctctcctctacagcaaaaatcacaattctccttctagatatcaatgacaaccctcctcttgttttgtttcctcagtctaatatgtcttatctgttagtactgccttctactctgccaggctccccggttacagaagtctatgctgtcgacaaagacacaggcatgaatgctgtcatagcttacagcatcatagggagaagaggtcctaggcctgagtccttcaggattgaccctaaaactggcaacattactttggaagaggcattgctgcagacagattatgggctccatcgcttactggtgaaagtgagtgatcatggttatcccgagcctctccactccacagtcatggtgaacctatttgtcaatgacactgtcagtaatgagagttacattgagagtcttttaagaaaagaaccagagattaatatagaggagaaagaaccacaaatctcaatagaaccgactcataggaaggtagaatctgtgtcttgtatgcccaccttagtagctctgtctgtaataagcttgggttccatcacactggtcacagggatgggcatatacatctgtttaaggaaaggggaaaagcatcccagggaagatgaaaatttggaagtacagattccactgaaaggaaaaattgacttgcatatgcgagagagaaagccaatggatatttctaatatttgatatttcatggtggaataacacagagaaatgttttaactgactttggatcttcatcacctaaaaaagagtgtgttgatggcagttccaatgaaggacaactaatttataacttgttctatattgtaaatagctgtttacaggtttttaaatttaaattcagaggttataaaatgtgtacagcatttttaagtgaaaattagtactaacagctataggacttgtatttaaaaaaaaaaaaaaaaaaagcttggacatggtttgcagctttcatacaccaagcagttgattgataaaacctgggagtaaggtaagaaaaatggaacaaatttttatctaaaaattcctgtcaccacaagagggcatcagctgctcctttgcaggaaactggggtattgtacttggcagttgtacatgaaattaatgaaagagtatattttaaatatattgtttttaacattaaacaaatatgaaattaaagtaaattaaatttcaccctatttaaacatatgataaaaaaagaaatgcacttgtaaacagaatgtttattacctcataagtgcatatatagtttgaaagagaaggcattaaaaagaagtgcgattcctttttagcaaggataaaatcattgccttgtgttacagattcagcctgctgaagagtattccactttctgtgtactcgaattgctttctgtttgctttaccactgcacttgttattattacaagggaaatagatatatacatacatatatatattcttcattacaggaaatgtaactagatattgtgcccaagaaaaacagccagaagcaaagaaatgcttcaatctttagttgcttcataggcattcatgacattttagtgctttcacaacttgttggtcgtactttatacttgggttatatattagacttttataggcttgaaatcatccatcacataagaaaatagaaatcatattaaaagtgaattcttctagaggcttgtgtacactactggttgttttagttgggccttttatatgaaagttatactgtacttatctttttgttgttgtttaggtttgttgactaccatttctggcttcctttctttggttttggattaaatccaacagtttatttgtaagccctgcagcagatttctttgataatttagcttttactgaatctcttgcaatgaagaaagctatttcatcagtgatttatcactttcaattcattgtgtgagctggaaatattattttatatgagagctatagcaaaataatctgtataaacaaggaatgtgttagcttaaactggatcattttactttttggcatcatgcatctgtactgtaccaaaagtgtttatatgtctgcaaattaaaggtatatattttcataatttctttctcacttttagcattttatatttgaacatgggcttgttatttcactgaagtgcctgtcatttgtttgtttttagggttaaatgtgggtaacctgtagtattctgctatactaaagtttatattaaatgaattcattactcaattaaacattgggtaaattattaaaaaaatgtg

SEQ ID NO: 313633 - DNA, 2167 bp, Homo sapiens
agcgggcggccgagggaatgcgcgcagctcacaggccctgggagtgagctggtgcccggcgacctggcacccgcgcctggatatggggcgtctacatcgtcccaggagcagcaccagctacaggaacctgccgcatctgtttctgtttttcctcttcgtgggacccttcagctgcctcgggagttacagccgggccaccgagcttctgtacagcctaaacgagggactacccgcgggggtgctcatcggcagcctggccgaggacctgcggctgctgcccaggtctgcagggaggccggacccgcagtcgcagctgccagagcgcaccggtgctgagtggaacccccctctctccttcagcctggcctcccggggactgagtggccagtacgtgaccctagacaaccgctctggggagctgcacacttcagctcaggagatcgacagggaggccctgtgtgttgaagggggtggagggactgcgtggagcggcagcgtttccatctcctcctctccttctgactcttgtcttttgctgctggatgtgcttgtcctgcctcaggaatacttcaggtttgtgaaggtgaagatcgccatcagagacatcaatgacaacgccccgcagttccctgtttcccagatctcggtgtgggtcccggaaaatgcacctgtaaacacccgactggccatagagcatcctgctgtggacccagatgtaggcattaatgggggtacagacctatcgcttactggactaccatggtatgttcaccctggacgtggaggagaatgagaatggggagcgcaccccctacctaattgtcatgggtgctttggacagggaaacccaggaccagtatgtgagcatcatcacagctgaggatggtgggtctccaccacttttgggcagtgccactctcaccattggcatcagtgacattaatgacaattgccctctcttcacagactcacaaatcaatgtcactgtgtatgggaatgctacagtgggcaccccaattgcagctgtccaggctgtggataaagacttggggaccaatgctcaaattacttattcttacagtcagaaagttccacaagcatctaaggatttatttcacctggatgaaaacactggagtcattaaacttttcagtaagattggaggaagtgttctggagtcccacaagctcaccatccttgctaatggaccaggctgcatccctgctgtaatcactgctcttgtgtccattattaaagttattttcagaccccctgaaattgtccctcgttacatagcaaacgagatagatggtgttgtttatctgaaagaactggaacccgttaacactcccattgcgtttttcaccataagagatccagaaggtaaatacaaggttaactgctacctggatggtgaagggccgtttaggttatcaccttacaaaccatacaataatgaatatttactagagaccacaaaacctatggactatgagctacagcagttctatgaagtagctgtggtggcttggaactctgagggatttcatgtcaaaagggtcattaaagtgcaacttttagatgacaatgataatgctccaattttccttcaacccttaatagaactaaccatcgaagagaacaactcacccaatgcctttttgactaagctgtatgctacagatgccgacagcgaggagagaggccaagtttcatattttctgggacctgatgctccatcatatttttccttagacagtgtcacaggaattctgacagtttctactcagctggaccgagaagagaaagaaaagtacagatacactgtcagagctgttgactgtgggaagccacccagagaatcagtagccactgtggccctcacagtgttggataaaaatgacaacagtcctcggtttatcaacaaggacttcagcttttttgtgcctgaaaactttccaggctatggtgagattggagtaattagtgtaacagatgctgacgctggacgaaatggatgggtcgccctctctgtggtgaaccagagtgatatttttgtcatagaccccggaaaaagatacctctggggcaaaacttctttgggactatcgctccaaatgtacttaattcttttgtgcgtttaaagttcttgatggggggttattct

SEQ ID NO: 313634 - DNA, 2302 bp, Homo sapiens
ggccgagacgcgctgtgtgattgcctcggagagaggaaggcgctccagttccgggtcaggcccttctcccgcctccctcggccttagccatggcgagtagcggcggtgctggggcggcggcggcggccgcggcggcgaatctgaatgcggtgcgggagaccatggacgttctgcttgagatttcaagaattttgaatactggcttagatatggaaactctgtctatttgtgtacggctttgtgaacaaggaattaacccagaagctttatcatcggttattaaggagcttcgcaaggctactgaagcactgaaggctgctgaaaatatgacaagctgactttctggagaaattctgatgagatatgtcaagctctgcaagagggtttgaagattgcattgtagttgagaatgtacaatgaaattactgcatgcagcagtgtagaaaaattttactttttaaaagaattataaaaccatagctttataaatcagtggaaagtggcttacagagagaactatcagatgtgtttacatcacatcttattcactttttttaacagctctaatgctttggcattgctatgttcatatttatgtattccttatttatagctctgatagctttaattttctaagcagtctgtctatcagatgtgcacatctgctgtgccaggttgaagtatagtggaacccatcagtagtaatgtgtagtagttatgacttgttgacatttccattataaactttaattttgaattgtttatgcattataactgtggatttatattgtattgggctgaaagttgacaggatttcagccaccacttgtgaatttttatttagattcattatgtatatcagaatcttgttttttgaaataagagcatggaaaacatttcttgtaatctactcttgaacaaagaatatttagtttttcaaacagtttgttgggcagctaatagtgtgaaccaggtcatttttgtattgagtaaaaaaatcaaactttgagaaacttggattttaaaagtaatgacaatgcttaggttagtattatttgtaatttgaatcatttacatctaatgagaatgttagttgagaatgttttcttaaagttttatatcctataaataacggaataaaaaaatttgtaaaatgaaacaacaaacatgcaaaattcctatttacttttattacataaaagtaattttagtgcttacctaataaatcttgaatggttatttaataaattattagatgggtgatgtgtttcaaaagatacttgctattttttgaagaaataaggatttccagtcattaaacaaaactaaacaatcttattagatgggtgatgtgtttcaaaggatacttgctattttttgaagaaataaggatttccagtcattaaacaaaactaaacaatcaaatgttctatattaggaatctcaagtatggctttttttaaaaaacctttttaacatcttgatgtcaaggattataagtatggcttttcagaattgtttgtttgtcattattcttgcctttaaaattttaactcatcaaagtgaagattagaaataaattttagaaaatgtagaatagtattgattctgtccctgtaatagaatctcagtggagtttttttgcaaaactaatatggatttcatctgattttattatttcttaaattttagattttattgagtaccatttatatgattgtacaagcattcactctttagtagcattttttgtttttcagacaagctgaagtggttttattaagatttggtaatatttaaatagcaaccttctctgccttttttttttttaatatagaattttgaccattttgactttttaaatgcctggcatctttaccaaccaagtaaactggaagatctgttactggtagaacaggttgaggagacagtaggaatttgtaaaaagtcatttgatttataatcaacactacaaatactatgtgttatttataaaatcataaagaacacttttgtcagactccaaaatttgtatatacttccaggccataagagttgatggtattatttatgactttgtagattaagttatttatgtatgaaacaaagcaggaaaatatattgagaagggatcgtgtttacagaggacttctttaaagtgtcacatttttaaaatgtaaacatatttttaatgcatacttaagtaatatttaagaaactaaacaaaataatgatacaattgcagtgttgtgcttgttgtcaatgacaaaaataaaaccattttggtggtattggcctgtac

SEQ ID NO: 313635 - DNA, 2280 bp, Homo sapiens
ggccgagacgcgctgtgtgattgcctcggagagaggaaggcgctccagttccgggtcaggcccttctcccgcctccctcggccttagccatggcgagtagcggcgcgcggcggcgaatctgaatgcggtgcgggagaccatggacgttctgcttgagatttcaagaattttgaatactggcttagatatggaaactctgtctatttgtgtacggctttgtgaacaaggaattaacccagaagctttatcatcggttattaaggagcttcgcaaggctactgaagcactgaaggctgctgaaaatatgacaagctgactttctggagaaattctgatgagatatgtcaagctctgcaagagggtttgaagattgcattgtagttgagaatgtacaatgaaattactgcatgcagcagtgtagaaaaattttactttttaaaagaattataaaaccatagctttataaatcagtggaaagtggcttacagagagaactatcagatgtgtttacatcacatcttattcactttttttaacagctctaatgctttggcattgctatgttcatatttatgtattccttatttatagctctgatagctttaattttctaagcagtctgtctatcagatgtgcacatctgctgtgccaggttgaagtatagtggaacccatcagtagtaatgtgtagtagttatgacttgttgacatttccattataaactttaattttgaattgtttatgcattataactgtggatttatattgtattgggctgaaagttgacaggatttcagccaccacttgtgaatttttatttagattcattatgtatatcagaatcttgttttttgaaataagagcatggaaaacatttcttgtaatctactcttgaacaaagaatatttagtttttcaaacagtttgttgggcagctaatagtgtgaaccaggtcatttttgtattgagtaaaaaaatcaaactttgagaaacttggattttaaaagtaatgacaatgcttaggttagtattatttgtaatttgaatcatttacatctaatgagaatgttagttgagaatgttttcttaaagttttatatcctataaataacggaataaaaaaatttgtaaaatgaaacaacaaacatgcaaaattcctatttacttttattacataaaagtaattttagtgcttacctaataaatcttgaatggttatttaataaattattagatgggtgatgtgtttcaaaagatacttgctattttttgaagaaataaggatttccagtcattaaacaaaactaaacaatcttattagatgggtgatgtgtttcaaaggatacttgctattttttgaagaaataaggatttccagtcattaaacaaaactaaacaatcaaatgttctatattaggaatctcaagtatggctttttttaaaaaacctttttaacatcttgatgtcaaggattataagtatggcttttcagaattgtttgtttgtcattattcttgcctttaaaattttaactcatcaaagtgaagattagaaataaattttagaaaatgtagaatagtattgattctgtccctgtaatagaatctcagtggagtttttttgcaaaactaatatggatttcatctgattttattatttcttaaattttagattttattgagtaccatttatatgattgtacaagcattcactctttagtagcattttttgtttttcagacaagctgaagtggttttattaagatttggtaatatttaaatagcaaccttctctgccttttttttttttaatatagaattttgaccattttgactttttaaatgcctggcatctttaccaaccaagtaaactggaagatctgttactggtagaacaggttgaggagacagtaggaatttgtaaaaagtcatttgatttataatcaacactacaaatactatgtgttatttataaaatcataaagaacacttttgtcagactccaaaatttgtatatacttccaggccataagagttgatggtattatttatgactttgtagattaagttatttatgtatgaaacaaagcaggaaaatatattgagaagggatcgtgtttacagaggacttctttaaagtgtcacatttttaaaatgtaaacatatttttaatgcatacttaagtaatatttaagaaactaaacaaaataatgatacaattgcagtgttgtgcttgttgtcaatgacaaaaataaaaccattttggtggtattggcctgtac

SEQ ID NO: 313636 - DNA, 1945 bp, Homo sapiens
  misc_feature (1944)..(1945): n is a, c, g, or t
ggccgagacgcgctgtgtgattgcctcggagagaggaaggcgctccagttccgggtcaggcccttctcccgcctccctcggccttagccatggcgagtagcggcggtgctggggcggcggcggcggccgcggcggcgaatctgaatgcggtgcgggagaccatggacgttctgcttgagatttcaagaattttgaatactggcttagatatggaaactctgtctatttgtgtacggctttgtgaacaaggaattaacccagaagctttatcatcggttattaaggagcttcgcaaggctactgaagcactgaaggctgctgaaaatatgacaagctgactttctggagaaattctgatgagatatgtcaagctctgcaagagggtttgaagattgcattgtagttgagaatgtacaatgaaattactgcatgcagcagtgtagaaaaattttactttttaaaagaattataaaaccatagctttataaatcagtggaaagtggcttacagagagaactatcagatgtgtttacatcacatcttattcactttttttaacagctctaatgctttggcattgctatgttcatatttatgtattccttatttatagctctgatagctttaattttctaagcagtctgtctatcagatgtgcacatctgctgtgccaggttgaagtatagtggaacccatcagtagtaatgtgtagtagttatgacttgttgacatttccattataaactttaattttgaattgtttatgcattataactgtggatttatattgtattgggctgaaagttgacaggatttcagccaccacttgtgaatttttatttagattcattatgtatatcagaatcttgttttttgaaataagagcatggaaaacatttcttgtaatctactcttgaacaaagaatatttagtttttcaaacagtttgttgggcagctaatagtgtgaaccaggtcatttttgtattgagtaaaaaaatcaaactttgagaaacttggattttaaaagtaatgacaatgcttaggttagtattatttgtaatttgaatcatttacatctaatgagaatgttagttgagaatgttttcttaaagttttatatcctataaataacggaataaaaaaatttgtaaaatgaaacaacaaaaaaaaaaaacaaaaaaaaaaaaaaaaaaaaaaaaaagaaaagaaaaacaaaaacaaaaaaaacgacgcgcgagaacgagaacaaaagaaaacaacccacaacagaaaaaactacaaaggaaaccgccacaaggtagccggggtccccgaagaggccgggatacaagaacggagtccaccacagcagataacaccacggcagactctgggatgaaacatgggacgcacaaaatggccaactgctcggagaagaacaagacaatcgtatccgaagacggtcagagaaaaaagacataacagaaggcataccatagaagaccatctaaacgacacggagagaagcaaacaagagggctgcaacggaggctaatagtccacgacatagccgacacaatccaacagagcagaaaagcgaaacagaaataaaacacggaacagatatcaccaggaaagaaagaaatcaaagaatggtgacgatggatcataaagacgagaaaagcagcaaagacaagtcaattcaagtaactagacataagattacatgtacgtatgaagaaggaggtgtcaagtaggaatcgggtacgaaggcaaaaagagagttcgagcagcagatacgaagcgaacgtacgaaaaaaggggagcagagccgagaccagccgagcagagaggaaaacgaacagaataggtgaattaaagcaaagcagagagaaagtcaataagaagaaaggacaagaatcaaaatgggtaagtgatgacaatcgaacatgtctgctaagacnn

SEQ ID NO: 313637 - DNA, 349 bp, Homo sapiens
ggccgagacgcgctgtgtgattgcctcggagagaggaaggcgctccagttccgggtcaggcccttctcccgcctccctcggccttagccatggcgagtagcggcggtgctggggcggcggcggcggccgcggcggcgaatctgaatgcggtgcgggagaccatggacggtgagtttccgttgcgctccctttaccttgcgtgccttcccagagccaaggcccccaggcgggaatgagcctggggaggacttcaggtccccttagtgccccaaacggcatcttccaagatctttggtagggacctgccagggccgcagggctgatggccctatcccttgagagttgtctc

SEQ ID NO: 313638 - DNA, 379 bp, Homo sapiens
gtttatatttatatttaagtttctaaaactaagtaaaggcaagaaagtattacatgcagatttccaaaacctgggatgctatgctaattccttggtattgtgcagtgatatataaattaatgaaagtactatatgcatatttttaaatgctgtaagccttaagttttttttttttttgtatcttttttcagttctgcttgagatttcaagaattttgaatactggcttagatatggaaactctgtctatttgtgtacggctttgtgaacaaggaattaacccagaagctttatcatcggttattaaggagcttcgcaaggctactgaagcactgaaggttggagattcctattagttcattctaaataaagatgctttt

SEQ ID NO: 313639 - DNA, 798 bp, Homo sapiens
tttttttcagatgatgtctcactctgtcacccaagatggagtgcaatggcacgatctcagctcactgcaacctctgcctcccaggttcaagcaattatcctgcctcagccacccgagtagctgagattacaggcctctgccaccatgctcagctattttttgtatttttagtagagacggggtttcaccatgttgggcaggctagtcttggaactactgacctcaggtgatccgcccactttggcctcccgaaagtgctgggattacagtcatgagccaccatgcccagcctatttatttctgattctttaagggtgactggacgtgttgatcagcgctcgctgggatttggctgacgtggccccagccccgcctccctccccaccccacaatggcagaagaaactggacagagtaaattagctgcagccaagaaaaagttcaaagaatattggcagagaaaccgccctggtgttccagcagcagcgaagaggaacacgaaagcaaatggcagtagccctgagacggccgcttctggtggttgccactcatctgaagctgtgagtcttgcctggacaggcttttggggacagggggcccaaggagcagtagagggcaatcgttaagattgtggatggactgttgggtactggtgaaggattctggatttggccgggcacagtggctcacgcctgtaatccccacacttcgggagaccgaggcaggtggatcacaaggtcaggagatcgagaccatccaggcaaacacggtgaaatactaaaaaatacaaaaaaaaaag

SEQ ID NO: 313640 - DNA, 4581 bp, Homo sapiens
tgcttgagctctttgggcctctgttttcacgtctgtatgatagaggtggtattgtttgacttgtatttgtgaagtttcaatgagattgataattgtcgattttatgttaatccctagtacatggcctgctgtcaacacccaggacacccaggatatggtctttgctgtttgattttcctcatccccagtctcaaggggaagccaggacaatgagaacagccacttcccatcaggagtcactgcaaggcccccagggtgggatggtggggagataagaaccgtgagagaagttggcacaaaggagttatgggacaaagggtccaagataggcagaaaagaaaatgttgccagttgatggggaagaaaggaagtcggagggctcagacactgagggggacagaacatctccatgtgcagtatcatctgctaccctgaaggatctggaggtaggaggctctgggcggaggtgcagtgaccccgcaggccagccctccaacctcctcccgcagcggggactgggtgcccctctgccagctgagacagcccacacacaacccagccctaatgatcgttctctctacctctcccccaagtcctcctccgcctcctcctctctgcatgcgcgtcagagcccgtgccaagaacaagcagcagtcctgaactcgaggtccataaaaatcagtcgactgaatgacaccatcaaatctttgaaacaacagaagaaacaagtggaacatcagctggaagaagaaaagaaagcaaacaatgagaaacagaaagctgaaagggagctagagggtcaaatccagagattgaacacagagaaaaagaaactaaatacggacctgtatcacatgaaacattctctcagatactttgaagaagagtccaaggatctggccggccgcctgcaacgttcatcgcagcgtataggagagttagagtggtctctctgtgctgtcgccgccacacagaagaagaagccggatgggttctcgagccgcagtaaagcacttctcaagcggcagttagagcagtccatacgggagcagatactgctgaaaggacacgtgacacagttgaaggagtcgcttaaagaagtccagctggagagagatcaatatgctgaacaaataaaaggagagagggcccagtggcagcagaggatgaggaaaatgtcgcaggaggtttgcacattgaaggaggagaagaagcatgatacgcatcgggtagaggagctggagaggagcttgtccagactcaaaaaccagatggctgagccactgcccccggatgccccagcagtgtcctctgaggtggagctgcaagacctgaggaaggagctggagagagtggcaggagagctccaggctcaggtggaaaacaatcagtgcatcagtctcctgaaccgtgggcaaaaggagaggcttcgcgagcaggaggagaggcttcaggagcagcaggagaggcttcgggaacgggagaagaggcttcagcagctggccgagccacagagcgacttggaggagctgaagcacgagaacaagagcgcactgcagttggagcagcaagtaaaggagctgcaggagaagctgggccaggtgatggagacgctcacctcggccgagaaggagccagaggcagcagtcccagcctcagggactgggggcgagtctagcggccttatggacctcctggaggagaaggcggacctgagggagcatgtggagaaactggaacttggattcatccagtaccggagagagagatgccatcagaacgtacatcgccttctaacagagccaggggacagtgccaaagatgcgtcaccgggaggaggccatcatcaggctggcccaggacaaggaggagaggaaggtgaagctgctggagctgcaggagatggtgttgcggcttgtggcagctacaacgaggggcacggcaaattcctggccgctgcccagaaccctgctgctgaacccagtccaggaggccccagccccccaggagctcggggctgccgacaagcatggtgatctttgtgaggcgagcctcaccaacagcgtggagcctgcacaaggagaagccagggagggttcttcccaggacaaccctactgcacagccaatcgtgcagctccttggtgagatgcaggaccaccaggagcacccaggcttgggcagcaactgctgtgtgccatgcttttgctgggcttggctgccgagaagaaggagataaacaccaccatcatcaaagagctgctcaagaaatttttaaaaacgaaacaaagttatggggttaatctcctacacaattcatttacttcatttgaatgttagagctactcatgattatttgtgtttctaatttatagtttaagtttatttgtaaaaagttaaaagagagtgggtctctgtggctctcactgatgttcactctggcatccttcagcatttttcttttttcatttcataattgtaggtcattagcatgcatatcgagtttgcccttacgtggtgggagttcaaacacacaaagacccactctttgcacaaaactgttctcgctggtttggaataggctcccgtgcttttctaatgttattgcagcatggatgtccattacagaattcagataaaatttgctaatgttctgctatgatgtttgatctcatcttaatcacagtgagctcttctatagctcaatatgcggtttgccctcaagtgtgcactgtttattactttgtaatatgccactgtgagtactgacatttagagctgtttaaaggccgagaactggaaacagcctttcctccattttctgtgtattggtgatgggagtgataaccttttgggggagctttctaaatctcacagaagaggaaagtggcctgctctggcaggtatgtgcaggatacagtgtgtttcatctgttccggtgccaagaatgagcagtgtactgtggcagttccctttggatttgtatgtgctctgggctcatgaagatattgcatcgtgagctgcagcagttgcactctttttcaatgacctaaaaagggcttatttccgaggaatgaaaggctgccatcattggctgtgggtgtgaaaaacctttcctagcttagagcatttgtatctacaatacattttaaagtcagagttcgtgttccctgttttaatcacatgactacctgtcccagtacacgaaagggcgctggttggcattcttcttaatgtatttagtgaagatcataagaaatcctttaagagtttaaatgtctctgaaacaggcatacaggctctagtcaagaatgaattagagtgaaggaaagctgtgtgacacctggcattcctctctgttcatggagcttctttgaggcttgaagtttgattttactatctagacctctctggctaatacctattcttcaaccacctcggttactctgacataggaatttacttcttttccttgagtggaaaacactttagaaagtaataacaaacattattataaactaatatatgtgagagtacttagttgaaacaaaaaggaattttagtagacagtattatattatctttgaaaatcaaggagaagtttatgcaacttaaaatgtttacacactgtggtgcaatctactgtttgtgaatgtctgtattatcaggaaacatgtctatacgatcgcagagttgtatttcctcacaaacttctttacgaagagtgaaatacgtttttgtacctctcattttcagtcagggacatactttgtgcaatatttctgtgattgtgcctatgcatgatgaatgaatgcatttcaatcatacattgcctaaatcataacttgatgatgcttgggaaagaatcaacagttaaaacttcatgaagttctaatgtctgtgttccaaaacacatcacattattaggttgtagggagatatgtaggtgtgctccctggggtggggagttttctagttactagaccatctccatttttagcacttggcagcctcatgatccttttataaatgtgagattaacaggagagcagcaatacgattttgccaatggaataacagatttgccggcattcactgaaagagggcagatattgggtccttgtaacttcaactgactcttccaaattgtatgaatttatcaatgtattacacaaatccagtttcagaatgataaaaaatgttagaccaaataatgcggctaattaacagtcgtatgatttctagcccatgggtttaaaactgtatcttaaagagtcattttaaaataatataaatattaaaaaatgtaactgctatcttaatgttctgaaataaaacattttaaaatataaatcctgtagtttaaaaggaagaaatggtgggaaggaaaagtagagaaagaaatgccaattacaggccaaagcgttatttgccaagttttcttagaatgaattttaccaatgtatgagttcttgttaacagaatgtgtaacggaaatactgaaagacttttgcttaaagtggcattattgactgctgatgtgatgctactgtaatgcaataaatttttaaattgttgcaaa

SEQ ID NO: 313641 - DNA, 410 bp, Homo sapiens
caggccagcgggtagaagaacggacagagtaattagcggcgccaagaaaaattcaaagaatattggcagagaaaccgccctggtgttccagcagcagcgaagaggaacacgaaagcaaatggcagtagccctgagacggccgcttctggtggttgccactcatctgaagctgtgagtcttgcctggacaggcttttggggacagggggcccaaggagcagtagagggcaatcgttaagattgtggatggactgttgggtactggtgaaggattctggatttggccgggcacagtggctcacgcctgtaatccccacacttcgggagaccgaggcaggtggatcacaaggtcaggagatcgagaccatccaggcaaacacggtgaaatactaaaaaatacaaaaaaaaaag

SEQ ID NO: 313642 - DNA, 496 bp, Homo sapiens
tttttttcagatgatgtctcactctgtcacccaagatggagtgcaatggcacgatctcagctcactgcaacctctgcctcccaggttcaagcaattatcctgcctcagccacccgagtagctgagattacaggcctctgccaccatgctcagctattttttgtatttttagtagagacggggtttcaccatgttgggcaggctagtcttggaactactgacctcaggtgatccgcccactttggcctcccgaaagtgctgggattacagtcatgagccaccatgcccagcctatttatttctgattctttaagggtgagtagaaattttttccaggtgactaaaaccttgagacattattccaagcagagaccagcggggcaaagacacggggatatagagatgttgaagtttaccaaacactgctagatttaaaaaacagaaaagaaacaatcaaaatcaaaaattaaaattaaaaatcacctaaaaaaaaagaa

SEQ ID NO: 313643 - DNA, 4627 bp, Homo sapiens
tgcttgagctctttgggcctctgttttcacgtctgtatgatagaggtggtattgtttgacttgtatttgtgaagtttcaatgagattgataattgtcgattttatgttaatccctagtacatggcctgctgtcaacacccaggacacccaggatatggtctttgctgtttgattttcctcatccccagtctcaaggggaagccaggacaatgagaacagccacttcccatcaggagtcactgcaaggcccccagggtgggatggtggggagataagaaccgtgagagaagttggcacaaaggagttatgggacaaagggtccaagataggcagaaaagaaaatgttgccagttgatggggaagaaaggaagtcggagggctcagacactgagggggacagaacatctccatgtgcagtctcatctcttatagtcagcaacaggtatccacggggagggccctacatcatctgctaccctgaaggatctggaggtaggaggctctgggcggaggtgcagtgaccccgcaggccagccctccaacctcctcccgcagcggggactgggtgcccctctgccagctgagacagcccacacacaacccagccctaatgatcgttctctctacctctcccccaagtcctcctccgcctcctcctctctgcatgcgcgtcagagcccgtgccaagaacaagcagcagtcctgaactcgaggtccataaaaatcagtcgactgaatgacaccatcaaatctttgaaacaacagaagaaacaagtggaacatcagctggaagaagaaaagaaagcaaacaatgagaaacagaaagctgaaagggagctagagggtcaaatccagagattgaacacagagaaaaagaaactaaatacggacctgtatcacatgaaacattctctcagatactttgaagaagagtccaaggatctggccggccgcctgcaacgttcatcgcagcgtataggagagttagagtggtctctctgtgctgtcgccgccacacagaagaagaagccggatgggttctcgagccgcagtaaagcacttctcaagcggcagttagagcagtccatacgggagcagatactgctgaaaggacacgtgacacagttgaaggagtcgcttaaagaagtccagctggagagagatcaatatgctgaacaaataaaaggagagagggcccagtggcagcagaggatgaggaaaatgtcgcaggaggtttgcacattgaaggaggagaagaagcatgatacgcatcgggtagaggagctggagaggagcttgtccagactcaaaaaccagatggctgagccactgcccccggatgccccagcagtgtcctctgaggtggagctgcaagacctgaggaaggagctggagagagtggcaggagagctccaggctcaggtggaaaacaatcagtgcatcagtctcctgaaccgtgggcaaaaggagaggcttcgcgagcaggaggagaggcttcaggagcagcaggagaggcttcgggaacgggagaagaggcttcagcagctggccgagccacagagcgacttggaggagctgaagcacgagaacaagagcgcactgcagttggagcagcaagtaaaggagctgcaggagaagctgggccaggtgatggagacgctcacctcggccgagaaggagccagaggcagcagtcccagcctcagggactgggggcgagtctagcggccttatggacctcctggaggagaaggcggacctgagggagcatgtggagaaactggaacttggattcatccagtaccggagagagagatgccatcagaacgtacatcgccttctaacagagccaggggacagtgccaaagatgcgtcaccgggaggaggccatcatcaggctggcccaggacaaggaggagaggaaggtgaagctgctggagctgcaggagatggtgttgcggcttgtggcagctacaacgaggggcacggcaaattcctggccgctgcccagaaccctgctgctgaacccagtccaggaggccccagccccccaggagctcggggctgccgacaagcatggtgatctttgtgaggcgagcctcaccaacagcgtggagcctgcacaaggagaagccagggagggttcttcccaggacaaccctactgcacagccaatcgtgcagctccttggtgagatgcaggaccaccaggagcacccaggcttgggcagcaactgctgtgtgccatgcttttgctgggcttggctgccgagaagaaggagataaacaccaccatcatcaaagagctgctcaagaaatttttaaaaacgaaacaaagttatggggttaatctcctacacaattcatttacttcatttgaatgttagagctactcatgattatttgtgtttctaatttatagtttaagtttatttgtaaaaagttaaaagagagtgggtctctgtggctctcactgatgttcactctggcatccttcagcatttttcttttttcatttcataattgtaggtcattagcatgcatatcgagtttgcccttacgtggtgggagttcaaacacacaaagacccactctttgcacaaaactgttctcgctggtttggaataggctcccgtgcttttctaatgttattgcagcatggatgtccattacagaattcagataaaatttgctaatgttctgctatgatgtttgatctcatcttaatcacagtgagctcttctatagctcaatatgcggtttgccctcaagtgtgcactgtttattactttgtaatatgccactgtgagtactgacatttagagctgtttaaaggccgagaactggaaacagcctttcctccattttctgtgtattggtgatgggagtgataaccttttgggggagctttctaaatctcacagaagaggaaagtggcctgctctggcaggtatgtgcaggatacagtgtgtttcatctgttccggtgccaagaatgagcagtgtactgtggcagttccctttggatttgtatgtgctctgggctcatgaagatattgcatcgtgagctgcagcagttgcactctttttcaatgacctaaaaagggcttatttccgaggaatgaaaggctgccatcattggctgtgggtgtgaaaaacctttcctagcttagagcatttgtatctacaatacattttaaagtcagagttcgtgttccctgttttaatcacatgactacctgtcccagtacacgaaagggcgctggttggcattcttcttaatgtatttagtgaagatcataagaaatcctttaagagtttaaatgtctctgaaacaggcatacaggctctagtcaagaatgaattagagtgaaggaaagctgtgtgacacctggcattcctctctgttcatggagcttctttgaggcttgaagtttgattttactatctagacctctctggctaatacctattcttcaaccacctcggttactctgacataggaatttacttcttttccttgagtggaaaacactttagaaagtaataacaaacattattataaactaatatatgtgagagtacttagttgaaacaaaaaggaattttagtagacagtattatattatctttgaaaatcaaggagaagtttatgcaacttaaaatgtttacacactgtggtgcaatctactgtttgtgaatgtctgtattatcaggaaacatgtctatacgatcgcagagttgtatttcctcacaaacttctttacgaagagtgaaatacgtttttgtacctctcattttcagtcagggacatactttgtgcaatatttctgtgattgtgcctatgcatgatgaatgaatgcatttcaatcatacattgcctaaatcataacttgatgatgcttgggaaagaatcaacagttaaaacttcatgaagttctaatgtctgtgttccaaaacacatcacattattaggttgtagggagatatgtaggtgtgctccctggggtggggagttttctagttactagaccatctccatttttagcacttggcagcctcatgatccttttataaatgtgagattaacaggagagcagcaatacgattttgccaatggaataacagatttgccggcattcactgaaagagggcagatattgggtccttgtaacttcaactgactcttccaaattgtatgaatttatcaatgtattacacaaatccagtttcagaatgataaaaaatgttagaccaaataatgcggctaattaacagtcgtatgatttctagcccatgggtttaaaactgtatcttaaagagtcattttaaaataatataaatattaaaaaatgtaactgctatcttaatgttctgaaataaaacattttaaaatataaatcctgtagtttaaaaggaagaaatggtgggaaggaaaagtagagaaagaaatgccaattacaggccaaagcgttatttgccaagttttcttagaatgaattttaccaatgtatgagttcttgttaacagaatgtgtaacggaaatactgaaagacttttgcttaaagtggcattattgactgctgatgtgatgctactgtaatgcaataaatttttaaattgttgcaaa

SEQ ID NO: 313644 - DNA, 4547 bp, Homo sapiens
tttttttcagatgatgtctcactctgtcacccaagatggagtgcaatggcacgatctcagctcactgcaacctctgcctcccaggttcaagcaattatcctgcctcagccacccgagtagctgagattacaggcctctgccaccatgctcagctattttttgtatttttagtagagacggggtttcaccatgttgggcaggctagtcttggaactactgacctcaggtgatccgcccactttggcctcccgaaagtgctgggattacagtcatgagccaccatgcccagcctatttatttctgattctttaagggtgactggacgtgttgatcagcgctcgctgggatttggctgacgtggccccagccccgcctccctccccaccccacaatggcagaagaaactggacagagtaaattagctgcagccaagaaaaagttcaaagaatattggcagagaaaccgccctggtgttccagcagcagcgaagaggaacacgaaagcaaatggcagtagccctgagacggccgcttctggtggttgccactcatctgaagcttcctcctccgcctcctcctctctgcatgcgcgtcagagcccgtgccaagaacaagcagcagtcctgaactcgaggtccataaaaatcagtcgactgaatgacaccatcaaatctttgaaacaacagaagaaacaagtggaacatcagctggaagaagaaaagaaagcaaacaatgagaaacagaaagctgaaagggagctagagggtcaaatccagagattgaacacagagaaaaagaaactaaatacggacctgtatcacatgaaacattctctcagatactttgaagaagagtccaaggatctggccggccgcctgcaacgttcatcgcagcgtataggagagttagagtggtctctctgtgctgtcgccgccacacagaagaagaagccggatgggttctcgagccgcagtaaagcacttctcaagcggcagttagagcagtccatacgggagcagatactgctgaaaggacacgtgacacagttgaaggagtcgcttaaagaagtccagctggagagagatcaatatgctgaacaaataaaaggagagagggcccagtggcagcagaggatgaggaaaatgtcgcaggaggtttgcacattgaaggaggagaagaagcatgatacgcatcgggtagaggagctggagaggagcttgtccagactcaaaaaccagatggctgagccactgcccccggatgccccagcagtgtcctctgaggtggagctgcaagacctgaggaaggagctggagagagtggcaggagagctccaggctcaggtggaaaacaatcagtgcatcagtctcctgaaccgtgggcaaaaggagaggcttcgcgagcaggaggagaggcttcaggagcagcaggagaggcttcgggaacgggagaagaggcttcagcagctggccgagccacagagcgacttggaggagctgaagcacgagaacaagagcgcactgcagttggagcagcaagtaaaggagctgcaggagaagctgggccaggtgatggagacgctcacctcggccgagaaggagccagaggcagcagtcccagcctcagggactgggggcgagtctagcggccttatggacctcctggaggagaaggcggacctgagggagcatgtggagaaactggaacttggattcatccagtaccggagagagagatgccatcagaacgtacatcgccttctaacagagccaggggacagtgccaaagatgcgtcaccgggaggaggccatcatcaggctggcccaggacaaggaggagaggaaggtgaagctgctggagctgcaggagatggtgttgcggcttgtggcagctacaacgaggggcacggcaaattcctggccgctgcccagaaccctgctgctgaacccagtccaggaggccccagccccccaggagctcggggctgccgacaagcatggtgatctttgtgaggcgagcctcaccaacagcgtggagcctgcacaaggagaagccagggagggttcttcccaggacaaccctactgcacagccaatcgtgcagctccttggtgagatgcaggaccaccaggagcacccaggcttgggcagcaactgctgtgtgccatgcttttgctgggcttggctgccgagaagaaggagataaacaccaccatcatcaaagagctgctcaagaaatttttaaaaacgaaacaaagttatggggttaatctcctacacaattcatttacttcatttgaatgttagagctactcatgattatttgtgtttctaatttatagtttaagtttatttgtaaaaagttaaaagagagtgggtctctgtggctctcactgatgttcactctggcatccttcagcatttttcttttttcatttcataattgtaggtcattagcatgcatatcgagtttgcccttacgtggtgggagttcaaacacacaaagacccactctttgcacaaaactgttctcgctggtttggaataggctcccgtgcttttctaatgttattgcagcatggatgtccattacagaattcagataaaatttgctaatgttctgctatgatgtttgatctcatcttaatcacagtgagctcttctatagctcaatatgcggtttgccctcaagtgtgcactgtttattactttgtaatatgccactgtgagtactgacatttagagctgtttaaaggccgagaactggaaacagcctttcctccattttctgtgtattggtgatgggagtgataaccttttgggggagctttctaaatctcacagaagaggaaagtggcctgctctggcaggtatgtgcaggatacagtgtgtttcatctgttccggtgccaagaatgagcagtgtactgtggcagttccctttggatttgtatgtgctctgggctcatgaagatattgcatcgtgagctgcagcagttgcactctttttcaatgacctaaaaagggcttatttccgaggaatgaaaggctgccatcattggctgtgggtgtgaaaaacctttcctagcttagagcatttgtatctacaatacattttaaagtcagagttcgtgttccctgttttaatcacatgactacctgtcccagtacacgaaagggcgctggttggcattcttcttaatgtatttagtgaagatcataagaaatcctttaagagtttaaatgtctctgaaacaggcatacaggctctagtcaagaatgaattagagtgaaggaaagctgtgtgacacctggcattcctctctgttcatggagcttctttgaggcttgaagtttgattttactatctagacctctctggctaatacctattcttcaaccacctcggttactctgacataggaatttacttcttttccttgagtggaaaacactttagaaagtaataacaaacattattataaactaatatatgtgagagtacttagttgaaacaaaaaggaattttagtagacagtattatattatctttgaaaatcaaggagaagtttatgcaacttaaaatgtttacacactgtggtgcaatctactgtttgtgaatgtctgtattatcaggaaacatgtctatacgatcgcagagttgtatttcctcacaaacttctttacgaagagtgaaatacgtttttgtacctctcattttcagtcagggacatactttgtgcaatatttctgtgattgtgcctatgcatgatgaatgaatgcatttcaatcatacattgcctaaatcataacttgatgatgcttgggaaagaatcaacagttaaaacttcatgaagttctaatgtctgtgttccaaaacacatcacattattaggttgtagggagatatgtaggtgtgctccctggggtggggagttttctagttactagaccatctccatttttagcacttggcagcctcatgatccttttataaatgtgagattaacaggagagcagcaatacgattttgccaatggaataacagatttgccggcattcactgaaagagggcagatattgggtccttgtaacttcaactgactcttccaaattgtatgaatttatcaatgtattacacaaatccagtttcagaatgataaaaaatgttagaccaaataatgcggctaattaacagtcgtatgatttctagcccatgggtttaaaactgtatcttaaagagtcattttaaaataatataaatattaaaaaatgtaactgctatcttaatgttctgaaataaaacattttaaaatataaatcctgtagtttaaaaggaagaaatggtgggaaggaaaagtagagaaagaaatgccaattacaggccaaagcgttatttgccaagttttcttagaatgaattttaccaatgtatgagttcttgttaacagaatgtgtaacggaaatactgaaagacttttgcttaaagtggcattattgactgctgatgtgatgctactgtaatgcaataaatttttaaattgttgcaaa

SEQ ID NO: 313645 - DNA, 4506 bp, Homo sapiens
taagggttttaaagcaaaagccagcccctccactctcccagagcgggcggcccctcccctctctcagagtgggtggggacagcggttgcatgggcagctttcctgatgagccacaggtccctctggacacactgccgcctggccacgccccctttccctgtcatctttctcgttgaccaatgggcttgaagcattaaggccacgcccctattctgcattctactgtggccctggttacgctgcctctgggtcagttacgcagctgtcttccaggtgactggacgtgttgatcagcgctcgctgggatttggctgacgtggccccagccccgcctccctccccaccccacaatggcagaagaaactggacagagtaaattagctgcagccaagaaaaagttcaaagaatattggcagagaaaccgccctggtgttccagcagcagcgaagaggaacacgaaagcaaatggcagtagccctgagacggccgcttctggtggttgccactcatctgaagcttcctcctccgcctcctcctctctgcatgcgcgtcagagcccgtgccaagaacaagcagcagtcctgaactcgaggtccataaaaatcagtcgactgaatgacaccatcaaatctttgaaacaacagaagaaacaagtggaacatcagctggaagaagaaaagaaagcaaacaatgagaaacagaaagctgaaagggagctagagggtcaaatccagagattgaacacagagaaaaagaaactaaatacggacctgtatcacatgaaacattctctcagatactttgaagaagagtccaaggatctggccggccgcctgcaacgttcatcgcagcgtataggagagttagagtggtctctctgtgctgtcgccgccacacagaagaagaagccggatgggttctcgagccgcagtaaagcacttctcaagcggcagttagagcagtccatacgggagcagatactgctgaaaggacacgtgacacagttgaaggagtcgcttaaagaagtccagctggagagagatcaatatgctgaacaaataaaaggagagagggcccagtggcagcagaggatgaggaaaatgtcgcaggaggtttgcacattgaaggaggagaagaagcatgatacgcatcgggtagaggagctggagaggagcttgtccagactcaaaaaccagatggctgagccactgcccccggatgccccagcagtgtcctctgaggtggagctgcaagacctgaggaaggagctggagagagtggcaggagagctccaggctcaggtggaaaacaatcagtgcatcagtctcctgaaccgtgggcaaaaggagaggcttcgcgagcaggaggagaggcttcaggagcagcaggagaggcttcgggaacgggagaagaggcttcagcagctggccgagccacagagcgacttggaggagctgaagcacgagaacaagagcgcactgcagttggagcagcaagtaaaggagctgcaggagaagctgggccaggtgatggagacgctcacctcggccgagaaggagccagaggcagcagtcccagcctcagggactgggggcgagtctagcggccttatggacctcctggaggagaaggcggacctgagggagcatgtggagaaactggaacttggattcatccagtaccggagagagagatgccatcagaacgtacatcgccttctaacagagccaggggacagtgccaaagatgcgtcaccgggaggaggccatcatcaggctggcccaggacaaggaggagaggaaggtgaagctgctggagctgcaggagatggtgttgcggcttgtggcagctacaacgaggggcacggcaaattcctggccgctgcccagaaccctgctgctgaacccagtccaggaggccccagccccccaggagctcggggctgccgacaagcatggtgatctttgtgaggcgagcctcaccaacagcgtggagcctgcacaaggagaagccagggagggttcttcccaggacaaccctactgcacagccaatcgtgcagctccttggtgagatgcaggaccaccaggagcacccaggcttgggcagcaactgctgtgtgccatgcttttgctgggcttggctgccgagaagaaggagataaacaccaccatcatcaaagagctgctcaagaaatttttaaaaacgaaacaaagttatggggttaatctcctacacaattcatttacttcatttgaatgttagagctactcatgattatttgtgtttctaatttatagtttaagtttatttgtaaaaagttaaaagagagtgggtctctgtggctctcactgatgttcactctggcatccttcagcatttttcttttttcatttcataattgtaggtcattagcatgcatatcgagtttgcccttacgtggtgggagttcaaacacacaaagacccactctttgcacaaaactgttctcgctggtttggaataggctcccgtgcttttctaatgttattgcagcatggatgtccattacagaattcagataaaatttgctaatgttctgctatgatgtttgatctcatcttaatcacagtgagctcttctatagctcaatatgcggtttgccctcaagtgtgcactgtttattactttgtaatatgccactgtgagtactgacatttagagctgtttaaaggccgagaactggaaacagcctttcctccattttctgtgtattggtgatgggagtgataaccttttgggggagctttctaaatctcacagaagaggaaagtggcctgctctggcaggtatgtgcaggatacagtgtgtttcatctgttccggtgccaagaatgagcagtgtactgtggcagttccctttggatttgtatgtgctctgggctcatgaagatattgcatcgtgagctgcagcagttgcactctttttcaatgacctaaaaagggcttatttccgaggaatgaaaggctgccatcattggctgtgggtgtgaaaaacctttcctagcttagagcatttgtatctacaatacattttaaagtcagagttcgtgttccctgttttaatcacatgactacctgtcccagtacacgaaagggcgctggttggcattcttcttaatgtatttagtgaagatcataagaaatcctttaagagtttaaatgtctctgaaacaggcatacaggctctagtcaagaatgaattagagtgaaggaaagctgtgtgacacctggcattcctctctgttcatggagcttctttgaggcttgaagtttgattttactatctagacctctctggctaatacctattcttcaaccacctcggttactctgacataggaatttacttcttttccttgagtggaaaacactttagaaagtaataacaaacattattataaactaatatatgtgagagtacttagttgaaacaaaaaggaattttagtagacagtattatattatctttgaaaatcaaggagaagtttatgcaacttaaaatgtttacacactgtggtgcaatctactgtttgtgaatgtctgtattatcaggaaacatgtctatacgatcgcagagttgtatttcctcacaaacttctttacgaagagtgaaatacgtttttgtacctctcattttcagtcagggacatactttgtgcaatatttctgtgattgtgcctatgcatgatgaatgaatgcatttcaatcatacattgcctaaatcataacttgatgatgcttgggaaagaatcaacagttaaaacttcatgaagttctaatgtctgtgttccaaaacacatcacattattaggttgtagggagatatgtaggtgtgctccctggggtggggagttttctagttactagaccatctccatttttagcacttggcagcctcatgatccttttataaatgtgagattaacaggagagcagcaatacgattttgccaatggaataacagatttgccggcattcactgaaagagggcagatattgggtccttgtaacttcaactgactcttccaaattgtatgaatttatcaatgtattacacaaatccagtttcagaatgataaaaaatgttagaccaaataatgcggctaattaacagtcgtatgatttctagcccatgggtttaaaactgtatcttaaagagtcattttaaaataatataaatattaaaaaatgtaactgctatcttaatgttctgaaataaaacattttaaaatataaatcctgtagtttaaaaggaagaaatggtgggaaggaaaagtagagaaagaaatgccaattacaggccaaagcgttatttgccaagttttcttagaatgaattttaccaatgtatgagttcttgttaacagaatgtgtaacggaaatactgaaagacttttgcttaaagtggcattattgactgctgatgtgatgctactgtaatgcaataaatttttaaattgttgcaaa

SEQ ID NO: 313646 - DNA, 2673 bp, Homo sapiens
acagttctgtgtaccgatcgagggcacggacttagttactggtgggtctgacgcatgattccctgtggttgaatttgttttccgcaaacccagcccccagagctcggggctgccgacaagcatggtgatctttgtgaggcgagcctcaccaacagcgtggagcctgcacaaggagaagccagggagggttcttcccaggacaaccctactgcacagccaatcgtgcagctccttggtgagatgcaggaccaccaggagcacccaggcttgggcagcaactgctgtgtgccatgcttttgctgggcttggctgccgagaagaaggagataaacaccaccatcatcaaagagctgctcaagaaatttttaaaaacgaaacaaagttatggggttaatctcctacacaattcatttacttcatttgaatgttagagctactcatgattatttgtgtttctaatttatagtttaagtttatttgtaaaaagttaaaagagagtgggtctctgtggctctcactgatgttcactctggcatccttcagcatttttcttttttcatttcataattgtaggtcattagcatgcatatcgagtttgcccttacgtggtgggagttcaaacacacaaagacccactctttgcacaaaactgttctcgctggtttggaataggctcccgtgcttttctaatgttattgcagcatggatgtccattacagaattcagataaaatttgctaatgttctgctatgatgtttgatctcatcttaatcacagtgagctcttctatagctcaatatgcggtttgccctcaagtgtgcactgtttattactttgtaatatgccactgtgagtactgacatttagagctgtttaaaggccgagaactggaaacagcctttcctccattttctgtgtattggtgatgggagtgataaccttttgggggagctttctaaatctcacagaagaggaaagtggcctgctctggcaggtatgtgcaggatacagtgtgtttcatctgttccggtgccaagaatgagcagtgtactgtggcagttccctttggatttgtatgtgctctgggctcatgaagatattgcatcgtgagctgcagcagttgcactctttttcaatgacctaaaaagggcttatttccgaggaatgaaaggctgccatcattggctgtgggtgtgaaaaacctttcctagcttagagcatttgtatctacaatacattttaaagtcagagttcgtgttccctgttttaatcacatgactacctgtcccagtacacgaaagggcgctggttggcattcttcttaatgtatttagtgaagatcataagaaatcctttaagagtttaaatgtctctgaaacaggcatacaggctctagtcaagaatgaattagagtgaaggaaagctgtgtgacacctggcattcctctctgttcatggagcttctttgaggcttgaagtttgattttactatctagacctctctggctaatacctattcttcaaccacctcggttactctgacataggaatttacttcttttccttgagtggaaaacactttagaaagtaataacaaacattattataaactaatatatgtgagagtacttagttgaaacaaaaaggaattttagtagacagtattatattatctttgaaaatcaaggagaagtttatgcaacttaaaatgtttacacactgtggtgcaatctactgtttgtgaatgtctgtattatcaggaaacatgtctatacgatcgcagagttgtatttcctcacaaacttctttacgaagagtgaaatacgtttttgtacctctcattttcagtcagggacatactttgtgcaatatttctgtgattgtgcctatgcatgatgaatgaatgcatttcaatcatacattgcctaaatcataacttgatgatgcttgggaaagaatcaacagttaaaacttcatgaagttctaatgtctgtgttccaaaacacatcacattattaggttgtagggagatatgtaggtgtgctccctggggtggggagttttctagttactagaccatctccatttttagcacttggcagcctcatgatccttttataaatgtgagattaacaggagagcagcaatacgattttgccaatggaataacagatttgccggcattcactgaaagagggcagatattgggtccttgtaacttcaactgactcttccaaattgtatgaatttatcaatgtattacacaaatccagtttcagaatgataaaaaatgttagaccaaataatgcggctaattaacagtcgtatgatttctagcccatgggtttaaaactgtatcttaaagagtcattttaaaataatataaatattaaaaaatgtaactgctatcttaatgttctgaaataaaacattttaaaatataaatcctgtagtttaaaaggaagaaatggtgggaaggaaaagtagagaaagaaatgccaattacaggccaaagcgttatttgccaagttttcttagaatgaattttaccaatgtatgagttcttgttaacagaatgtgtaacggaaatactgaaagacttttgcttaaagtggcattattgactgctgatgtgatgctactgtaatgcaataaatttttaaattgttgcaaa

SEQ ID NO: 313647 - DNA, 4570 bp, Homo sapiens
tgcttgagctctttgggcctctgttttcacgtctgtatgatagaggtggtattgtttgacttgtatttgtgaagtttcaatgagattgataattgtcgattttatgttaatccctagtacatggcctgctgtcaacacccaggacacccaggatatggtctttgctgtttgattttcctcatccccagtctcaaggggaagccaggacaatgagaacagccacttcccatcaggagtcactgcaaggcccccagggtgggatggtggggagataagaaccgtgagagaagttggcacaaaggagttatgggacaaagggtccaagataggcagaaaagaaaatgttgccagttgatggggaagaaaggaagtcggagggctcagacactgagggggacagaacatctccatgtgcagtctcatctcttatagtcagcaacaggtatccacggggagggccctacatcatctgctaccctgaaggatctggaggtaggaggctctgggcggaggtgcagtgaccccgcaggccagccctccaacctcctcccgcagcggggactgggtgcccctctgccagctgagacagcccacacacaacccagccctaatgatcgttctctctacctctcccccaagtcctcctccgcctcctcctctctgcatgcgcgtcagagcccgtgccaagaacaagcagcagtcctgaactcgaggtccataaaaatcagtcgactgaatgacaccatcaaatctttgaaacaacagaagaaacaagtggaacatcagctggaagaagaaaagaaagcaaacaatgagaaacagaaagctgaaagggagctagagggtcaaatccagagattgaacacagagaaaaagaaactaaatacggacctgtatcacatgaaacattctctcagatactttgaagaagagtccaaggatctggccggccgcctgcaacgttcatcgcagcgtataggagagttagagtggtctctctgtgctgtcgccgccacacagaagaagaagccggatgggttctcgagccgcagtaaagcacttctcaagcggcagttagagcagtccatacgggagcagatactgctgaaaggacacgtgacacagttgaaggagtcgcttaaagaagtccagctggagagagatcaatatgctgaacaaataaaaggagagagggcccagtggcagcagaggatgaggaaaatgtcgcaggaggtttgcacattgaaggaggagaagaagcatgatacgcatcgggtagaggagctggagaggagcttgtccagactcaaaaaccagatggctgagccactgcccccggatgccccagcagtgtcctctgaggtggagctgcaagacctgaggaaggagctggagagagtggcaggagagctccaggctcaggtggaaaacaatcagtgcatcagtctcctgaaccgtgggcaaaaggagaggcttcgcgagcaggaggagaggcttcaggagcagcaggagaggcttcgggaacgggagaagaggcttcagcagctggccgagccacagagcgacttggaggagctgaagcacgagaacaagagcgcactgcagttggagcagcaagtaaaggagctgcaggagaagctgggccaggtgatggagacgctcacctcggccgagaaggagccagaggcagcagtcccagcctcagggactgggggcgagtctagcggccttatggacctcctggaggagaaggcggacctgagggagcatgtggagaaactggaacttggattcatccagtaccggagagagagatgccatcagaacgtacatcgccttctaacagagccaggggacagtgccaaagatgcgtcaccgggaggaggccatcatcaggctggcccaggacaaggaggagaggaaggtgaagctgctggagctgcaggagatggtgttgcggcttgtggcagctacaacgaggggcacggcaaattcctggccgctgcccagaaccctgctgctgaacccagtccaggaggccccagccccccaggagctcggggctgccgacaagcatggtgatctttgtgaggcgagcctcaccaacagcgtggagcctgcacaaggagaagccagggagggttcttcccaggacaaccctactgcacagccaatcgtgcagctccttggtgagatgcaggaccaccaggagcacccaggcttgggcagcaactgctgtgtgccatgcttttgctgggcttggctgccgagaagaaggagataaacaccaccatcatcaaagagctgctcaagaaatttttaaaaacgaaacaaagttatggggttaatctcctacacaattcatttacttcatttgaatgttagagctactcatgattatttgtgtttctaatttatagtttaagtttatttgtaaaaagttaaaagagagtgggtctctgtggctctcactgatgttcactctggcatccttcagcatttttcttttttcatttcataattgtaggtcattagcatgcatatcgagtttgcccttacgtggtgggagttcaaacacacaaagacccactctttgcacaaaactgttctcgctggtttggaataggctcccgtgcttttctaatgttattgcagcatggatgtccattacagaattcagataaaatttgctaatgttctgctatgatgtttgatctcatcttaatcacagtgagctcttctatagctcaatatgcggtttgccctcaagtgtgcactgtttattactttgtaatatgccactgtgagtactgacatttagagctgtttaaaggccgagaactggaaacagcctttcctccattttctgtgtattggtgatgggagtgataaccttttgggggagctttctaaatctcacagaagaggaaagtggcctgctctggcaggtatgtgcaggatacagtgtgtttcatctgttccggtgccaagaatgagcagtgtactgtggcagttccctttggatttgtatgtgctctgggctcatgaagatattgcatcgtgagctgcagcagttgcactctttttcaatgacctaaaaagggcttatttccgaggaatgaaaggctgccatcattggctgtgggtgtgaaaaacctttcctagcttagagcatttgtatctacaatacattttaaagtcagagttcgtgttccctgttttaatcacatgactacctgtcccagtacacgaaagggcgctggttggcattcttcttaatgtatttagtgaagatcataagaaatcctttaagagtttaaatgtctctgaaacaggcatacaggctctagtcaagaatgaattagagtgaaggaaagctgtgtgacacctggcattcctctctgttcatggagcttctttgaggcttgaagtttgattttactatctagacctctctggctaatacctattcttcaaccacctcggttactctgacataggaatttacttcttttccttgagtggaaaacactttagaaagtaataacaaacattattataaactaatatatgtgagagtacttagttgaaacaaaaaggaattttagtagacagtattatattatctttgaaaatcaaggagaagtttatgcaacttaaaatgtttacacactgtggtgcaatctactgtttgtgaatgtctgtattatcaggaaacatgtctatacgatcgcagagttgtatttcctcacaaacttctttacgaagagtgaaatacgtttttgtacctctcattttcagtcagggacatactttgtgcaatatttctgtgattgtgcctatgcatgatgaatgaatgcatttcaatcatacattgcctaaatcataacttgatgatgcttgggaaagaatcaacagttaaaacttcatgaagttctaatgtctgtgttccggagttttctagttactagaccatctccatttttagcacttggcagcctcatgatccttttataaatgtgagattaacaggagagcagcaatacgattttgccaatggaataacagatttgccggcattcactgaaagagggcagatattgggtccttgtaacttcaactgactcttccaaattgtatgaatttatcaatgtattacacaaatccagtttcagaatgataaaaaatgttagaccaaataatgcggctaattaacagtcgtatgatttctagcccatgggtttaaaactgtatcttaaagagtcattttaaaataatataaatattaaaaaatgtaactgctatcttaatgttctgaaataaaacattttaaaatataaatcctgtagtttaaaaggaagaaatggtgggaaggaaaagtagagaaagaaatgccaattacaggccaaagcgttatttgccaagttttcttagaatgaattttaccaatgtatgagttcttgttaacagaatgtgtaacggaaatactgaaagacttttgcttaaagtggcattattgactgctgatgtgatgctactgtaatgcaataaatttttaaattgttgcaaa

SEQ ID NO: 313648 - DNA, 1960 bp, Homo sapiens
tatacaacagatacgtgctatggcgacgctcgatgattcaaatgttactgctcacgtatctgtgacattatgccagcttgctcgaagtaactagatcctgtgtatcactgcatgtagtatgaccgggccagaagcaacatgcgaatacaagaccattgtccctgcgcagtgttaactcggtagtcgttgcgttgaatgaggatctgagtatgccatttcggaggatccttactgagatctcatcagacagaagataccagatgcgatgttcagatcgagtattagtgcaccgatacagtgtgtttcatctgttccggtgccaagaatgagcagtgtactgtggcagttccctttggatttgtatgtgctctgggctcatgaagatattgcatcgtgagctgcagcagttgcactctttttcaatgacctaaaaagggcttatttccgaggaatgaaaggctgccatcattggctgtgggtgtgaaaaacctttcctagcttagagcatttgtatctacaatacattttaaagtcagagttcgtgttccctgttttaatcacatgactacctgtcccagtacacgaaagggcgctggttggcattcttcttaatgtatttagtgaagatcataagaaatcctttaagagtttaaatgtctctgaaacaggcatacaggctctagtcaagaatgaattagagtgaaggaaagctgtgtgacacctggcattcctctctgttcatggagcttctttgaggcttgaagtttgattttactatctagacctctctggctaatacctattcttcaaccacctcggttactctgacataggaatttacttcttttccttgagtggaaaacactttagaaagtaataacaaacattattataaactaatatatgtgagagtacttagttgaaacaaaaaggaattttagtagacagtattatattatctttgaaaatcaaggagaagtttatgcaacttaaaatgtttacacactgtggtgcaatctactgtttgtgaatgtctgtattatcaggaaacatgtctatacgatcgcagagttgtatttcctcacaaacttctttacgaagagtgaaatacgtttttgtacctctcattttcagtcagggacatactttgtgcaatatttctgtgattgtgcctatgcatgatgaatgaatgcatttcaatcatacattgcctaaatcataacttgatgatgcttgggaaagaatcaacagttaaaacttcatgaagttctaatgtctgtgttccaaaacacatcacattattaggttgtagggagatatgtaggtgtgctccctggggtggggagttttctagttactagaccatctccatttttagcacttggcagcctcatgatccttttataaatgtgagattaacaggagagcagcaatacgattttgccaatggaataacagatttgccggcattcactgaaagagggcagatattgggtccttgtaacttcaactgactcttccaaattgtatgaatttatcaatgtattacacaaatccagtttcagaatgataaaaaatgttagaccaaataatgcggctaattaacagtcgtatgatttctagcccatgggtttaaaactgtatcttaaagagtcattttaaaataatataaatattaaaaaatgtaactgctatcttaatgttctgaaataaaacattttaaaatataaatcctgtagtttaaaaggaagaaatggtgggaaggaaaagtagagaaagaaatgccaattacaggccaaagcgttatttgccaagttttcttagaatgaattttaccaatgtatgagttcttgttaacagaatgtgtaacggaaatactgaaagacttttgcttaaagtggcattattgactgctgatgtgatgctactgtaatgcaataaatttttaaattgttgcaaa

SEQ ID NO: 313649 - DNA, 747 bp, Homo sapiens
agaaattccagttgtctttttcccagctgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagttgcggcaatacgattttgccaatggaataacagatttgccggcattcactgaaagagggcagatattgggtccttgtaacttcaactgactcttccaaattgtatgaatttatcaatgtattacacaaatccagtttcagaatgataaaaaatgttagaccaaataatgcggctaattaacagtcgtatgatttctagcccatgggtttaaaactgtatcttaaagagtcattttaaaataatataaatattaaaaaatgtaactgctatcttaatgttctgaaataaaacattttaaaatataaatcctgtagtttaaaaggaagaaatggtgggaaggaaaagtagagaaagaaatgccaattacaggccaaagcgttatttgccaagttttcttagaatgaattttaccaatgtatgagttcttgttaacagaatgtgtaacggaaatactgaaagacttttgcttaaagtggcattattgactgctgatgtgatgctactgtaatgcaataaatttttaaattgttgcaaa

SEQ ID NO: 313650 - DNA, 4470 bp, Homo sapiens
tgcttgagctctttgggcctctgttttcacgtctgtatgatagaggtggtattgtttgacttgtatttgtgaagtttcaatgagattgataattgtcgattttatgttaatccctagtacatggcctgctgtcaacacccaggacacccaggatatggtctttgctgtttgattttcctcatccccagtctcaaggggaagccaggacaatgagaacagccacttcccatcaggagtcactgcaaggcccccagggtgggatggtggggagataagaaccgtgagagaagttggcacaaaggagttatgggacaaagggtccaagataggcagaaaagaaaatgttgccagttgatggggaagaaaggaagtcggagggctcagacactgagggggacagaacatctccatgtgcagtctcatctcttatagtcagcaacaggtatccacggggagggccctacatcatctgctaccctgaaggatctggaggtaggaggctctgggcggaggtgcagtgaccccgcaggccagccctccaacctcctcccgcagcggggactgggtgcccctctgccagctgagacagcccacacacaacccagccctaatgatcgttctctctacctctcccccaagtcctcctccgcctcctcctctctgcatgcgcgtcagagcccgtgccaagaacaagcagcagtcctgaactcgaggtccataaaaatcagtcgactgaatgacaccatcaaatctttgaaacaacagaagaaacaagtggaacatcagctggaagaagaaaagaaagcaaacaatgagaaacagaaagctgaaagggagctagagggtcaaatccagagattgaacacagagaaaaagaaactaaatacggacctgtatcacatgaaacattctctcagatactttgaagaagagtccaaggatctggccggccgcctgcaacgttcatcgcagcgtataggagagttagagtggtctctctgtgctgtcgccgccacacagaagaagaagccggatgggttctcgagccgcagtaaagcacttctcaagcggcagttagagcagtccatacgggagcagatactgctgaaaggacacgtgacacagttgaaggagtcgcttaaagaagtccagctggagagagatcaatatgctgaacaaataaaaggagagagggcccagtggcagcagaggatgaggaaaatgtcgcaggaggtttgcacattgaaggaggagaagaagcatgatacgcatcgggtagaggagctggagaggagcttgtccagactcaaaaaccagatggctgagccactgcccccggatgccccagcagtgtcctctgaggtggagctgcaagacctgaggaaggagctggagagagtggcaggagagctccaggctcaggtggaaaacaatcagtgcatcagtctcctgaaccgtgggcaaaaggagaggcttcgcgagcaggaggagaggcttcaggagcagcaggagaggcttcgggaacgggagaagaggcttcagcagctggccgagccacagagcgacttggaggagctgaagcacgagaacaagagcgcactgcagttggagcagcaagtaaaggagctgcaggagaagctgggccaggtgatggagacgctcacctcggccgagaaggagccagaggcagcagtcccagcctcagggactgggggcgagtctagcggccttatggacctcctggaggagaaggcggacctgagggagcatgtggagaaactggaacttggattcatccagtaccggagagagagatgccatcagaacgtacatcgccttctaacagagccaggggacagtgccaaagatgcgtcaccgggaggaggccatcatcaggctggcccaggacaaggaggagaggaaggtgaagctgctggagctgcaggagatggtgttgcggcttgtggcagctacaacgaggggcacggcaaattcctggccgctgcccagaaccctgctgctgaacccagtccaggaggccccagccccccaggagctcggggctgccgacaagcatggtgatctttgtgaggcgagcctcaccaacagcgtggagcctgcacaaggagaagccagggagggttcttcccaggacaaccctactgcacagccaatcgtgcagctccttggtgagatgcaggaccaccaggagcacccaggcttgggcagcaactgctgtgtgccatgcttttgctgggcttggctgccgagaagaaggagataaacaccaccatcatcaaagagctgctcaagaaatttttaaaaacgaaacaaagttatggggttaatctcctacacaattcatttacttcatttgaatgttagagctactcatgattatttgtgtttctaatttatagtttaagtttatttgtaaaaagttaaaagagagtgggtctctgtggctctcactgatgttcactctggcatccttcagcatttttcttttttcatttcataattgtaggtcattagcatgcatatcgagtttgcccttacgtggtgggagttcaaacacacaaagacccactctttgcacaaaactgttctcgctggtttggaataggctcccgtgcttttctaatgttattgcagcatggatgtccattacagaattcagataaaatttgctaatgttctgctatgatgtttgatctcatcttaatcacagtgagctcttctatagctcaatatgcggtttgccctcaagtgtgcactgtttattactttgtaatatgccactgtgagtactgacatttagagctgtttaaaggccgagaactggaaacagcctttcctccattttctgtgtattggtgatgggagtgataaccttttgggggagctttctaaatctcacagaagaggaaagtggcctgctctggcaggtatgtgcaggatacagtgtgtttcatctgttccggtgccaagaatgagcagtgtactgtggcagttccctttggatttgtatgtgctctgggctcatgaagatattgcatcgtgagctgcagcagttgcactctttttcaatgacctaaaaagggcttatttccgaggaatgaaaggctgccatcattggctgtgggtgtgaaaaacctttcctagcttagagcatttgtatctacaatacattttaaagtcagagttcgtgttccctgttttaatcacatgactacctgtcccagtacacgaaagggcgctggttggcattcttcttaatgtatttagtgaagatcataagaaatcctttaagagtttaaatgtctctgaaacaggcatacaggctctagtcaagaatgaattagagtgaaggaaagctgtgtgacacctggcattcctctctgttcatggagcttctttgaggcttgaagtttgattttactatctagacctctctggctaatacctattcttcaaccacctcggttactctgacataggaatttacttcttttccttgagtggaaaacactttagaaagtaataacaaacattattataaactaatatatgtgagagtacttagttgaaacaaaaaggaattttagtagacagtattatattatctttgaaaatcaaggagaagtttatgcaacttaaaatgtttacacactgtggtgcaatctactgtttgtgaatgtctgtattatcaggaaacatgtctatacgatcgcagagttgtatttcctcacaaacttctttacgaagagtgaaatacgtttttgtacctctcattttcagtcagggacatactttgtgcaatatttctgtgattgtgcctatgcatgatgaatgaatgcatttcaatcatacattgcctaaatcataacttgatgatgcttgggaaagaatcaacagttaaaacttcatgaagttctaatgtctgtgttccaaaacacatcacattattaggttgtagggagatatgtaggtgtgctccctggggtggggagttttctagttactagaccatctccatttttagcacttggcagcctcatgatccttttataaatgtgagattaacaggagagcagcaatacgattttgccaatggaataacagatttgccggcattcactgaaagagggcagatattgggtccttgtaacttcaactgactcttccaaattgtatgaatttatcaatgtattacacaaatccagtttcagaatgataaaaaatgttagaccaaataatgcggctaattaacagtcgtatgatttctagcccatgggtttaaaactgtatcttaaagagtcattttaaaataatataaatattaaaaaatgtaactgctatcttaatgttctgaaataaaacattttaaaatataaatcctgtagtttaaaaggaagaaatggtgggtagtcacagacgtctgtgactacccatgactacccagtctca

SEQ ID NO: 313651 - DNA, 721 bp, Homo sapiens
agcagatcgcggtgtgccgctacgtgcgggctctcaaggagctcagcctcccggacggagccggcggctgcggggcgaggacggcggcgcggcgaggacggcggcggaccggggcagccccgcgccctggccgctctactgagatgaagaaagaaaaagaatacctgctcagctccagagacacgtaaagggacagagattgggggacagaaggaagtgcattaattccttccacgacccctgaagagcagcggtgggtctgagcatcctatctccaggaagcaggccagcaggcaagccagctgccacctcgtcctgtgcaaagcacaggcaccgtccccaaaagatttccaaagatgatgttaaacccagccacggttctgatctccaggaaagcaattgctgtggtacaaaaggacaagggttaaaagagaacagtgggagctctctttcccagctaactcacgcagtgtgacgcagaggctttcagcacagcccagggtgcccgggactgaaaactccttcaccagccccctccacaggatatagaagacttagatcactacgagatgaaagcagagcccattagtgggaaaaagttggaggatgaaggaattgaaaaagaaaatttggcaatattagagaaattaggaagactgaaagacaagagcatttaactgcaaactgttgtcgttgtcaactgggttgtcttcctgaagta

SEQ ID NO: 313652 - DNA, 3989 bp, Homo sapiens
  misc_feature (145)..(145): n is a, c, g, or t
  misc_feature (148)..(148): n is a, c, g, or t
ctgaatttgaacctttgggagaaaagccaagcaagtgctgaaagagaaggaaagcaacattctccagaggacaggagggaacttcacaccctccactcacctctaactgcctctttagggttccctggttttgctggctttcttnctnttcctataggaaaagaaagcaaacaatgagaaacagaaagctgaaagggagctagagggtcaaatccagagattgaacacagagaaaaagaaactaaatacggacctgtatcacatgaaacattctctcagatactttgaagaagagtccaaggatctggccggccgcctgcaacgttcatcgcagcgtataggagagttagagtggtctctctgtgctgtcgccgccacacagaagaagaagccggatgggttctcgagccgcagtaaagcacttctcaagcggcagttagagcagtccatacgggagcagatactgctgaaaggacacgtgacacagttgaaggagtcgcttaaagaagtccagctggagagagatcaatatgctgaacaaataaaaggagagagggcccagtggcagcagaggatgaggaaaatgtcgcaggaggtttgcacattgaaggaggagaagaagcatgatacgcatcgggtagaggagctggagaggagcttgtccagactcaaaaaccagatggctgagccactgcccccggatgccccagcagtgtcctctgaggtggagctgcaagacctgaggaaggagctggagagagtggcaggagagctccaggctcaggtggaaaacaatcagtgcatcagtctcctgaaccgtgggcaaaaggagaggcttcgcgagcaggaggagaggcttcaggagcagcaggagaggcttcgggaacgggagaagaggcttcagcagctggccgagccacagagcgacttggaggagctgaagcacgagaacaagagcgcactgcagttggagcagcaagtaaaggagctgcaggagaagctgggccaggtgatggagacgctcacctcggccgagaaggagccagaggcagcagtcccagcctcagggactgggggcgagtctagcggccttatggacctcctggaggagaaggcggacctgagggagcatgtggagaaactggaacttggattcatccagtaccggagagagagatgccatcagaacgtacatcgccttctaacagagccaggggacagtgccaaagatgcgtcaccgggaggaggccatcatcaggctggcccaggacaaggaggagaggaaggtgaagctgctggagctgcaggagatggtgttgcggcttgtggcagctacaacgaggggcacggcaaattcctggccgctgcccagaaccctgctgctgaacccagtccaggaggccccagccccccaggagctcggggctgccgacaagcatggtgatctttgtgaggcgagcctcaccaacagcgtggagcctgcacaaggagaagccagggagggttcttcccaggacaaccctactgcacagccaatcgtgcagctccttggtgagatgcaggaccaccaggagcacccaggcttgggcagcaactgctgtgtgccatgcttttgctgggcttggctgccgagaagaaggagataaacaccaccatcatcaaagagctgctcaagaaatttttaaaaacgaaacaaagttatggggttaatctcctacacaattcatttacttcatttgaatgttagagctactcatgattatttgtgtttctaatttatagtttaagtttatttgtaaaaagttaaaagagagtgggtctctgtggctctcactgatgttcactctggcatccttcagcatttttcttttttcatttcataattgtaggtcattagcatgcatatcgagtttgcccttacgtggtgggagttcaaacacacaaagacccactctttgcacaaaactgttctcgctggtttggaataggctcccgtgcttttctaatgttattgcagcatggatgtccattacagaattcagataaaatttgctaatgttctgctatgatgtttgatctcatcttaatcacagtgagctcttctatagctcaatatgcggtttgccctcaagtgtgcactgtttattactttgtaatatgccactgtgagtactgacatttagagctgtttaaaggccgagaactggaaacagcctttcctccattttctgtgtattggtgatgggagtgataaccttttgggggagctttctaaatctcacagaagaggaaagtggcctgctctggcaggtatgtgcaggatacagtgtgtttcatctgttccggtgccaagaatgagcagtgtactgtggcagttccctttggatttgtatgtgctctgggctcatgaagatattgcatcgtgagctgcagcagttgcactctttttcaatgacctaaaaagggcttatttccgaggaatgaaaggctgccatcattggctgtgggtgtgaaaaacctttcctagcttagagcatttgtatctacaatacattttaaagtcagagttcgtgttccctgttttaatcacatgactacctgtcccagtacacgaaagggcgctggttggcattcttcttaatgtatttagtgaagatcataagaaatcctttaagagtttaaatgtctctgaaacaggcatacaggctctagtcaagaatgaattagagtgaaggaaagctgtgtgacacctggcattcctctctgttcatggagcttctttgaggcttgaagtttgattttactatctagacctctctggctaatacctattcttcaaccacctcggttactctgacataggaatttacttcttttccttgagtggaaaacactttagaaagtaataacaaacattattataaactaatatatgtgagagtacttagttgaaacaaaaaggaattttagtagacagtattatattatctttgaaaatcaaggagaagtttatgcaacttaaaatgtttacacactgtggtgcaatctactgtttgtgaatgtctgtattatcaggaaacatgtctatacgatcgcagagttgtatttcctcacaaacttctttacgaagagtgaaatacgtttttgtacctctcattttcagtcagggacatactttgtgcaatatttctgtgattgtgcctatgcatgatgaatgaatgcatttcaatcatacattgcctaaatcataacttgatgatgcttgggaaagaatcaacagttaaaacttcatgaagttctaatgtctgtgttccaaaacacatcacattattaggttgtagggagatatgtaggtgtgctccctggggtggggagttttctagttactagaccatctccatttttagcacttggcagcctcatgatccttttataaatgtgagattaacaggagagcagcaatacgattttgccaatggaataacagatttgccggcattcactgaaagagggcagatattgggtccttgtaacttcaactgactcttccaaattgtatgaatttatcaatgtattacacaaatccagtttcagaatgataaaaaatgttagaccaaataatgcggctaattaacagtcgtatgatttctagcccatgggtttaaaactgtatcttaaagagtcattttaaaataatataaatattaaaaaatgtaactgctatcttaatgttctgaaataaaacattttaaaatataaatcctgtagtttaaaaggaagaaatggtgggaaggaaaagtagagaaagaaatgccaattacaggccaaagcgttatttgccaagttttcttagaatgaattttaccaatgtatgagttcttgttaacagaatgtgtaacggaaatactgaaagacttttgcttaaagtggcattattgactgctgatgtgatgctactgtaatgcaataaatttttaaattgttgcaaa

SEQ ID NO: 313653 - DNA, 3072 bp, Homo sapiens
agcggaggccaggcactgcctggcaaggctgctggagggagatctggccgcagatggtgaaggagaacatcgaggcccccagtccccaagcagggctccatgggtcgggcggcgggcattggctctactgagatgaagaaagaaaaagaatacctgctcagctccagagacacgtaaagggacagagattgggggacagaaggaagtgcattaattccttccacgacccctgaagagcagcggtgggtctgagcatcctatctccaggaagcaggccagcaggcaagccagctgccacctcgtcctgtgcaaagcacaggcaccgtccccaaaagatttccaaagatgatgttaaacccagccacggttctgatctccaggaaagcaattgctgtggtacaaaaggacaagggttaaaagagaacagtgggagctctctttcccagctaactcacgcagtgtgacgcagaggctttcagcacagccccagccccccaggagctcggggctgccgacaagcatggtgatctttgtgaggcgagcctcaccaacagcgtggagcctgcacaaggagaagccagggagggttcttcccaggacaaccctactgcacagccaatcgtgcagctccttggtgagatgcaggaccaccaggagcacccaggcttgggcagcaactgctgtgtgccatgcttttgctgggcttggctgccgagaagaaggagataaacaccaccatcatcaaagagctgctcaagaaatttttaaaaacgaaacaaagttatggggttaatctcctacacaattcatttacttcatttgaatgttagagctactcatgattatttgtgtttctaatttatagtttaagtttatttgtaaaaagttaaaagagagtgggtctctgtggctctcactgatgttcactctggcatccttcagcatttttcttttttcatttcataattgtaggtcattagcatgcatatcgagtttgcccttacgtggtgggagttcaaacacacaaagacccactctttgcacaaaactgttctcgctggtttggaataggctcccgtgcttttctaatgttattgcagcatggatgtccattacagaattcagataaaatttgctaatgttctgctatgatgtttgatctcatcttaatcacagtgagctcttctatagctcaatatgcggtttgccctcaagtgtgcactgtttattactttgtaatatgccactgtgagtactgacatttagagctgtttaaaggccgagaactggaaacagcctttcctccattttctgtgtattggtgatgggagtgataaccttttgggggagctttctaaatctcacagaagaggaaagtggcctgctctggcaggtatgtgcaggatacagtgtgtttcatctgttccggtgccaagaatgagcagtgtactgtggcagttccctttggatttgtatgtgctctgggctcatgaagatattgcatcgtgagctgcagcagttgcactctttttcaatgacctaaaaagggcttatttccgaggaatgaaaggctgccatcattggctgtgggtgtgaaaaacctttcctagcttagagcatttgtatctacaatacattttaaagtcagagttcgtgttccctgttttaatcacatgactacctgtcccagtacacgaaagggcgctggttggcattcttcttaatgtatttagtgaagatcataagaaatcctttaagagtttaaatgtctctgaaacaggcatacaggctctagtcaagaatgaattagagtgaaggaaagctgtgtgacacctggcattcctctctgttcatggagcttctttgaggcttgaagtttgattttactatctagacctctctggctaatacctattcttcaaccacctcggttactctgacataggaatttacttcttttccttgagtggaaaacactttagaaagtaataacaaacattattataaactaatatatgtgagagtacttagttgaaacaaaaaggaattttagtagacagtattatattatctttgaaaatcaaggagaagtttatgcaacttaaaatgtttacacactgtggtgcaatctactgtttgtgaatgtctgtattatcaggaaacatgtctatacgatcgcagagttgtatttcctcacaaacttctttacgaagagtgaaatacgtttttgtacctctcattttcagtcagggacatactttgtgcaatatttctgtgattgtgcctatgcatgatgaatgaatgcatttcaatcatacattgcctaaatcataacttgatgatgcttgggaaagaatcaacagttaaaacttcatgaagttctaatgtctgtgttccaaaacacatcacattattaggttgtagggagatatgtaggtgtgctccctggggtggggagttttctagttactagaccatctccatttttagcacttggcagcctcatgatccttttataaatgtgagattaacaggagagcagcaatacgattttgccaatggaataacagatttgccggcattcactgaaagagggcagatattgggtccttgtaacttcaactgactcttccaaattgtatgaatttatcaatgtattacacaaatccagtttcagaatgataaaaaatgttagaccaaataatgcggctaattaacagtcgtatgatttctagcccatgggtttaaaactgtatcttaaagagtcattttaaaataatataaatattaaaaaatgtaactgctatcttaatgttctgaaataaaacattttaaaatataaatcctgtagtttaaaaggaagaaatggtgggaaggaaaagtagagaaagaaatgccaattacaggccaaagcgttatttgccaagttttcttagaatgaattttaccaatgtatgagttcttgttaacagaatgtgtaacggaaatactgaaagacttttgcttaaagtggcattattgactgctgatgtgatgctactgtaatgcaataaatttttaaattgttgcaaa

SEQ ID NO: 313654 - DNA, 4216 bp, Homo sapiens
cccggtgacgtggcttgataggttcagggtatcatcagggactcattggaggttgcatatctttctaaggaggatctggaggtaggaggctctgggcggaggtgcagtgaccccgcaggccagccctccaacctcctcccgcagcggggactgggtgcccctctgccagctgagacagcccacacacaacccagccctaatgatcgttctctctacctctcccccaagtcctcctccgcctcctcctctctgcatgcgcgtcagagcccgtgccaagaacaagcagcagtcctgaactcgaggtccataaaaatcagtcgactgaatgacaccatcaaatctttgaaacaacagaagaaacaagtggaacatcagctggaagaagaaaagaaagcaaacaatgagaaacagaaagctgaaagggagctagagggtcaaatccagagattgaacacagagaaaaagaaactaaatacggacctgtatcacatgaaacattctctcagatactttgaagaagagtccaaggatctggccggccgcctgcaacgttcatcgcagcgtataggagagttagagtggtctctctgtgctgtcgccgccacacagaagaagaagccggatgggttctcgagccgcagtaaagcacttctcaagcggcagttagagcagtccatacgggagcagatactgctgaaaggacacgtgacacagttgaaggagtcgcttaaagaagtccagctggagagagatcaatatgctgaacaaataaaaggagagagggcccagtggcagcagaggatgaggaaaatgtcgcaggaggtttgcacattgaaggaggagaagaagcatgatacgcatcgggtagaggagctggagaggagcttgtccagactcaaaaaccagatggctgagccactgcccccggatgccccagcagtgtcctctgaggtggagctgcaagacctgaggaaggagctggagagagtggcaggagagctccaggctcaggtggaaaacaatcagtgcatcagtctcctgaaccgtgggcaaaaggagaggcttcgcgagcaggaggagaggcttcaggagcagcaggagaggcttcgggaacgggagaagaggcttcagcagctggccgagccacagagcgacttggaggagctgaagcacgagaacaagagcgcactgcagttggagcagcaagtaaaggagctgcaggagaagctgggccaggtgatggagacgctcacctcggccgagaaggagccagaggcagcagtcccagcctcagggactgggggcgagtctagcggccttatggacctcctggaggagaaggcggacctgagggagcatgtggagaaactggaacttggattcatccagtaccggagagagagatgccatcagaacgtacatcgccttctaacagagccaggggacagtgccaaagatgcgtcaccgggaggaggccatcatcaggctggcccaggacaaggaggagaggaaggtgaagctgctggagctgcaggagatggtgttgcggcttgtggcagctacaacgaggggcacggcaaattcctggccgctgcccagaaccctgctgctgaacccagtccaggaggccccagccccccaggagctcggggctgccgacaagcatggtgatctttgtgaggcgagcctcaccaacagcgtggagcctgcacaaggagaagccagggagggttcttcccaggacaaccctactgcacagccaatcgtgcagctccttggtgagatgcaggaccaccaggagcacccaggcttgggcagcaactgctgtgtgccatgcttttgctgggcttggctgccgagaagaaggagataaacaccaccatcatcaaagagctgctcaagaaatttttaaaaacgaaacaaagttatggggttaatctcctacacaattcatttacttcatttgaatgttagagctactcatgattatttgtgtttctaatttatagtttaagtttatttgtaaaaagttaaaagagagtgggtctctgtggctctcactgatgttcactctggcatccttcagcatttttcttttttcatttcataattgtaggtcattagcatgcatatcgagtttgcccttacgtggtgggagttcaaacacacaaagacccactctttgcacaaaactgttctcgctggtttggaataggctcccgtgcttttctaatgttattgcagcatggatgtccattacagaattcagataaaatttgctaatgttctgctatgatgtttgatctcatcttaatcacagtgagctcttctatagctcaatatgcggtttgccctcaagtgtgcactgtttattactttgtaatatgccactgtgagtactgacatttagagctgtttaaaggccgagaactggaaacagcctttcctccattttctgtgtattggtgatgggagtgataaccttttgggggagctttctaaatctcacagaagaggaaagtggcctgctctggcaggtatgtgcaggatacagtgtgtttcatctgttccggtgccaagaatgagcagtgtactgtggcagttccctttggatttgtatgtgctctgggctcatgaagatattgcatcgtgagctgcagcagttgcactctttttcaatgacctaaaaagggcttatttccgaggaatgaaaggctgccatcattggctgtgggtgtgaaaaacctttcctagcttagagcatttgtatctacaatacattttaaagtcagagttcgtgttccctgttttaatcacatgactacctgtcccagtacacgaaagggcgctggttggcattcttcttaatgtatttagtgaagatcataagaaatcctttaagagtttaaatgtctctgaaacaggcatacaggctctagtcaagaatgaattagagtgaaggaaagctgtgtgacacctggcattcctctctgttcatggagcttctttgaggcttgaagtttgattttactatctagacctctctggctaatacctattcttcaaccacctcggttactctgacataggaatttacttcttttccttgagtggaaaacactttagaaagtaataacaaacattattataaactaatatatgtgagagtacttagttgaaacaaaaaggaattttagtagacagtattatattatctttgaaaatcaaggagaagtttatgcaacttaaaatgtttacacactgtggtgcaatctactgtttgtgaatgtctgtattatcaggaaacatgtctatacgatcgcagagttgtatttcctcacaaacttctttacgaagagtgaaatacgtttttgtacctctcattttcagtcagggacatactttgtgcaatatttctgtgattgtgcctatgcatgatgaatgaatgcatttcaatcatacattgcctaaatcataacttgatgatgcttgggaaagaatcaacagttaaaacttcatgaagttctaatgtctgtgttccaaaacacatcacattattaggttgtagggagatatgtaggtgtgctccctggggtggggagttttctagttactagaccatctccatttttagcacttggcagcctcatgatccttttataaatgtgagattaacaggagagcagcaatacgattttgccaatggaataacagatttgccggcattcactgaaagagggcagatattgggtccttgtaacttcaactgactcttccaaattgtatgaatttatcaatgtattacacaaatccagtttcagaatgataaaaaatgttagaccaaataatgcggctaattaacagtcgtatgatttctagcccatgggtttaaaactgtatcttaaagagtcattttaaaataatataaatattaaaaaatgtaactgctatcttaatgttctgaaataaaacattttaaaatataaatcctgtagtttaaaaggaagaaatggtgggaaggaaaagtagagaaagaaatgccaattacaggccaaagcgttatttgccaagttttcttagaatgaattttaccaatgtatgagttcttgttaacagaatgtgtaacggaaatactgaaagacttttgcttaaagtggcattattgactgctgatgtgatgctactgtaatgcaataaatttttaaattgttgcaaa

SEQ ID NO: 313655 - DNA, 4601 bp, Homo sapiens
tgcttgagctctttgggcctctgttttcacgtctgtatgatagaggtggtattgtttgacttgtatttgtgaagtttcaatgagattgataattgtcgattttatgttaatccctagtacatggcctgctgtcaacacccaggacacccaggatatggtctttgctgtttgattttcctcatccccagtctcaaggggaagccaggacaatgagaacagccacttcccatcaggagtcactgcaaggcccccagggtgggatggtggggagataagaaccgtgagagaagttggcacaaaggagttatgggacaaagggtccaagataggcagaaaagaaaatgttgccagttgatggggaagaaaggaagtcggagggctcagacactgagggggacagaacatctccatgtgcagtctcatctcttatagtcagcaacaggtatccacggggagggccctacatcatctgctaccctgaaggatctggaggtaggaggctctgggcggaggtgcagtgaccccgcaggccagccctccaacctcctcccgcagcggggactgggtgcccctctgccagctgagacagcccacacacaacccagccctaatgatcgttctctctacctctcccccaagtcctcctccgcctcctcctctctgcatgcgcgtcagagcccgtgccaagaacaagcagcagtcctgaactcgaggtccataaaaatcagtcgactgaatgacaccatcaaatctttgaaacaacagaagaaacaagtggaacatcagctggaagaagaaaagaaagcaaacaatgagaaacagaaagctgaaagggagctagagggtcaaatccagagattgaacacagagaaaaagaaactaaatacggacctgtatcacatgaaacattctctcagatactttgaagaagagtccaaggatctggccggccgcctgcaacgttcatcgcagcgtataggagagttagagtggtctctctgtgctgtcgccgccacacagaagaagaagccggatgggttctcgagccgcagtaaagcacttctcaagcggcagttagagcagtccatacgggagcagatactgctgaaaggacacgtgacacagttgaaggagtcgcttaaagaagtccagctggagagagatcaatatgctgaacaaataaaaggagagagggcccagtggcagcagaggatgaggaaaatgtcgcaggaggtttgcacattgaaggaggagaagaagcatgatacgcatcgggtagaggagctggagaggagcttgtccagactcaaaaaccagatggctgagccactgcccccggatgccccagcagtgtcctctgaggtggagctgcaagacctgaggaaggagctggagagagtggcaggagagctccaggctcaggtggaaaacaatcagtgcatcagtctcctgaaccgtgggcaaaaggagaggcttcgcgagcaggaggagaggcttcaggagcagcaggagaggcttcgggaacgggagaagaggcttcagcagctggccgagccacagagcgacttggaggagctgaagcacgagaacaagagcgcactgcagttggagcagcaagtaaaggagctgcaggagaagctgggccaggtgatggagacgctcacctcggccgagaaggagccagaggcagcagtcccagcctcagggactgggggcgagtctagcggccttatggacctcctggaggagaaggcggacctgagggagcatgtggagaaactggaacttggattcatccagtaccggagagagagatgccatcagaacgtacatcgccttctaacagagccaggggacagtgccaaagatgcgtcaccgggaggaggccatcatcaggctggcccaggacaaggaggagaggaaggtgaagctgctggagctgcaggagatggtgttgcggcttgtggcagctacaacgaggggcacggcaaattcctggccgctgcccagaaccctgctgctgaacccagtccaggaggccccagccccccaggagctcggggctgccgacaagcatggtgatctttgtgaggcgagcctcaccaacagcgtggagcctgcacaaggagaagccagggagggttcttcccaggacaaccctactgcacagccaatcgtgcagctccttggtgagatgcaggaccaccaggagcacccaggcttgggcagcaactgctgtgtgccatgcttttgctgggcttggctgccgagaagaaggagataaacaccaccatcatcaaagagctgctcaagaaatttttaaaaacgaaacaaagttatggggttaatctcctacacaattcatttacttcatttgaatgttagagctactcatgattatttgtgtttctaatttatagtttaagtttatttgtaaaaagttaaaagagagtgggtctctgtggctctcactgatgttcactctggcatccttcagcatttttcttttttcatttcataattgtaggtcattagcatgcatatcgagtttgcccttacgtggtgggagttcaaacacacaaagacccactctttgcacaaaactgttctcgctggtttggaataggctcccgtgcttttctaatgttattgcagcatggatgtccattacagaattcagataaaatttgctaatgttctgctatgatgtttgatctcatcttaatcacagtgagctcttctatagctcaatatgcggtttgccctcaagtgtgcactgtttattactttgtaatatgccactgtgagtactgacatttagagctgtttaaaggccgagaactggaaacagcctttcctccattttctgtgtattggtgatgggagtgataaccttttgggggagctttctaaatctcacagaagaggaaagtggcctgctctggcaggtatgtgcaggatacagtgtgtttcatctgttccggtgccaagaatgagcagtgtactgtggcagttccctttggatttgtatgtgctctgggctcatgaagatattgcatcgtgagctgcagcagttgcactctttttcaatgacctaaaaagggcttatttccgaggaatgaaaggctgccatcattggctgtgggtgtgaaaaacctttcctagcttagagcatttgtatctacaatacattttaaagtcagagttcgtgttccctgttttaatcacatgactacctgtcccagtacacgaaagggcgctggttggcattcttcttaatgtatttagtgaagatcataagaaatcctttaagagtttaaatgtctctgaaacaggcatacaggctctagtcaagaatgaattagagtgaaggaaagctgtgtgacacctggcattcctctctgttcatggagcttctttgaggcttgaagtttgattttactatctagacctctctggctaatacctattcttcaaccacctcggttactctgacataggaatttacttcttttccttgagtggaaaacactttagaaagtaataacaaacattattataaactaatatatgtgagagtacttagttgaaacaaaaaggaattttagtagacagtattatattatctttgaaaatcaaggagaagtttatgcaacttaaaatgtttacacactgtggtgcaatctactgtttgtgaatgtctgtattatcaggaaacatgtctatacgatcgcagagttgtatttcctcacaaacttctttacgaagagtgaaatacgtttttgtacctctcattttcagtcagggacatactttgtgcaatatttctgtgattgtgcctatgcatgatgaatgaatgcatttcaatcatacattgcctaaatcataacttgatgatgcttgggaaagaatcaacagttaaaacttcatgaagttctaatgtctgtgttccaaaacacatcacattattaggttgtagggagggagttttctagttactagaccatctccatttttagcacttggcagcctcatgatccttttataaatgtgagattaacaggagagcagcaatacgattttgccaatggaataacagatttgccggcattcactgaaagagggcagatattgggtccttgtaacttcaactgactcttccaaattgtatgaatttatcaatgtattacacaaatccagtttcagaatgataaaaaatgttagaccaaataatgcggctaattaacagtcgtatgatttctagcccatgggtttaaaactgtatcttaaagagtcattttaaaataatataaatattaaaaaatgtaactgctatcttaatgttctgaaataaaacattttaaaatataaatcctgtagtttaaaaggaagaaatggtgggaaggaaaagtagagaaagaaatgccaattacaggccaaagcgttatttgccaagttttcttagaatgaattttaccaatgtatgagttcttgttaacagaatgtgtaacggaaatactgaaagacttttgcttaaagtggcattattgactgctgatgtgatgctactgtaatgcaataaatttttaaattgttgcaaa

SEQ ID NO: 313656 - DNA, 4396 bp, Homo sapiens
tgcttgagctctttgggcctctgttttcacgtctgtatgatagaggtggtattgtttgacttgtatttgtgaagtttcaatgagattgataattgtcgattttatgttaatccctagtacatggcctgctgtcaacacccaggacacccaggatatggtctttgctgtttgattttcctcatccccagtctcaaggggaagccaggacaatgagaacagccacttcccatcaggagtcactgcaaggcccccagggtgggatggtggggagataagaaccgtgagagaagttggcacaaaggagttatgggacaaagggtccaagataggcagaaaagaaaatgttgccagttgatggggaagaaaggaagtcggagggctcagacactgagggggacagaacatctccatgtgcagtctcatctcttatagtcagcaacaggtatccacggggagggccctacatcatctgctaccctgaaggatctggaggtaggaggctctgggcggaggtgcagtgaccccgcaggccagccctccaacctcctcccgcagcggggactgggtgcccctctgccagctgagacagcccacacacaacccagccctaatgatcgttctctctacctctcccccaagtcctcctccgcctcctcctctctgcatgcgcgtcagagcccgtgccaagaacaagcagcagtcctgaactcgaggtccataaaaatcagtcgactgaatgacaccatcaaatctttgaaacaacagaagaaacaagtggaacatcagctggaagaagaaaagaaagcaaacaatgagaaacagaaagctgaaagggagctagagggtcaaatccagagattgaacacagagaaaaagaaactaaatacggacctgtatcacatgaaacattctctcagatactttgaagaagagtccaaggatctggccggccgcctgcaacgttcatcgcagcgtataggagagttagagtggtctctctgtgctgtcgccgccacacagaagaagaagccggatgggttctcgagccgcagtaaagcacttctcaagcggcagttagagcagtccatacgggagcagatactgctgaaaggacacgtgacacagttgaaggagtcgcttaaagaagtccagctggagagagatcaatatgctgaacaaataaaaggagagagggcccagtggcagcagaggatgaggaaaatgtcgcaggaggtttgcacattgaaggaggagaagaagcatgatacgcatcgggtagaggagctggagaggagcttgtccagactcaaaaaccagatggctgagccactgcccccggatgccccagcagtgtcctctgaggtggagctgcaagacctgaggaaggagctggagagagtggcaggagagctccaggctcaggtggaaaacaatcagtgcatcagtctcctgaaccgtgggcaaaaggagaggcttcgcgagcaggaggagaggcttcaggagcagcaggagaggcttcgggaacgggagaagaggcttcagcagctggccgagccacagagcgacttggaggagctgaagcacgagaacaagagcgcactgcagttggagcagcaagtaaaggagctgcaggagaagctgggccaggtgatggagacgctcacctcggccgagaaggagccagaggcagcagtcccagcctcagggactgggggcgagtctagcggccttatggacctcctggaggagaaggcggacctgagggagcatgtggagaaactggaacttggattcatccagtaccggagagagagatgccatcagaacgtacatcgccttctaacagagccaggggacagtgccaaagatgcgtcaccgggaggaggccatcatcaggctggcccaggacaaggaggagaggaaggtgaagctgctggagctgcaggagatggtgttgcggcttgtggcagctacaacgaggggcacggcaaattcctggccgctgcccagaaccctgctgctgaacccagtccaggaggccccagccccccaggagctcggggctgccgacaagcatggtgatctttgtgaggcgagcctcaccaacagcgtggagcctgcacaaggagaagccagggagggttcttcccaggacaaccctactgcacagccaatcgtgcagctccttggtgagatgcaggaccaccaggagcacccaggcttgggcagcaactgctgtgtgccatgcttttgctgggcttggctgccgagaagaaggagataaacaccaccatcatcaaagagctgctcaagaaatttttaaaaacgaaacaaagttatggggttaatctcctacacaattcatttacttcatttgaatgttagagctactcatgattatttgtgtttctaatttatagtttaagtttatttgtaaaaagttaaaagagagtgggtctctgtggctctcactgatgttcactctggcatccttcagcatttttcttttttcatttcataattgtaggtcattagcatgcatatcgagtttgcccttacgtggtgggagttcaaacacacaaagacccactctttgcacaaaactgttctcgctggtttggaataggctcccgtgcttttctaatgttattgcagcatggatgtccattacagaattcagataaaatttgctaatgttctgctatgatgtttgatctcatcttaatcacagtgagctcttctatagctcaatatgcggtttgccctcaagtgtgcactgtttattactttgtaatatgccactgtgagtactgacatttagagctgtttaaaggccgagaactggaaacagcctttcctccattttctgtgtattggtgatgggagtgataaccttttgggggagctttctaaatctcacagaagaggaaagtggcctgctctggcaggtatgtgcaggatacagtgtgtttcatctgttccggtgccaagaatgagcagtgtactgtggcagttccctttggatttgtatgtgctctgggctcatgaagatattgcatcgtgagctgcagcagttgcactctttttcaatgacctaaaaagggcttatttccgaggaatgaaaggctgccatcattggctgtgggtgtgaaaaacctttcctagcttagagcatttgtatctacaatacattttaaagtcagagttcgtgttccctgttttaatcacatgactacctgtcccagtacacgaaagggcgctggttggcattcttcttaatgtatttagtgaagatcataagaaatcctttaagagtttaaatgtctctgaaacaggcatacaggctctagtcaagaatgaattagagtgaaggaaagctgtgtgacacctggcattcctctctgttcatggagcttctttgaggcttgaagtttgattttactatctagacctctctggctaatacctattcttcaaccacctcggttactctgacataggaatttacttcttttccttgagtggaaaacactttagaaagtaataacaaacattattataaactaatatatgtgagagtacttagttgaaacaaaaaggaattttagtagacagtattatattatctttgaaaatcaaggagaagtttatgcaacttaaaatgtttacacactgtggtgcaatctactgtttgtgaatgtctgtattatcaggaaacatgtctatacgatcgcagagttgtatttcctcacaaacttctttacgaagagtgaaatacgtttttgtacctctcattttcagtcagggacatactttgtgcaatatttctgtgattgtgcctatgcatgatgaatgaatgcatttcaatcatacattgcctaaatcataacttgatgatgcttgggaaagaatcaacagttaaaacttcatgaagttctaatgtctgtgttccaaaacacatcacattattaggttgtagggagatatgtaggtgtgctccctggggtggggagttttctagttactagaccatctccatttttagcacttggcagcctcatgatccttttataaatgtgagattaacaggagagcagcaatacgattttgccaatggaataacagatttgccggcattcactgaaagagggcagatattgggtccttgtaacttcaactgactcttccaaattgtatgaatttatcaatgtattacacaaatccagtttcagaatgataaaaaatgttagaccaaataatgcggctaattaacagtcgtatgatttctagcccatgggtttaaaactgtatcttaaagagtcattttaaaataatataaatattaaaaaatgtaactgctatcttaatgttctgaaataaaacattttaaaatata

SEQ ID NO: 313657 - DNA, 610 bp, Homo sapiens
gacagaatttacgcacccttggcttccttggagcctagcggctctccccgcgtccaagatggcggcagaagcagctggtgggaaatacagaagcacagtcagcaaaagcaaagacccctcggggctgctcatctctgtgatcagcagcactcactgagaaaggcgtcttgtttcctggactttggggtgtaaggccttggagtccggagattcctgtcacgagttgcagatttgtgttttcacactctggatactttcaaccacctgtgcgtggccacagccacaaatacaagaatctgcagtgagctggtaggaggactgggtttgaaggcacacatcggttttcaattttttgccctgcctccgcattctggtccattccttaaaaaacagaaccaaaccaatttcaaattatcctccatgcactgcccctctgcacctcccagaagattagggtgggggtggagtgggagcggtggatcttttaggagcttttttttaaaaaagcgaaatatattgaggatgggggaaccctttcaagaatcttggatatgatgcaggtactgactaaaaccaatctaaataaaatttattatggcacgttaaatac

SEQ ID NO: 313658 - DNA, 4258 bp, Homo sapiens
aagatttttagcagcatttcgtttggtgcgcgatgccagtaggtaagtgagcatggtacatacctagtttcctgatgagcatcctgcgtcagttgacctatcggcgttgtgattctcatcctagattaataaaagagctcctggcgtgcatagctgagcgagtgcttgaaacaacatcgcacagatgtgagtttcgtggatcggtcatttactagagactctactcaaaaagggtggtaccaggcagacgtgtcaggagaatcaaagattgtagccacccagctaactgcaagaattgacgacagccattcgcacataccagagcatcacagagcgcatcactaactcccgaaataaaataaagcaggtaaaagagaacctgctttcatgcaagatgctgctgcactgcaaacgggatgagcttcggaaactgtggattgaaggaattgagcataagcatgtcctgaacttgttggatgaaattgagaatatcaagcaagtgcctcaaaagctggaacagtgcatggccagcaagcactatctcagtgccactgacatgttggtgtcagcagttgagtctttggagggccccctgctccaggtggaaggactgagtgaccttcgactagagcttcacagcaagaagatgaaccttcacttggttctcatagatgaactacaccggcacctgtacatcaaatcgactagccgagttgtgcagcgtaacaaggaaaaagggaaaatcagctccctcgtgaaagatgcttctgttcctctgattgatgttacaaacctccctactcctcgaaaattccttgatacctctcactattctactgctggaagctcaagtgtgagggagataaatctgcaggacatcaaggaagatttagaattggatccagaggaaaacagcaccctgtttatgggtatcctcattaagggcttggcgaaactgaagaagatcccagaaacagttaaggcaatcatagagcgcttggagcaggagttgaagcaaattgtgaagaggtctacaacccaggtggcagacagtggctatcagcggggggagaacgttactgtggagaaccaaccaaggttgcttctagaactgctggagttactgtttgacaagtttaatgctgtagccgctgcacactctgtggtcctgggatacctgcaggacactgtagtgactccactgactcagcaggaagatatcaaactgtatgatatggcagatgtatgggtgaagatccaagatgttctacagatgctattaactgagtacttggatatgaaaaatactcgtacggcctctgaaccatcagctcaactaagctatgccagcactggacgagagtttgcagccttttttgccaagaagaaacctcaaaggccaaaaaattctcttttcaagttcgaatcgtcctcccatgccatcagtatgagcgcctatctgcgagaacagagaagggagctctatagtcggagtggagaactgcaagggggtcctgatgacaacttaattgaaggtggaggaacaaaatttgtctgcaaacctggagccagaaacattaccgtcatattccacccattactaagatttattcaggagattgagcatgctctgggtcttggcccagccaaacagtgtcctcttcgagagtttctcaccgtgtacatcaaaaacatctttctcaatcaagtcttggctgagatcaacaaggagattgaaggagtcactaaaacatctgaccctttgaagattctggccaacgcagacaccatgaaggtgctgggagtgcagcggcctctcctacagagcacaatcattgtggagaagacagttcaagacctcctgaacctgatgcatgacttgagtgcatattcagatcaattcctcaacatggtgtgcgtgaagctccaggagtacaaggacacctgcactgcagcttacaggggtattgtccagtcagaagaaaaacttgtcatcagtgcatcctgggcaaaagatgatgatatcagcagactcttgaaatctctaccaaactggatgaatatggctcaacccaaacagctgaggccaaaaagagaggaggaagaagatttcataagggcagcttttggcaaggagtctgaagttcttattgggaacctgggtgataaattaatccctccacaagacatccttcgtgacgtcagtgacctcaaagccttggccaacatgcatgaaagcctggaatggttggcaagtcgaacaaagtcagctttctccaatctttctacatcccagatgctttctcctgctcaagacagccacacgaacacggatctccccccagtgtcagagcagatcatgcagactctcagtgaacttgccaaatcgttccaggatatggctgaccgctgcttgcttgtcttacatctggaagtgagggttcactgtttccactatcttatccctcttgcaaaggaggggaactatgccattgtggctaatgtggaaagtatggattatgaccccctggtggtcaagctcaacaaagatatcagcgccattgaagaggccatgagcgccagccttcagcagcacaagttccagtatatcttcgaaggcctgggccacctgatctcctgcatcctcattaatggtgcccagtacttcaggcgcatcagtgagtctggcatcaagaaaatgtgtaggaacatttttgttcttcagcagaatttgaccaacatcaccatgtcgcgggaggcagacctggactttgcaaggcagtactacgagatgctttacaacacagctgacgagctcctgaacctggtggtggaccagggtgtgaagtacacggagctggagtacatccacgctctgaccctgctgcaccgcagccaaactggggtgggggaactgaccacccagaacacgaggctgcagaggctcaaagagatcatctgcgagcaggctgccatcaagcaagccaccaaggacaagaagataactaccgtttagcagggcgtactgcggttggtgacgggggtcccctcagtcacactcacttttttccttggtatgttattgagtatattctgagcttagttttctctacagtgatactttagtggagaggaggtgtaaggattctttctctctggttttggcttttcatataaatgctaaaggaaggcgacagtacagagtgttttggttgaacaactactttaatgcagtcaaatctaacgggactagggtgggatagggaggaaggtggtatcaaattgttggactctgaaaaacaagtggatggattactaatatttgatttattactcaatatatatataattccagccttggaaagtaggaaagtaggctgctacctaacttttagtcccttccaaaaccatttagtagggttctattacataaacagtagggtttttcctctcctgaccttatccgtttacagttcaatgaaataagtgtatgtgcattgctgtctgtctctattgccaaaatcaaataaatggcttctcagctgctgtttacaacaaacttccctaaccaaaacagaacctctaatttagggctaggaatagaagtcttttgatcccagtccgtgggacagttttgtatgctgtatcttgtacacaggttgtaggttggtttattgccattttgttttatttctgctatataaaaaccaagagccagacaattagacaactatggaggaatgaaaggcaattcaaacatctgcttgattcccgccccgccacccctaatttctgagagaataatggttagagaacattgcatctcacttgaaacatcctttgggggtaaatgattcttaggtgctcacttggtctgagctcagctgaatgcagggaagatgggacagagtgacatttctcctctgtgcggcctccagctgagcctgtctctgaattgttccctcccccgcaatgtgggcacttaccatgttcctggcacactggacctcaccatgtcccccggtcaccagtcctcttgctgcccatggttcataggtcatagaaggcagcaatgcactgactgggccacatcttgaaaactcgtggaaagggaaaggggaggagatgggactttgaccacacacagtgatgcctcacaccctgaaggtgggggattttgtacctgtttgtacaactttggtcttgatgggaaaaatggagaattaaaaagtgttttgagaagcttaaaaaaaacatg

SEQ ID NO: 313659 - DNA, 2579 bp, Homo sapiens
gctaggtagaggcggggtgaatcggacgagtcttggctgagatcaacaaggagattgaaggagtcactaaaacatctgaccctttgaagattctggccaacgcagacaccatgaaggtgctgggagtgcagcggcctctcctacagagcacaatcattgtggagaagacagttcaagacctcctgaacctgatgcatgacttgagtgcatattcagatcaattcctcaacatggtgtgcgtgaagctccaggagtacaaggacacctgcactgcagcttacaggggtattgtccagtcagaagaaaaacttgtcatcagtgcatcctgggcaaaagatgatgatatcagcagactcttgaaatctctaccaaactggatgaatatggctcaacccaaacagctgaggccaaaaagagaggaggaagaagatttcataagggcagcttttggcaaggagtctgaagttcttattgggaacctgggtgataaattaatccctccacaagacatccttcgtgacgtcagtgacctcaaagccttggccaacatgcatgaaagcctggaatggttggcaagtcgaacaaagtcagctttctccaatctttctacatcccagatgctttctcctgctcaagacagccacacgaacacggatctccccccagtgtcagagcagatcatgcagactctcagtgaacttgccaaatcgttccaggatatggctgaccgctgcttgcttgtcttacatctggaagtgagggttcactgtttccactatcttatccctcttgcaaaggaggggaactatgccattgtggctaatgtggaaagtatggattatgaccccctggtggtcaagctcaacaaagatatcagcgccattgaagaggccatgagcgccagccttcagcagcacaagttccagtatatcttcgaaggcctgggccacctgatctcctgcatcctcattaatggtgcccagtacttcaggcgcatcagtgagtctggcatcaagaaaatgtgtaggaacatttttgttcttcagcagaatttgaccaacatcaccatgtcgcgggaggcagacctggactttgcaaggcagtactacgagatgctttacaacacagctgacgagctcctgaacctggtggtggaccagggtgtgaagtacacggagctggagtacatccacgctctgaccctgctgcaccgcagccaaactggggtgggggaactgaccacccagaacacgaggctgcagaggctcaaagagatcatctgcgagcaggctgccatcaagcaagccaccaaggacaagaagataactaccgtttagcagggcgtactgcggttggtgacgggggtcccctcagtcacactcacttttttccttggtatgttattgagtatattctgagcttagttttctctacagtgatactttagtggagaggaggtgtaaggattctttctctctggttttggcttttcatataaatgctaaaggaaggcgacagtacagagtgttttggttgaacaactactttaatgcagtcaaatctaacgggactagggtgggatagggaggaaggtggtatcaaattgttggactctgaaaaacaagtggatggattactaatatttgatttattactcaatatatatataattccagccttggaaagtaggaaagtaggctgctacctaacttttagtcccttccaaaaccatttagtagggttctattacataaacagtagggtttttcctctcctgaccttatccgtttacagttcaatgaaataagtgtatgtgcattgctgtctgtctctattgccaaaatcaaataaatggcttctcagctgctgtttacaacaaacttccctaaccaaaacagaacctctaatttagggctaggaatagaagtcttttgatcccagtccgtgggacagttttgtatgctgtatcttgtacacaggttgtaggttggtttattgccattttgttttatttctgctatataaaaaccaagagccagacaattagacaactatggaggaatgaaaggcaattcaaacatctgcttgattcccgccccgccacccctaatttctgagagaataatggttagagaacattgcatctcacttgaaacatcctttgggggtaaatgattcttaggtgctcacttggtctgagctcagctgaatgcagggaagatgggacagagtgacatttctcctctgtgcggcctccagctgagcctgtctctgaattgttccctcccccgcaatgtgggcacttaccatgttcctggcacactggacctcaccatgtcccccggtcaccagtcctcttgctgcccatggttcataggtcatagaaggcagcaatgcactgactgggccacatcttgaaaactcgtggaaagggaaaggggaggagatgggactttgaccacacacagtgatgcctcacaccctgaaggtgggggattttgtacctgtttgtacaactttggtcttgatgggaaaaatggagaattaaaaagtgttttgagaagcttaaaaaaaacatg

SEQ ID NO: 313660 - DNA, 2377 bp, Homo sapiens
aggtcagagaacacgaggcttgccaccatcttggaagcggccagccaccatcttgggagctctgggagcaaggaccccctggggtattgtccagtcagaagaaaaacttgtcatcagtgcatcctgggcaaaagatgatgatatcagcagactcttgaaatctctaccaaactggatgaatatggctcaacccaaacagctgaggccaaaaagagaggaggaagaagatttcataagggcagcttttggcaaggagtctgaagttcttattgggaacctgggtgataaattaatccctccacaagacatccttcgtgacgtcagtgacctcaaagccttggccaacatgcatgaaagcctggaatggttggcaagtcgaacaaagtcagctttctccaatctttctacatcccagatgctttctcctgctcaagacagccacacgaacacggatctccccccagtgtcagagcagatcatgcagactctcagtgaacttgccaaatcgttccaggatatggctgaccgctgcttgcttgtcttacatctggaagtgagggttcactgtttccactatcttatccctcttgcaaaggaggggaactatgccattgtggctaatgtggaaagtatggattatgaccccctggtggtcaagctcaacaaagatatcagcgccattgaagaggccatgagcgccagccttcagcagcacaagttccagtatatcttcgaaggcctgggccacctgatctcctgcatcctcattaatggtgcccagtacttcaggcgcatcagtgagtctggcatcaagaaaatgtgtaggaacatttttgttcttcagcagaatttgaccaacatcaccatgtcgcgggaggcagacctggactttgcaaggcagtactacgagatgctttacaacacagctgacgagctcctgaacctggtggtggaccagggtgtgaagtacacggagctggagtacatccacgctctgaccctgctgcaccgcagccaaactggggtgggggaactgaccacccagaacacgaggctgcagaggctcaaagagatcatctgcgagcaggctgccatcaagcaagccaccaaggacaagaagataactaccgtttagcagggcgtactgcggttggtgacgggggtcccctcagtcacactcacttttttccttggtatgttattgagtatattctgagcttagttttctctacagtgatactttagtggagaggaggtgtaaggattctttctctctggttttggcttttcatataaatgctaaaggaaggcgacagtacagagtgttttggttgaacaactactttaatgcagtcaaatctaacgggactagggtgggatagggaggaaggtggtatcaaattgttggactctgaaaaacaagtggatggattactaatatttgatttattactcaatatatatataattccagccttggaaagtaggaaagtaggctgctacctaacttttagtcccttccaaaaccatttagtagggttctattacataaacagtagggtttttcctctcctgaccttatccgtttacagttcaatgaaataagtgtatgtgcattgctgtctgtctctattgccaaaatcaaataaatggcttctcagctgctgtttacaacaaacttccctaaccaaaacagaacctctaatttagggctaggaatagaagtcttttgatcccagtccgtgggacagttttgtatgctgtatcttgtacacaggttgtaggttggtttattgccattttgttttatttctgctatataaaaaccaagagccagacaattagacaactatggaggaatgaaaggcaattcaaacatctgcttgattcccgccccgccacccctaatttctgagagaataatggttagagaacattgcatctcacttgaaacatcctttgggggtaaatgattcttaggtgctcacttggtctgagctcagctgaatgcagggaagatgggacagagtgacatttctcctctgtgcggcctccagctgagcctgtctctgaattgttccctcccccgcaatgtgggcacttaccatgttcctggcacactggacctcaccatgtcccccggtcaccagtcctcttgctgcccatggttcataggtcatagaaggcagcaatgcactgactgggccacatcttgaaaactcgtggaaagggaaaggggaggagatgggactttgaccacacacagtgatgcctcacaccctgaaggtgggggattttgtacctgtttgtacaactttggtcttgatgggaaaaatggagaattaaaaagtgttttgagaagcttaaaaaaaacatg

SEQ ID NO: 313661 - DNA, 3970 bp, Homo sapiens
gacagaatttacgcacccttggcttccttggagcctagcggctctccccgcgtccaagatggcggcagaagcagctggtgggaaatacagaagcacagtcagcaaaagcaaagacccctcggggctgctcatctctgtgatcaggactctgtctactagtgacgatgtcgaagacagggaaaatgaaaagggtcgccttgaagaagcctacgagaaatgtgaccgtgacctggatgaattgattgtacagcactacacagaattgacgacagccattcgcacataccagagcatcacagagcgcatcactaactcccgaaataaaataaagcaggtaaaagagaacctgctttcatgcaagatgctgctgcactgcaaacgggatgagcttcggaaactgtggattgaaggaattgagcataagcatgtcctgaacttgttggatgaaattgagaatatcaagcaagtgcctcaaaagctggaacagtgcatggccagcaagcactatctcagtgccactgacatgttggtgtcagcagttgagtctttggagggccccctgctccaggtggaaggactgagtgaccttcgactagagcttcacagcaagaagatgaaccttcacttggttctcatagatgaactacaccggcacctgtacatcaaatcgactagccgagttgtgcagcgtaacaaggaaaaagggaaaatcagctccctcgtgaaagatgcttctgttcctctgattgatgttacaaacctccctactcctcgaaaattccttgatacctctcactattctactgctggaagctcaagtgtgagggagataaatctgcaggacatcaaggaagatttagaattggatccagaggaaaacagcaccctgtttatgggtatcctcattaagggcttggcgaaactgaagaagatcccagaaacagttaaggcaatcatagagcgcttggagcaggagttgaagcaaattgtgaagaggtctacaacccaggtggcagacagtggctatcagcggggggagaacgttactgtggagaaccaaccaaggttgcttctagaactgctggagttactgtttgacaagtttaatgctgtagccgctgcacactctgtggtcctgggatacctgcaggacactgtagtgactccactgactcagcaggaagatatcaaactgtatgatatggcagatgtatgggtgaagatccaagatgttctacagatgctattaactgagtacttggatatgaaaaatactcgtacggcctctgaaccatcagctcaactaagctatgccagcactggacgagagtttgcagccttttttgccaagaagaaacctcaaaggccaaaaaattctcttttcaagttcgaatcgtcctcccatgccatcagtatgagcgcctatctgcgagaacagagaagggagctctatagtcggagtggagaactgcaagggggtcctgatgacaacttaattgaaggtggaggaacaaaatttgtctgcaaacctggagccagaaacattaccgtcatattccacccattactaagatttattcaggagattgagcatgctctgggtcttggcccagccaaacagtgtcctcttcgagagtttctcaccgtgtacatcaaaaacatctttctcaatcaagtcttggctgagatcaacaaggagattgaaggagtcactaaaacatctgaccctttgaagattctggccaacgcagacaccatgaaggtgctgggagtgcagcggcctctcctacagagcacaatcattgtggagaagacagttcaagacctcctgaacctgatgcatgacttgagtgcatattcagatcaattcctcaacatggtgtgcgtgaagctccaggagtacaaggacacctgcactgcagcttacaggggtattgtccagtcagaagaaaaacttgtcatcagtgcatcctgggcaaaagatgatgatatcagcagactcttgaaatctctaccaaactggatgaatatggctcaacccaaacagctgaggccaaaaagagaggaggaagaagatttcataagggcagcttttggcaaggagtctgaagttcttattgggaacctgggtgataaattaatccctccacaagacatccttcgtgacgtcagtgacctcaaagccttggccaacatgcatgaaagcctggaatggttggcaagtcgaacaaagtcagctttctccaatctttctacatcccagatgctttctcctgctcaagacagccacacgaacacggatctccccccagtgtcagagcagatcatgcagactctcagtgaacttgccaaatcgttccaggatatggctgaccgctgcttgcttgtcttacatctggaagtgagggttcactgtttccactatcttatccctcttgcaaaggaggggaactatgccattgtggctaatgtggaaagtatggattatgaccccctggtggtcaagctcaacaaagatatcagcgccattgaagaggccatgagcgccagccttcagcagcacaagttccagtatatcttcgaaggcctgggccacctgatctcctgcatcctcattaatggtgcccagtacttcaggcgcatcagtgagtctggcatcaagaaaatgtgtaggaacatttttgttcttcagcagaatttgaccaacatcaccatgtcgcgggaggcagacctggactttgcaaggcagtactacgagatgctttacaacacagctgacgagctcctgaacctggtggtggaccagggtgtgaagtacacggagctggagtacatccacgctctgaccctgctgcaccgcagccaaactggggtgggggaactgaccacccagaacacgaggctgcagaggctcaaagagatcatctgcgagcaggctgccatcaagcaagccaccaaggacaagaagataactaccgtttagcagggcgtactgcggttggtgacgggggtcccctcagtcacactcacttttttccttggtatgttattgagtatattctgagcttagttttctctacagtgatactttagtggagaggaggtgtaaggattctttctctctggttttggcttttcatataaatgctaaaggaaggcgacagtacagagtgttttggttgaacaactactttaatgcagtcaaatctaacgggactagggtgggatagggaggaaggtggtatcaaattgttggactctgaaaaacaagtggatggattactaatatttgatttattactcaatatatatataattccagccttggaaagtaggaaagtaggctgctacctaacttttagtcccttccaaaaccatttagtagggttctattacataaacagtagggtttttcctctcctgaccttatccgtttacagttcaatgaaataagtgtatgtgcattgctgtctgtctctattgccaaaatcaaataaatggcttctcagctgctgtttacaacaaacttccctaaccaaaacagaacctctaatttagggctaggaatagaagtcttttgatcccagtccgtgggacagttttgtatgctgtatcttgtacacaggttgtaggttggtttattgccattttgttttatttctgctatataaaaaccaagagccagacaattagacaactatggaggaatgaaaggcaattcaaacatctgcttgattcccgccccgccacccctaatttctgagagaataatggttagagaacattgcatctcacttgaaacatcttgaaaactcgtggaaagggaaaggggaggagatgggactttgaccacacacagtgatgcctcacaccctgaaggtgggggattttgtacctgtttgtacaactttggtcttgatgggaaaaatggagaattaaaaagtgttttgagaagcttaaaaaaaacatg

SEQ ID NO: 313662 - DNA, 3526 bp, Homo sapiens
gacagaatttacgcacccttggcttccttggagcctagcggctctccccgcgtccaagatggcggcagaagcagctggtgggaaatacagaagcacagtcagcaaaagcaaagacccctcggggctgctcatctctgtgatcaggactctgtctactagtgacgatgtcgaagacagggaaaatgaaaagggtcgccttgaagaagcctacgagaaatgtgaccgtgacctggatgaattgattgtacagcactacacagaattgacgacagccattcgcacataccagagcatcacagagcgcatcactaactcccgaaataaaataaagcaggtaaaagagaacctgctttcatgcaagatgctgctgcactgcaaacgggatgagcttcggaaactgtggattgaaggaattgagcataagcatgtcctgaacttgttggatgaaattgagaatatcaagcaagtgcctcaaaagctggaacagtgcatggccagcaagcactatctcagtgccactgacatgttggtgtcagcagttgagtctttggagggccccctgctccaggtggaaggactgagtgaccttcgactagagcttcacagcaagaagatgaaccttcacttggttctcatagatgaactacaccggcacctgtacatcaaatcgactagccgagttgtgcagcgtaacaaggaaaaagggaaaatcagctccctcgtgaaagatgcttctgttcctctgattgatgttacaaacctccctactcctcgaaaattccttgatacctctcactattctactgctggaagctcaagtgtgagggagataaatctgcaggacatcaaggaagatttagaattggatccagaggaaaacagcaccctgtttatgggtatcctcattaagggcttggcgaaactgaagaagatcccagaaacagttaaggcaatcatagagcgcttggagcaggagttgaagcaaattgtgaagaggtctacaacccaggtggcagacagtggctatcagcggggggagaacgttactgtggagaaccaaccaaggttgcttctagaactgctggagttactgtttgacaagtttaatgctgtagccgctgcacactctgtggtcctgggatacctgcaggacactgtagtgactccactgactcagcaggaagatatcaaactgtatgatatggcagatgtatgggtgaagatccaagatgttctacagatgctattaactgagtacttggatatgaaaaatactcgtacggcctctgaaccatcagctcaactaagctatgccagcactggacgagagtttgcagccttttttgccaagaagaaacctcaaaggccaaaaaattctcttttcaagttcgaatcgtcctcccatgccatcagtatgagcgcctatctgcgagaacagagaagggagctctatagtcggagtggagaactgcaagggggtcctgatgacaacttaattgaaggtggaggaacaaaatttgtctgcaaacctggagccagaaacattaccgtcatattccacccattactaagatttattcaggagattgagcatgctctgggtcttggcccagccaaacagtgtcctcttcgagagtttctcaccgtgtacatcaaaaacatctttctcaatcaagtcttggctgagatcaacaaggagattgaaggagtcactaaaacatctgaccctttgaagattctggccaacgcagacaccatgaaggtgctgggagtgcagcggcctctcctacagagcacaatcattgtggagaagacagttcaagacctcctgaacctgatgcatgacttgagtgcatattcagatcaattcctcaacatggtgtgcgtgaagctccaggagtacaaggacacctgcactgcagcttacaggggtattgtccagtcagaagaaaaacttgtcatcagtgcatcctgggcaaaagatgatgatatcagcagactcttgaaatctctaccaaactggatgaatatggctcaacccaaacagctgaggccaaaaagagaggaggaagaagatttcataagggcagcttttggcaaggagtctgaagttcttattgggaacctgggtgataaattaatccctccacaagacatccttcgtgacgtcagtgacctcaaagccttggccaacatgcatgaaagcctggaatggttggcaagtcgaacaaagtcagctttctccaatctttctacatcccagatgctttctcctgctcaagacagccacacgaacacggatctccccccagtgtcagagcagatcatgcagactctcagtgaacttgccaaatcgttccaggatatggctgaccgctgcttgcttgtcttacatctggaagtgagggttcactgtttccactatcttatccctcttgcaaaggaggggaactatgccattgtggctaatgtggaaagtatggattatgaccccctggtggtcaagctcaacaaagatatcagcgccattgaagaggccatgagcgccagccttcagcagcacaagttccagtatatcttcgaaggcctgggccacctgatctcctgcatcctcattaatggtgcccagtacttcaggcgcatcagtgagtctggcatcaagaaaatgtgtaggaacatttttgttcttcagcagaatttgaccaacatcaccatgtcgcgggaggcagacctggactttgcaaggcagtactacgagatgctttacaacacagctgacgagctcctgaacctggtggtggaccagggtgtgaagtacacggagctggagtacatccacgctctgaccctgctgcaccgcagccaaactggggtgggggaactgaccacccagaacacgaggctgcagaggctcaaagagatcatctgcgagcaggctgccatcaagcaagccaccaaggacaagaagataactaccgtttagcagggcgtactgcggttggtgacgggggtcccctcagtcacactcacttttttccttgcaaatattccccagaagcctaatatgtgctccatgctaccacacacaagggcaaatggatagatgaagaggacacccttattatctaagagtgtgggaactggactggagccaaaaatcccaacagctcaaactcagggctgggtcagaatcaggcggagaacccggagtggtgacagtgatggcagcagagccagggtgagactgagagtgctcagactaattttcttggaagtagtggaaagctccgctaaaaaagaaacatgggtttggattgagcagaatgtcaagagccctgagaaccaaccaaaaaatggcagatgagctgtttcaggggcaacatttaggaaagtgaaatctctgctttgcttacaatgacgggactgaaaatggcaattctgcacaggaaagggactgtgggactcttccaagacatttaggacatccaagtttctttgaaggttggcacatcagtctttattcttc

SEQ ID NO: 313663 - DNA, 2553 bp, Homo sapiens
gacagaatttacgcacccttggcttccttggagcctagcggctctccccgcgtccaagatggcggcagaagcagctggtgggaaatacagaagcacagtcagcaaaagcaaagacccctcggggctgctcatctctgtgatcaggactctgtctactagtgacgatgtcgaagacagggaaaatgaaaagggtcgccttgaagaagcctacgagaaatgtgaccgtgacctggatgaattgattgtacagcactacacagaattgacgacagccattcgcacataccagagcatcacagagcgcatcactaactcccgaaataaaataaagcaggtaaaagagaacctgctttcatgcaagatgctgctgcactgcaaacgggatgagcttcggaaactgtggattgaaggaattgagcataagcatgtcctgaacttgttggatgaaattgagaatatcaagcaagtgcctcaaaagctggaacagtgcatggccagcaagcactatctcagtgccactgacatgttggtgtcagcagttgagtctttggagggccccctgctccaggtggaaggactgagtgaccttcgactagagcttcacagcaagaagatgaaccttcacttggttctcatagatgaactacaccggcacctgtacatcaaatcgactagccgagttgtgcagcgtaacaaggaaaaagggaaaatcagctccctcgtgaaagatgcttctgttcctctgattgatgttacaaacctccctactcctcgaaaattccttgatacctctcactattctactgctggaagctcaagtgtgagggagataaatctgcaggacatcaaggaagatttagaattggatccagaggaaaacagcaccctgtttatgggtatcctcattaagggcttggcgaaactgaagaagatcccagaaacagttaaggcaatcatagagcgcttggagcaggagttgaagcaaattgtgaagaggtctacaacccaggtggcagacagtggctatcagcggggggagaacgttactgtggagaaccaaccaaggttgcttctagaactgctggagttactgtttgacaagtttaatgctgtagccgctgcacactctgtggtcctgggatacctgcaggacactgtagtgactccactgactcagcaggaagatatcaaactgtatgatatggcagatgtatgggtgaagatccaagatgttctacagatgctattaactgagtacttggatatgaaaaatactcgtacggcctctgaaccatcagctcaactaagctatgccagcactggacgagagtttgcagccttttttgccaagaagaaacctcaaaggccaaaaaattctcttttcaagttcgaatcgtcctcccatgccatcagtatgagcgcctatctgcgagaacagagaagggagctctatagtcggagtggagaactgcaagggggtcctgatgacaacttaattgaaggtggaggaacaaaatttgtctgcaaacctggagccagaaacattaccgtcatattccacccattactaagatttattcaggagattgagcatgctctgggtcttggcccagccaaacagtgtcctcttcgagagtttctcaccgtgtacatcaaaaacatctttctcaatcaagtcttggctgagatcaacaaggagattgaaggagtcactaaaacatctgaccctttgaagattctggccaacgcagacaccatgaaggtgctgggagtgcagcggcctctcctacagagcacaatcattgtggagaagacagttcaagacctcctgaacctgatgcatgacttgagtgcatattcagatcaattcctcaacatggtgtgcgtgaagctccaggagtacaaggacacctgcactgcagcttacaggggtattgtccagtcagaagaaaaacttgtcatcagtgcatcctgggcaaaagatgatgatatcagcagactcttgaaatctctaccaaactggatgaatatggctcaacccaaacagctgaggccaaaaagagaggaggaagaagatttcataagggcagcttttggcaaggagtctgaagttcttattgggaacctgggtgataaattaatccctccacaagacatccttcgtgacgtcagtgacctcaaagccttggccaacatgcatgaaagcctggaatggttggcaagtcgaacaaagtcagctttctccaatctttctacatcccagatgctttctcctgctcaagacagccacacgaacacggatctccccccagtgtcagagcagatcatgcagactctcagtgaacttgccaaatcgttccaggatatggctgaccgctgcttgcttgtcttacatctggaagtgagggttcactgtttccactatcttatccctcttgcaaaggaggggaactatgccattgtggtaagtgaagttggtatgacccggtgtcagctcacaagattaggcatgagagcagacgcagctcagagacagtccgatattcaagcggc

SEQ ID NO: 313664 - DNA, 632 bp, Homo sapiens
cagtgagagaatgctgtatctggatacacaggtgtacggggggggcagtggccataggggagaactgctgctatataaaaaccaagagccagacaattagacaactatggaggaatgaaaggcaattcaaacatctgcttgattcccgccccgccacccctaatttctgagagaataatggttagagaacattgcatctcacttgaaacatcctttgggggtaaatgattcttaggtgctcacttggtctgagctcagctgaatgcagggaagatgggacagagtgacatttctcctctgtgcggcctccagctgagcctgtctctgaattgttccctcccccgcaatgtgggcacttaccatgttcctggcacactggacctcaccatgtcccccggtcaccagtcctcttgctgcccatggttcataggtcatagaaggcagcaatgcactgactgggccacatcttgaaaactcgtggaaagggaaaggggaggagatgggactttgaccacacacagtgatgcctcacaccctgaaggtgggggattttgtacctgtttgtacaactttggtcttgatgggaaaaatggagaattaaaaagtgttttgagaagcttaaaaaaaacatg

SEQ ID NO: 313665 - DNA, 2378 bp, Homo sapiens
  misc_feature (2356)..(2356): n is a, c, g, or t
  misc_feature (2362)..(2362): n is a, c, g, or t
  misc_feature (2375)..(2375): n is a, c, g, or t
  misc_feature (2378)..(2378): n is a, c, g, or t
gacagaatttacgcacccttggcttccttggagcctagcggctctccccgcgtccaagatggcggcagaagcagctggtgggaaatacagaagcacagtcagcaaaagcaaagacccctcggggctgctcatctctgtgatcaggactctgtctactagtgacgatgtcgaagacagggaaaatgaaaagggtcgccttgaagaagcctacgagaaatgtgaccgtgacctggatgaattgattgtacagcactacacagaattgacgacagccattcgcacataccagagcatcacagagcgcatcactaactcccgaaataaaataaagcaggtaaaagagaacctgctttcatgcaagatgctgctgcactgcaaacgggatgagcttcggaaactgtggattgaaggaattgagcataagcatgtcctgaacttgttggatgaaattgagaatatcaagcaagtgcctcaaaagctggaacagtgcatggccagcaagcactatctcagtgccactgacatgttggtgtcagcagttgagtctttggagggccccctgctccaggtggaaggactgagtgaccttcgactagagcttcacagcaagaagatgaaccttcacttggttctcatagatgaactacaccggcacctgtacatcaaatcgactagccgagttgtgcagcgtaacaaggaaaaagggaaaatcagctccctcgtgaaagatgcttctgttcctctgattgatgttacaaacctccctactcctcgaaaattccttgatacctctcactattctactgctggaagctcaagtgtgagggagataaatctgcaggacatcaaggaagatttagaattggatccagaggaaaacagcaccctgtttatgggtatcctcattaagggcttggcgaaactgaagaagatcccagaaacagttaaggcaatcatagagcgcttggagcaggagttgaagcaaattgtgaagaggtctacaacccaggtggcagacagtggctatcagcggggggagaacgttactgtggagaaccaaccaaggttgcttctagaactgctggagttactgtttgacaagtttaatgctgtagccgctgcacactctgtggtcctgggatacctgcaggacactgtagtgactccactgactcagcaggaagatatcaaactgtatgatatggcagatgtatgggtgaagatccaagatgttctacagatgctattaactgagtacttggatatgaaaaatactcgtacggcctctgaaccatcagctcaactaagctatgccagcactggacgagagtttgcagccttttttgccaagaagaaacctcaaaggccaaaaaattctcttttcaagttcgaatcgtcctcccatgccatcagtatgagcgcctatctgcgagaacagagaagggagctctatagtcggagtggagaactgcaagggggtcctgatgacaacttaattgaaggtggaggaacaaaatttgtctgcaaacctggagccagaaacattaccgtcatattccacccattactaagatttattcaggagattgagcatgctctgggtcttggcccagccaaacagtgtcctcttcgagagtttctcaccgtgtacatcaaaaacatctttctcaatcaagtcttggctgagatcaacaaggagattgaaggagtcactaaaacatctgaccctttgaagattctggccaacgcagacaccatgaaggtgctgggagtgcagcggcctctcctacagagcacaatcattgtggagaagacagttcaagacctcctgaacctgatgcatgacttgagtgcatattcagatcaattcctcaacatggtgtgcgtgaagctccaggagtacaaggacacctgcactgcagcttacaggggtattgtccagtcagaagaaaaacttgtcatcagtgcatcctgggcaaaagatgatgatatcagcagactcttgaaatctctaccaaactggatgaatatggctcaacccaaacagctgaggccaaaaagagaggaggaagaagatttcataagggcagcttttggcaaggagtctgaagttcttattgggaacctgggtgataaattaatccctccacaagacatccttcgtgacgtcagtgacctcaaagccttggccaacatgcatgaaagcctggaatggttggcaagtcgaacaaagtcagctttctccaatctttctacatcccagatgctttctcctgctcaagacagccacacgaacacggatctccccccagtgtcagagcagatcatgcagactctcagtgaacggggggatccnaaaaancgaaaacaggcancan

SEQ ID NO: 313666 - DNA, 1627 bp, Homo sapiens
gacagaatttacgcacccttggcttccttggagcctagcggctctccccgcgtccaagatggcggcagaagcagctggtgggaaatacagaagcacagtcagcaaaagcaaagacccctcggggctgctcatctctgtgatcaggactctgtctactagtgacgatgtcgaagacagggaaaatgaaaagggtcgccttgaagaagcctacgagaaatgtgaccgtgacctggatgaattgattgtacagcactacacagaattgacgacagccattcgcacataccagagcatcacagagcgcatcactaactcccgaaataaaataaagcaggtaaaagagaacctgctttcatgcaagatgctgctgcactgcaaacgggatgagcttcggaaactgtggattgaaggaattgagcataagcatgtcctgaacttgttggatgaaattgagaatatcaagcaagtgcctcaaaagctggaacagtgcatggccagcaagcactatctcagtgccactgacatgttggtgtcagcagttgagtctttggagggccccctgctccaggtggaaggactgagtgaccttcgactagagcttcacagcaagaagatgaaccttcacttggttctcatagatgaactacaccggcacctgtacatcaaatcgactagccgagttgtgcagcgtaacaaggaaaaagggaaaatcagctccctcgtgaaagatgcttctgttcctctgattgatgttacaaacctccctactcctcgaaaattccttgatacctctcactattctactgctggaagctcaagtgtgagggagataaatctgcaggacatcaaggaagatttagaattggatccagaggaaaacagcaccctgtttatgggtatcctcattaagggcttggcgaaactgaagaagatcccagaaacagttaaggcaatcatagagcgcttggagcaggagttgaagcaaattgtgaagaggtctacaacccaggtggcagacagtggctatcagcggggggagaacgttactgtggagaaccaaccaaggttgcttctagaactgctggagttactgtttgacaagtttaatgctgtagccgctgcacactctgtggtcctgggatacctgcaggacactgtagtgactccactgactcagcaggaagatatcaaactgtatgatatggcagatgtatgggtgaagatccaagatgttctacagatgctattaactgagtacttggatatgaaaaatactcgtacggcctctgaaccatcagctcaactaagctatgccagcactggacgagagtttgcagccttttttgccaagaagaaacctcaaaggccaaaaaattctcttttcaagttcgaatcgtcctcccatgccatcagtatgagcgcctatctgcgagaacagagaagggagctctatagtcggagtggagaactgcaagggtagcggcgaagaaatccaccagaaagacaatcaaagtaacattaaaaagctcaaattttacaaaagttaagttcctgccaacattttcaatttatcatacaattagaaatgtgactcagtctaacaacacccaagaggataaaaggatta

SEQ ID NO: 313667 - DNA, 1266 bp, Homo sapiens
gacagaatttacgcacccttggcttccttggagcctagcggctctccccgcgtccaagatggcggcagaagcagctggtgggaaatacagaagcacagtcagcaaaagcaaagacccctcggggctgctcatctctgtgatcaggactctgtctactagtgacgatgtcgaagacagggaaaatgaaaagggtcgccttgaagaagcctacgagaaatgtgaccgtgacctggatgaattgattgtacagcactacacagaattgacgacagccattcgcacataccagagcatcacagagcgcatcactaactcccgaaataaaataaagcaggtaaaagagaacctgctttcatgcaagatgctgctgcactgcaaacgggatgagcttcggaaactgtggattgaaggaattgagcataagcatgtcctgaacttgttggatgaaattgagaatatcaagcaagtgcctcaaaagctggaacagtgcatggccagcaagcactatctcagtgccactgacatgttggtgtcagcagttgagtctttggagggccccctgctccaggtggaaggactgagtgaccttcgactagagcttcacagcaagaagatgaaccttcacttggttctcatagatgaactacaccggcacctgtacatcaaatcgactagccgagttgtgcagcgtaacaaggaaaaagggaaaatcagctccctcgtgaaagatgcttctgttcctctgattgatgttacaaacctccctactcctcgaaaattccttgatacctctcactattctactgctggaagctcaagtgtgagggagataaatctgcaggacatcaaggaagatttagaattggatccagaggaaaacagcaccctgtttatgggtatcctcattaagggcttggcgaaactgaagaagatcccagaaacagttaaggcaatcatagagcgcttggagcaggagttgaagcaaattgtgaagaggtctacaacccaggtggcagacagtggctatcagcggggggagaacgttactgtggagaaccaaccaaggttgcttctagaactgctggagttactgtttgacaagtttaatgctgtagccgctgcacactctgtggtcctgggatacctgcaggacactgtagtgactccactgactcagcaggaagatatcaaactgtatgatatggcagatgtatgggtgaagatccaagatgttctacaggtaagagccttttacaaagggtgtca

SEQ ID NO: 313668 - DNA, 348 bp, Homo sapiens
tcgtaagctccctttgttagtatctttttaagacgtctttcttatttataatattgccaggttattaagttgtacttaattgtctttcatttttttctcttttcaggtgtcagcagttgagtctttggagggccccctgctccaggtggaaggactgagtgaccttcgactagagcttcacagcaagaagatgaaccttcacttggttctcatagatgaactacaccggcacctgtacatcaaatcgactagccgagttgtgcagcgtaacaaggaaaaagggaaaatcaggttaaagaggctctttgctataagtgtcttgtggcagtgtaggattggaaggaatat

SEQ ID NO: 313669 - DNA, 341 bp, Homo sapiens
agatcacagttgtaccagttgaaatgcagaataagcaaaagatccaaatacggttgtaaaggagccttagccaggaatatcgctcataaatcaaggtctgcggcagctggccctggccctgtcatggtatagccaaagtgtcttcatcacggaacatcggggagcaccacacagaccagagtagaataatgtggaatacagagctggtcagcacttaattggtttacacctgcttgtctgtttcccctgtgtttctctgcaggttcgaatcgtcctcccatgccatcagtatgagcgcctatctgcgagaacagagaagggagctctatagtcggagtgga

SEQ ID NO: 313670 - DNA, 4225 bp, Homo sapiens
gacagaatttacgcacccttggcttccttggagcctagcggctctccccgcgtccaagatggcggcagaagcagctggtgggaaatacagaagcacagtcagcaaaagcaaagacccctcggggctgctcatctctgtgatcaggactctgtctactagtgacgatgtcgaagacagggaaaatgaaaagggtcgccttgaagaagcctacgagaaatgtgaccgtgacctggatgaattgattgtacagcactacacagaattgacgacagccattcgcacataccagagcatcacagagcgcatcactaactcccgaaataaaataaagcaggtaaaagagaacctgctttcatgcaagatgctgctgcactgcaaacgggatgagcttcggaaactgtggattgaaggaattgagcataagcatgtcctgaacttgttggatgaaattgagaatatcaagcaagtgcctcaaaagctggaacagtgcatggccagcaagcactatctcagtgccactgacatgttggtgtcagcagttgagtctttggagggccccctgctccaggtggaaggactgagtgaccttcgactagagcttcacagcaagaagatgaaccttcacttggttctcatagatgaactacaccggcacctgtacatcaaatcgactagccgagttgtgcagcgtaacaaggaaaaagggaaaatcagctccctcgtgaaagatgcttctgttcctctgattgatgttacaaacctccctactcctcgaaaattccttgatacctctcactattctactgctggaagctcaagtgtgagggagataaatctgcaggacatcaaggaagatttagaattggatccagaggaaaacagcaccctgtttatgggtatcctcattaagggcttggcgaaactgaagaagatcccagaaacagttaaggcaatcatagagcgcttggagcaggagttgaagcaaattgtgaagaggtctacaacccaggtggcagacagtggctatcagcggggggagaacgttactgtggagaaccaaccaaggttgcttctagaactgctggagttactgtttgacaagtttaatgctgtagccgctgcacactctgtggtcctgggatacctgcaggacactgtagtgactccactgactcagcaggaagatatcaaactgtatgatatggcagatgtatgggtgaagatccaagatgttctacagatgctattaactgagtacttggatatgaaaaatactcgtacggcctctgaaccatcagctcaactaagctatgccagcactggacgagagtttgcagccttttttgccaagaagaaacctcaaaggccaaaaaattctcttttcaagttcgaatcgtcctcccatgccatcagtatgagcgcctatctgcgagaacagagaagggagctctatagtcggagtggagaactgcaagggggtcctgatgacaacttaattgaaggtggaggaacaaaatttgtctgcaaacctggagccagaaacattaccgtcatattccacccattactaagatttattcaggagattgagcatgctctgggtcttggcccagccaaacagtgtcctcttcgagagtttctcaccgtgtacatcaaaaacatctttctcaatcaagtcttggctgagatcaacaaggagattgaaggagtcactaaaacatctgaccctttgaagattctggccaacgcagacaccatgaaggtgctgggagtgcagcggcctctcctacagagcacaatcattgtggagaagacagttcaagacctcctgaacctgatgcatgacttgagtgcatattcagatcaattcctcaacatggtgtgcgtgaagctccaggagtacaaggacacctgcactgcagcttacaggggtattgtccagtcagaagaaaaacttgtcatcagtgcatcctgggcaaaagatgatgatatcagcagactcttgaaatctctaccaaactggatgaatatggctcaacccaaacagctgaggccaaaaagagaggaggaagaagatttcataagggcagcttttggcaaggagtctgaagttcttattgggaacctgggtgataaattaatccctccacaagacatccttcgtgacgtcagtgacctcaaagccttggccaacatgcatgaaagcctggaatggttggcaagtcgaacaaagtcagctttctccaatctttctacatcccagatgctttctcctgctcaagacagccacacgaacacggatctccccccagtgtcagagcagatcatgcagactctcagtgaacttgccaaatcgttccaggatatggctgaccgctgcttgcttgtcttacatctggaagtgagggttcactgtttccactatcttatccctcttgcaaaggaggggaactatgccattgtggctaatgtggaaagtatggattatgaccccctggtggtcaagctcaacaaagatatcagcgccattgaagaggccatgagcgccagccttcagcagcacaagttccagtatatcttcgaaggcctgggccacctgatctcctgcatcctcattaatggtgcccagtacttcaggcgcatcagtgagtctggcatcaagaaaatgtgtaggaacatttttgttcttcagcagaatttgaccaacatcaccatgtcgcgggaggcagacctggactttgcaaggcagtactacgagatgctttacaacacagctgacgagctcctgaacctggtggtggaccagggtgtgaagtacacggagctggagtacatccacgctctgaccctgctgcaccgcagccaaactggggtgggggaactgaccacccagaacacgaggctgcagaggctcaaagagatcatctgcgagcaggctgccatcaagcaagccaccaaggacaagaagataactaccgtttagcagggcgtactgcggttggtgacgggggtcccctcagtcacactcacttttttccttggtatgttattgagtatattctgagcttagttttctctacagtgatactttagtggagaggaggtgtaaggattctttctctctggttttggcttttcatataaatgctaaaggaaggcgacagtacagagtgttttggttgaacaactactttaatgcagtcaaatctaacgggactagggtgggatagggaggaaggtggtatcaaattgttggactctgaaaaacaagtggatggattactaatatttgatttattactcaatatatatataattccagccttggaaagtaggaaagtaggctgctacctaacttttagtcccttccaaaaccatttagtagggttctattacataaacagtagggtttttcctctcctgaccttatccgtttacagttcaatgaaataagtgtatgtgcattgctgtctgtctctattgccaaaatcaaataaatggcttctcagctgctgtttacaacaaacttccctaaccaaaacagaacctctaatttagggctaggaatagaagtcttttgatcccagtccgtgggacagttttgtatgctgtatcttgtacacaggttgtaggttggtttattgccattttgttttatttctgctatataaaaaccaagagccagacaattagacaactatggaggaatgaaaggcaattcaaacatctgcttgattcccgccccgccacccctaatttctgagagaataatggttagagaacattgcatctcacttgaaacatcctttgggggtaaatgattcttaggtgctcacttggtctgagctcagctgaatgcagggaagatgggacagagtgacatttctcctctgtgcggcctccagctgagcctgtctctgaattgttccctcccccgcaatgtgggcacttaccatgttcctggcacactggacctcaccatgtcccccggtcaccagtcctcttgctgcccatggttcataggtcatagaaggcagcaatgcactgactgggccacatcttgaaaactcgtggaaagggaaaggggaggagatgggactttgaccacacacagtgatgcctcacaccctgaaggtgggggattttgtacctgtttgtacaactttggtcttgatgggaaaaatggagaattaaaaagtgttttgagaagcttaaaaaaaacatg

SEQ ID NO: 313671 - DNA, 2973 bp, Homo sapiens
aaaaccaaaatgagcaaaggagaggatcccaataatcccagatctataaagcggatttctcaagggggtagagataaccacctagctattgctaaatgtgatctcactcagttgaaaaagaaacaatcagaagtgagcaatgggagccgtgaaaccatctcaatgaagacttgttgccaacatggagatagaggatattggtctacagggtactattggagagggggtcctgatgacaacttaattgaaggtggaggaacaaaatttgtctgcaaacctggagccagaaacattaccgtcatattccacccattactaagatttattcaggagattgagcatgctctgggtcttggcccagccaaacagtgtcctcttcgagagtttctcaccgtgtacatcaaaaacatctttctcaatcaagtcttggctgagatcaacaaggagattgaaggagtcactaaaacatctgaccctttgaagattctggccaacgcagacaccatgaaggtgctgggagtgcagcggcctctcctacagagcacaatcattgtggagaagacagttcaagacctcctgaacctgatgcatgacttgagtgcatattcagatcaattcctcaacatggtgtgcgtgaagctccaggagtacaaggacacctgcactgcagcttacaggggtattgtccagtcagaagaaaaacttgtcatcagtgcatcctgggcaaaagatgatgatatcagcagactcttgaaatctctaccaaactggatgaatatggctcaacccaaacagctgaggccaaaaagagaggaggaagaagatttcataagggcagcttttggcaaggagtctgaagttcttattgggaacctgggtgataaattaatccctccacaagacatccttcgtgacgtcagtgacctcaaagccttggccaacatgcatgaaagcctggaatggttggcaagtcgaacaaagtcagctttctccaatctttctacatcccagatgctttctcctgctcaagacagccacacgaacacggatctccccccagtgtcagagcagatcatgcagactctcagtgaacttgccaaatcgttccaggatatggctgaccgctgcttgcttgtcttacatctggaagtgagggttcactgtttccactatcttatccctcttgcaaaggaggggaactatgccattgtggctaatgtggaaagtatggattatgaccccctggtggtcaagctcaacaaagatatcagcgccattgaagaggccatgagcgccagccttcagcagcacaagttccagtatatcttcgaaggcctgggccacctgatctcctgcatcctcattaatggtgcccagtacttcaggcgcatcagtgagtctggcatcaagaaaatgtgtaggaacatttttgttcttcagcagaatttgaccaacatcaccatgtcgcgggaggcagacctggactttgcaaggcagtactacgagatgctttacaacacagctgacgagctcctgaacctggtggtggaccagggtgtgaagtacacggagctggagtacatccacgctctgaccctgctgcaccgcagccaaactggggtgggggaactgaccacccagaacacgaggctgcagaggctcaaagagatcatctgcgagcaggctgccatcaagcaagccaccaaggacaagaagataactaccgtttagcagggcgtactgcggttggtgacgggggtcccctcagtcacactcacttttttccttggtatgttattgagtatattctgagcttagttttctctacagtgatactttagtggagaggaggtgtaaggattctttctctctggttttggcttttcatataaatgctaaaggaaggcgacagtacagagtgttttggttgaacaactactttaatgcagtcaaatctaacgggactagggtgggatagggaggaaggtggtatcaaattgttggactctgaaaaacaagtggatggattactaatatttgatttattactcaatatatatataattccagccttggaaagtaggaaagtaggctgctacctaacttttagtcccttccaaaaccatttagtagggttctattacataaacagtagggtttttcctctcctgaccttatccgtttacagttcaatgaaataagtgtatgtgcattgctgtctgtctctattgccaaaatcaaataaatggcttctcagctgctgtttacaacaaacttccctaaccaaaacagaacctctaatttagggctaggaatagaagtcttttgatcccagtccgtgggacagttttgtatgctgtatcttgtacacaggttgtaggttggtttattgccattttgttttatttctgctatataaaaaccaagagccagacaattagacaactatggaggaatgaaaggcaattcaaacatctgcttgattcccgccccgccacccctaatttctgagagaataatggttagagaacattgcatctcacttgaaacatcctttgggggtaaatgattcttaggtgctcacttggtctgagctcagctgaatgcagggaagatgggacagagtgacatttctcctctgtgcggcctccagctgagcctgtctctgaattgttccctcccccgcaatgtgggcacttaccatgttcctggcacactggacctcaccatgtcccccggtcaccagtcctcttgctgcccatggttcataggtcatagaaggcagcaatgcactgactgggccacatcttgaaaactcgtggaaagggaaaggggaggagatgggactttgaccacacacagtgatgcctcacaccctgaaggtgggggattttgtacctgtttgtacaactttggtcttgatgggaaaaatggagaattaaaaagtgttttgagaagcttaaaaaaaacatg

SEQ ID NO: 313672 - DNA, 4101 bp, Homo sapiens
gacagaatttacgcacccttggcttccttggagcctagcggctctccccgcgtccaagatggcggcagaagcagctggtgggaaatacagaagcacagtcagcaaaagcaaagacccctcggggctgctcatctctgtgatcaggactctgtctactagtgacgatgtcgaagacagggaaaatgaaaagggtcgccttgaagaagcctacgagaaatgtgaccgtgacctggatgaattgattgtacagcactacacagaattgacgacagccattcgcacataccagagcatcacagagcgcatcactaactcccgaaataaaataaagcaggtaaaagagaacctgctttcatgcaagatgctgctgcactgcaaacgggatgagcttcggaaactgtggattgaaggaattgagcataagcatgtcctgaacttgttggatgaaattgagaatatcaagcaagtgcctcaaaagctggaacagtgcatggccagcaagcactatctcagtgccactgacatgttggtgtcagcagttgagtctttggagggccccctgctccaggtggaaggactgagtgaccttcgactagagcttcacagcaagaagatgaaccttcacttggttctcatagatgaactacaccggcacctgtacatcaaatcgactagccgagttgtgcagcgtaacaaggaaaaagggaaaatcagctccctcgtgaaagatgcttctgttcctctgattgatgttacaaacctccctactcctcgaaaattccttgatacctctcactattctactgctggaagctcaagtgtgagggagataaatctgcaggacatcaaggaagatttagaattggatccagaggaaaacagcaccctgtttatgggtatcctcattaagggcttggcgaaactgaagaagatcccagaaacagttaaggcaatcatagagcgcttggagcaggagttgaagcaaattgtgaagaggtctacaacccaggtggcagacagtggctatcagcggggggagaacgttactgtggagaaccaaccaaggttgcttctagaactgctggagttactgtttgacaagtttaatgctgtagccgctgcacactctgtggtcctgggatacctgcaggacactgtagtgactccactgactcagcaggaagatatcaaactgtatgatatggcagatgtatgggtgaagatccaagatgttctacagatgctattaactgagtacttggatatgaaaaatactcgtacggcctctgaaccatcagctcaactaagctatgccagcactggacgagagtttgcagccttttttgccaagaagaaacctcaaaggccaaaaaattctcttttcaagttcgaatcgtcctcccatgccatcagtatgagcgcctatctgcgagaacagagaagggagctctatagtcggagtggagaactgcaagggggtcctgatgacaacttaattgaaggtggaggaacaaaatttgtctgcaaacctggagccagaaacattaccgtcatattccacccattactaagatttattcaggagattgagcatgctctgggtcttggcccagccaaacagtgtcctcttcgagagtttctcaccgtgtacatcaaaaacatctttctcaatcaagtcttggctgagatcaacaaggagattgaaggagtcactaaaacatctgaccctttgaagattctggccaacgcagacaccatgaaggtgctgggagtgcagcggcctctcctacagagcacaatcattgtggagaagacagttcaagacctcctgaacctgatgcatgacttgagtgcatattcagatcaattcctcaacatggtgtgcgtgaagctccaggagtacaaggacacctgcactgcagcttacaggggtattgtccagtcagaagaaaaacttgtcatcagtgcatcctgggcaaaagatgatgatatcagcagactcttgaaatctctaccaaactggatgaatatggctcaacccaaacagctgaggccaaaaagagaggaggaagaagatttcataagggcagcttttggcaaggagtctgaagttcttattgggaacctgggtgataaattaatccctccacaagacatccttcgtgacgtcagtgacctcaaagccttggccaacatgcatgaaagcctggaatggttggcaagtcgaacaaagtcagctttctccaatctttctacatcccagatgctttctcctgctcaagacagccacacgaacacggatctccccccagtgtcagagcagatcatgcagactctcagtgaacttgccaaatcgttccaggatatggctgaccgctgcttgcttgtcttacatctggaagtgagggttcactgtttccactatcttatccctcttgcaaaggaggggaactatgccattgtggctaatgtggaaagtatggattatgaccccctggtggtcaagctcaacaaagatatcagcgccattgaagaggccatgagcgccagccttcagcagcacaagttccagtatatcttcgaaggcctgggccacctgatctcctgcatcctcattaatggtgcccagtacttcaggcgcatcagtgagtctggcatcaagaaaatgtgtaggaacatttttgttcttcagcagaatttgaccaacatcaccatgtcgcgggaggcagacctggactttgcaaggcagtactacgagatgctttacaacacagctgacgagctcctgaacctggtggtggaccagggtgtgaagtacacggagctggagtacatccacgctctgaccctgctgcaccgcagccaaactggggtgggggaactgaccacccagaacacgaggctgcagaggctcaaagagatcatctgcgagcaggctgccatcaagcaagccaccaaggacaagaagataactaccgtttagcagggcgtactgcggttggtgacgggggtcccctcagtcacactcacttttttccttggtatgttattgagtatattctgagcttagttttctctacagtgatactttagtggagaggaggtgtaaggattctttctctctggttttggcttttcatataaatgctaaaggaaggcgacagtacagagtgttttggttgaacaactactttaatgcagtcaaatctaacgggactagggtgggatagggaggaaggtggtatcaaattgttggactctgaaaaacaagtggatggattactaatatttgatttattactcaatatatatataattccagccttggaaagtaggaaagtaggctgctacctaacttttagtcccttccaaaaccatttagtagggttctattacataaacagtagggtttttcctctcctgaccttatccgtttacagttcaatgaaataagtgtatgtgcattgctgtctgtctctattgccaaaatcaaataaatggcttctcagctgctgtttacaacaaacttccctaaccaaaacagaacctctaatttagggctaggaatagaagtcttttgatcccagtccgtgggacagttttgtatgctgtatcttgtacacaggttgtaggttggtttattgccattttgttttatttctgctatataaaaaccaagagccagacaattagacaactatggaggaatgaaaggcaattcaaacatctgcttgattcccgccccgccacccctaatttctgagagaataatggttagagaacattgcatctcacttgaaacatcctttgggggtaaatgattcttaggtgctcacttggtctgagctcagctgaatgcagggaagatgggacagagtgacatttctcctctgtgcggcctccagctgagcctgtctctgaattgttccctcccctttccctttccacgagttttcaagatgtggcccagtcagtgcattgctgccttctatgacctatgaaccatgggcagcaagaggactggtgaccgggggacatggtgaggtccagtgtgccaggaacatgataagtgcccacattgcgggggagggaacgtcgagc

SEQ ID NO: 313673 - DNA, 2958 bp, Homo sapiens
gacagaatttacgcacccttggcttccttggagcctagcggctctccccgcgtccaagatggcggcagaagcagctggtgggaaatacagaagcacagtcagcaaaagcaaagacccctcggggctgctcatctctgtgatcaggactctgtctactagtgacgatgtcgaagacagggaaaatgaaaagggtcgccttgaagaagcctacgagaaatgtgaccgtgacctggatgaattgattgtacagcactacacagaattgacgacagccattcgcacataccagagcatcacagagcgcatcactaactcccgaaataaaataaagcaggtaaaagagaacctgctttcatgcaagatgctgctgcactgcaaacgggatgagcttcggaaactgtggattgaaggaattgagcataagcatgtcctgaacttgttggatgaaattgagaatatcaagcaagtgcctcaaaagctggaacagtgcatggccagcaagcactatctcagtgccactgacatgttggtgtcagcagttgagtctttggagggccccctgctccaggtggaaggactgagtgaccttcgactagagcttcacagcaagaagatgaaccttcacttggttctcatagatgaactacaccggcacctgtacatcaaatcgactagccgagttgtgcagcgtaacaaggaaaaagggaaaatcagctccctcgtgaaagatgcttctgttcctctgattgatgttacaaacctccctactcctcgaaaattccttgatacctctcactattctactgctggaagctcaagtgtgagggagataaatctgcaggacatcaaggaagatttagaattggatccagaggaaaacagcaccctgtttatgggtatcctcattaagggcttggcgaaactgaagaagatcccagaaacagttaaggcaatcatagagcgcttggagcaggagttgaagcaaattgtgaagaggtctacaacccaggtggcagacagtggctatcagcggggggagaacgttactgtggagaaccaaccaaggttgcttctagaactgctggagttactgtttgacaagtttaatgctgtagccgctgcacactctgtggtcctgggatacctgcaggacactgtagtgactccactgactcagcaggaagatatcaaactgtatgatatggcagatgtatgggtgaagatccaagatgttctacagatgctattaactgagtacttggatatgaaaaatactcgtacggcctctgaaccatcagctcaactaagctatgccagcactggacgagagtttgcagccttttttgccaagaagaaacctcaaaggccaaaaaattctcttttcaagttcgaatcgtcctcccatgccatcagtatgagcgcctatctgcgagaacagagaagggagctctatagtcggagtggagaactgcaagggggtcctgatgacaacttaattgaaggtggaggaacaaaatttgtctgcaaacctggagccagaaacattaccgtcatattccacccattactaagatttattcaggagattgagcatgctctgggtcttggcccagccaaacagtgtcctcttcgagagtttctcaccgtgtacatcaaaaacatctttctcaatcaagtcttggctgagatcaacaaggagattgaaggagtcactaaaacatctgaccctttgaagattctggccaacgcagacaccatgaaggtgctgggagtgcagcggcctctcctacagagcacaatcattgtggagaagacagttcaagacctcctgaacctgatgcatgacttgagtgcatattcagatcaattcctcaacatggtgtgcgtgaagctccaggagtacaaggacacctgcactgcagcttacaggggtattgtccagtcagaagaaaaacttgtcatcagtgcatcctgggcaaaagatgatgatatcagcagactcttgaaatctctaccaaactggatgaatatggctcaacccaaacagctgaggccaaaaagagaggaggaagaagatttcataagggcagcttttggcaaggagtctgaagttcttattgggaacctgggtgataaattaatccctccacaagacatccttcgtgacgtcagtgacctcaaagccttggccaacatgcatgaaagcctggaatggttggcaagtcgaacaaagtcagctttctccaatctttctacatcccagatgctttctcctgctcaagacagccacacgaacacggatctccccccagtgtcagagcagatcatgcagactctcagtgaacttgccaaatcgttccaggatatggctgaccgctgcttgcttgtcttacatctggaagtgagggttcactgtttccactatcttatccctcttgcaaaggaggggaactatgccattgtggctaatgtggaaagtatggattatgaccccctggtggtcaagctcaacaaagatatcagcgccattgaagaggccatgagcgccagccttcagcagcacaagttccagtatatcttcgaaggcctgggccacctgatctcctgcatcctcattaatggtgcccagtacttcaggcgcatcagtgagtctggcatcaagaaaatgtgtaggaacatttttgttcttcagcagaatttgaccaacatcaccatgtcccccggtcaccagtcctcttgctgcccatggttcataggtcatagaaggcagcaatgcactgactgggccacatcttgaaaactcgtggaaagggaaaggggaggagatgggactttgaccacacacagtgatgcctcacaccctgaaggtgggggattttgtacctgtttgtacaactttggtcttgatgggaaaaatggagaattaaaaagtgttttgagaagcttaaaaaaaacatg

SEQ ID NO: 313674 - DNA, 2849 bp, Homo sapiens
gacagaatttacgcacccttggcttccttggagcctagcggctctccccgcgtccaagatggcggcagaagcagctggtgggaaatacagaagcacagtcagcaaaagcaaagacccctcggggctgctcatctctgtgatcaggactctgtctactagtgacgatgtcgaagacagggaaaatgaaaagggtcgccttgaagaagcctacgagaaatgtgaccgtgacctggatgaattgattgtacagcactacacagaattgacgacagccattcgcacataccagagcatcacagagcgcatcactaactcccgaaataaaataaagcaggtaaaagagaacctgctttcatgcaagatgctgctgcactgcaaacgggatgagcttcggaaactgtggattgaaggaattgagcataagcatgtcctgaacttgttggatgaaattgagaatatcaagcaagtgcctcaaaagctggaacagtgcatggccagcaagcactatctcagtgccactgacatgttggtgtcagcagttgagtctttggagggccccctgctccaggtggaaggactgagtgaccttcgactagagcttcacagcaagaagatgaaccttcacttggttctcatagatgaactacaccggcacctgtacatcaaatcgactagccgagttgtgcagcgtaacaaggaaaaagggaaaatcagctccctcgtgaaagatgcttctgttcctctgattgatgttacaaacctccctactcctcgaaaattccttgatacctctcactattctactgctggaagctcaagtgtgagggagataaatctgcaggacatcaaggaagatttagaattggatccagaggaaaacagcaccctgtttatgggtatcctcattaagggcttggcgaaactgaagaagatcccagaaacagttaaggcaatcatagagcgcttggagcaggagttgaagcaaattgtgaagaggtctacaacccaggtggcagacagtggctatcagcggggggagaacgttactgtggagaaccaaccaaggttgcttctagaactgctggagttactgtttgacaagtttaatgctgtagccgctgcacactctgtggtcctgggatacctgcaggacactgtagtgactccactgactcagcaggaagatatcaaactgtatgatatggcagatgtatgggtgaagatccaagatgttctacagatgctattaactgagtacttggatatgaaaaatactcgtacggcctctgaaccatcagctcaactaagctatgccagcactggacgagagtttgcagccttttttgccaagaagaaacctcaaaggccaaaaaattctcttttcaagttcgaatcgtcctcccatgccatcagtatgagcgcctatctgcgagaacagagaagggagctctatagtcggagtggagaactgcaagggggtcctgatgacaacttaattgaaggtggaggaacaaaatttgtctgcaaacctggagccagaaacattaccgtcatattccacccattactaagatttattcaggagattgagcatgctctgggtcttggcccagccaaacagtgtcctcttcgagagtttctcaccgtgtacatcaaaaacatctttctcaatcaagtcttggctgagatcaacaaggagattgaaggagtcactaaaacatctgaccctttgaagattctggccaacgcagacaccatgaaggtgctgggagtgcagcggcctctcctacagagcacaatcattgtggagaagacagttcaagacctcctgaacctgatgcatgacttgagtgcatattcagatcaattcctcaacatggtgtgcgtgaagctccaggagtacaaggacacctgcactgcagcttacaggggtattgtccagtcagaagaaaaacttgtcatcagtgcatcctgggcaaaagatgatgatatcagcagactcttgaaatctctaccaaactggatgaatatggctcaacccaaacagctgaggccaaaaagagaggaggaagaagatttcataagggcagcttttggcaaggagtctgaagttcttattgggaacctgggtgataaattaatccctccacaagacatccttcgtgacgtcagtgacctcaaagccttggccaacatgcatgaaagcctggaatggttggcaagtcgaacaaagtcagctttctccaatctttctacatcccagatgctttctcctgctcaagacagccacacgaacacggatctccccccagtgtcagagcagatcatgcagactctcagtgaacttgccaaatcgttccaggatatggctgaccgctgcttgcttgtcttacatctggaagtgagggttcactgtttccactatcttatccctcttgcaaaggaggggaactatgccattgtggctaatgtggaaagtatggattatgaccccctggtggtcaagctcaacaaagatatcagcgccattgaagaggccatgagcgccagccttcagcagcacaagttccagtatatcttcgaaggcctgggccacctgatctcctgcatcctcattaatggtgcccagtacttcaggcgcatcagtgagtctggcatcaagaaaatgtgtaggaacatttttgttcttcagcagaatttgaccaacatcaccatgtcgcgggaggcagacctggactttgcaaggtaggagggaaaactgggtttagtttcttatgccaaagctaagacctcgttgcctgtgaagtcatttttaaaaatagactcttggtgcagaaaaagcttagttt

SEQ ID NO: 313675 - DNA, 2396 bp, Homo sapiens
gacagaatttacgcacccttggcttccttggagcctagcggctctccccgcgtccaagatggcggcagaagcagctggtgggaaatacagaagcacagtcagcaaaagcaaagacccctcggggctgctcatctctgtgatcaggactctgtctactagtgacgatgtcgaagacagggaaaatgaaaagggtcgccttgaagaagcctacgagaaatgtgaccgtgacctggatgaattgattgtacagcactacacagaattgacgacagccattcgcacataccagagcatcacagagcgcatcactaactcccgaaataaaataaagcaggtaaaagagaacctgctttcatgcaagatgctgctgcactgcaaacgggatgagcttcggaaactgtggattgaaggaattgagcataagcatgtcctgaacttgttggatgaaattgagaatatcaagcaagtgcctcaaaagctggaacagtgcatggccagcaagcactatctcagtgccactgacatgttggtgtcagcagttgagtctttggagggccccctgctccaggtggaaggactgagtgaccttcgactagagcttcacagcaagaagatgaaccttcacttggttctcatagatgaactacaccggcacctgtacatcaaatcgactagccgagttgtgcagcgtaacaaggaaaaagggaaaatcagctccctcgtgaaagatgcttctgttcctctgattgatgttacaaacctccctactcctcgaaaattccttgatacctctcactattctactgctggaagctcaagtgtgagggagataaatctgcaggacatcaaggaagatttagaattggatccagaggaaaacagcaccctgtttatgggtatcctcattaagggcttggcgaaactgaagaagatcccagaaacagttaaggcaatcatagagcgcttggagcaggagttgaagcaaattgtgaagaggtctacaacccaggtggcagacagtggctatcagcggggggagaacgttactgtggagaaccaaccaaggttgcttctagaactgctggagttactgtttgacaagtttaatgctgtagccgctgcacactctgtggtcctgggatacctgcaggacactgtagtgactccactgactcagcaggaagatatcaaactgtatgatatggcagatgtatgggtgaagatccaagatgttctacagatgctattaactgagtacttggatatgaaaaatactcgtacggcctctgaaccatcagctcaactaagctatgccagcactggacgagagtttgcagccttttttgccaagaagaaacctcaaaggccaaaaaattctcttttcaagttcgaatcgtcctcccatgccatcagtatgagcgcctatctgcgagaacagagaagggagctctatagtcggagtggagaactgcaaggtgagtgattgagcttctctggaaaaattaattttctggaggagtatttcctttattacacatgagtttgtgtcctgcattcacacgatcctttcaaggtaacaaacacttagtgacttaataatttgtttcttctgtaatttcccagcatctgctgccaagcaggtaaaactattactgtggccataggacttgtagacctgctactgttcaagtgggaattcaaagcaaaaagagatgaggccaggctcgtcttgcttaaacagaagacctgagtccagtcacaatctaggagaatgttggtcttctgcgactgccactgttacttctaattgttgtttttgacaccttctagaatatgacaggagtacctgagatttgggaaagggaaaatgcaaccactgtcattatttaaagggaaaaagatgcctctaaatagtatgttataatcaatataactgtgatgaacaggctatttgatacccatgtatagttaccaaagagttgtaagctgaagaagaaaatatttagaaaataaattaaatataaataaatatattagactgataacatttccttctgtgacaaaaagatgctgatcatgtaaatgtaatgagttaagaaaggtttggaggtcaggtgtggtgactaacacctgtaatctcagcactttgggagactgaggcaggcagatcacttgagtccaggagttcaagaccagcctgggcgacatggcgaagccctgtctctataaaaaaatacaaaaattagttggacatggtggcacgtgcgtattcccagctactcaggaggctgaggtgagattgcttgagcctgagaggcagaggttgcagtgagctgagatcatgccactgcacttcagcctgtgtgacaaagtgagaccatgtctcaaaaaaagaa

SEQ ID NO: 313676 - DNA, 1861 bp, Homo sapiens
gacagaatttacgcacccttggcttccttggagcctagcggctctccccgcgtccaagatggcggcagaagcagctggtgggaaatacagaagcacagtcagcaaaagcaaagacccctcggggctgctcatctctgtgatcaggactctgtctactagtgacgatgtcgaagacagggaaaatgaaaagggtcgccttgaagaagcctacgagaaatgtgaccgtgacctggatgaattgattgtacagcactacacagaattgacgacagccattcgcacataccagagcatcacagagcgcatcactaactcccgaaataaaataaagcaggtaaaagagaacctgctttcatgcaagatgctgctgcactgcaaacgggatgagcttcggaaactgtggattgaaggaattgagcataagcatgtcctgaacttgttggatgaaattgagaatatcaagcaagtgcctcaaaagctggaacagtgcatggccagcaagcactatctcagtgccactgacatgttggtgtcagcagttgagtctttggagggccccctgctccaggtggaaggactgagtgaccttcgactagagcttcacagcaagaagatgaaccttcacttggttctcatagatgaactacaccggcacctgtacatcaaatcgactagccgagttgtgcagcgtaacaaggaaaaagggaaaatcagctccctcgtgaaagatgcttctgttcctctgattgatgttacaaacctccctactcctcgaaaattccttgatacctctcactattctactgctggaagctcaagtgtgagggagataaatctgcaggacatcaaggaagatttagaattggatccagaggaaaacagcaccctgtttatgggtatcctcattaagggcttggcgaaactgaagaagatcccagaaacagttaaggcaatcatagagcgcttggagcaggagttgaagcaaattgtgaagaggtctacaacccaggtggcagacagtggctatcagcggggggagaacgttactgtggagaaccaaccaaggttgcttctagaactgctggagttactgtttgacaagtttaatgctgtagccgctgcacactctgtggtcctgggatacctgcaggacactgtagtgactccactgactcagcaggaagatatcaaactgtatgatatggcagatgtatgggtgaagatccaagatgttctacagatgctattaactgagtacttggatatgaaaaatactcgtacggcctctgaaccatcagctcaactaagctatgccagcactggacgagagtttgcagccttttttgccaagaagaaacctcaaaggccaaaaaattctcttttcaagttcgaatcgtcctcccatgccatcagtatgagcgcctatctgcgagaacagagaagggagctctatagtcggagtggagaactgcaagggggtcctgatgacaacttaattgaaggtggaggaacaaaatttgtctgcaaacctggagccagaaacattaccgtcatattccacccattactaagatttattcaggagattgagcatgctctgggtcttggcccagccaaacagtgtcctcttcgagagtttctcaccgtgtacatcaaaaacatctttctcaatcaagtcttggctgagatcaacaaggagattgaaggagtcactaaaacatctgaccctttgaagattctggccaacgcagacaccatgaaggtgctgggagtgcagcggcctctcctacaggtaataatacactttgaacttactatttttatcagcaattttcattgacttggcaagtgtcataaattt

SEQ ID NO: 313677 - DNA, 734 bp, Homo sapiens
gacagaatttacgcacccttggcttccttggagcctagcggctctccccgcgtccaagatggcggcagaagcagctggtgggaaatacagaagcacagtcagcaaaagcaaagacccctcggggctgctcatctctgtgatcaggactctgtctactagtgacgatgtcgaagacagggaaaatgaaaagggtcgccttgaagaagcctacgagaaatgtgaccgtgacctggatgaattgattgtacagcactacacagaattgacgacagccattcgcacataccagagcatcacagagcgcatcactaactcccgaaataaaataaagcaggtaaaagagaacctgctttcatgcaagatgctgctgcactgcaaacgggatgagcttcggaaactgtggattgaaggaattgagcataagcatgtcctgaacttgttggatgaaattgagaatatcaagcaagtgcctcaaaagctggaacagtgcatggccagcaagcactatctcagtgccactgacatgttggtgtcagcagttgagtctttggagggccccctgctccaggtggaaggactgagtgaccttcgactagagcttcacagcaagaagatgaaccttcacttggttctcatagatgaactacaccggcacctgtacatcaaatcgactagccgagttgtgcagcgtaacaaggaaaaagggaaaatcaggttaaagaggctctttgcta

SEQ ID NO: 313678 - DNA, 7306 bp, Homo sapiens
cttagtttacatcctctcccccaatcttcacacacagagccaaagagcagttatattcttgggataccatgatacctctgggaaaggaattatattcccaaggagaggtcccattggataagaacaataccatgggacttgagtctgaatgccaacttactattcacacatccttcttaaaaacgaacacactgtttcttttcctgacctagagcattctaaagttctgttcaaataaataaagggcaaaataaagtagatttaaccaagtgccaggtggaattcaaaaaacacattcttccagataaattctacctttatggtatggatttgaaagtactttgcaggaaaacagtcagtactctttaaaaagggactgcagggctgggtgtagtggctcacacctgtaatcccagcactttgggaggccaaggcaggtgggtcacttgaggccaggagtttgagaccagcctgaccaacatggcaaaaccccatctctactaaaatacaaaaattagctgggcatgatggtgcactcctgtaatcccagctacttggtaggctgaagcatgagaattgcttaaacctgggaggcagaggttgcagtaagccaagatcatgccactgcattccagcctgggcaacagagtaagactctgtcttaataaataaataagaaaataaaacggaactgcagtgctaacagtaatttatacatttttaaatgttctgagtatgttttgactgggctagtgtaacaatatactaccctgaaagtgcagttttgattgttgttggtgtctttgggtcaggaaagtgaactgtgccaagaagtatttttcagtgacatgaatggattcctgttaatgcaattgactgagagattgtgcttacgctttcttaactgacaaaaagaggctttgtccaacatcagaattgttgaaactggtgctgttttctgttgcactgggattctgatgatctgggattttccctccttggcacagtaaacaccatgactgtctttattgagaatgtcgtcacagtcctttagtgatagattagttagacccatggttgcaatacctttatctccccaaagaaaataatcaaaagaaagcacaaaagctaccctgtttgcagaatatttcactgacattgatttgtcattaattctaccagagctgacctcattcaggcttgatagaaacaggttcctatgtttagggcagatccctagcctctcgctcacagtgagtctgcatgtcctagattctggttattgctggagcatccattaaagtctaccaaactcaggacagaagaagatagcagtggatttgtaaaaatttttagtttataaattacagtcattggggaaacactagtaaggtcatgtgatcttttggaccaggattttctctctgtcttctctctgggtgtgtgtgtgtgtatgtacagaagggctaccaggaagtgtcaaccatgttagattttctgtagtcttccagaaacagtgcagcccatacaacaggaatcttaattttcctcacagcaaatataacaggatggaacagttagtgttttgttttcacaagtgtccaccactccatctgccctgcatggagagggctctctcactgctagatctaggctgagccatctggaaggatcaaagggtgtgggagtatcaccccctctcaggctgcagaaggtctcgagggtggcgtcacagcaggatttccgccttctgcattgcactgcacagccccatggaacatgaggcacttgaggccttgcttcttggagcctctggggagcagagtaggtcactgccctctgggagtgttttgcagtagttttgtaaatgtgttgctacatagtcaagttcctttgtggcaaagaaatattttgttttgatattaggagccagcccatgtaatgcctctcaggcttgcttgcttagaagaaaaaagtcaccctttgtggtttttaagaaaaaaattctgtgcagatctgttcctcctcctgctccttcccttttctctacatacagtgctcattggaggctcctgctaaaccttcttaaccagagaaataataggtatttgttagacctgagtgtacatttcacatgttatccttcacatatttctcattttcatctagtactttcttaatgcctttgttggagtccgcatcctcatctttaaaaaaaaaaaaaaaaaacagcttagcctaagccacattcactttttttagttcacaaaaaggatttaatagccacaatgtgatttttgccacaactgtgtgattttaatattctctaatatcaagggcggatttagaattgcaggaaatacctggagaaatcacagtggaatgaatttttgctttaagagaaatgagagttggctgtctctgtaattgataatacagcttcatcctagtcccatctgcatttcagaaaataaccctcatctttacaaaacacaggacacttgtgggacagttaactcaagcagctatggggagggaggagattattgaatggtgattaaataatgcaaatggctcttctgtttcttaaagactgtggaagaggtcagactgcccagttgaggtgggcagttcatactgctcagttgaggtggcagtcatttattctgagtcctgttggatagagcctatctcctcaaggctacagaggcttccaggatatggagctgtgcatgttaatggctcagccttgcctccatcagggcacctgcctaacttggagcaagtgggagagcaccctagagtcatcctctgtgctgtttcgtgagttttgcagcggagacttcaccatccggaggagctgtgtttctgtgtcacttgggatatcacctaaaaatgaaacatttgatattttaaggtataaaaaaaaagtaaattggggaacattggctgcagtccctaaaagatactgttgtctgtgcatcaggttagcttgaggtcaccacaggtcctgggagcccagagagtttaggcatactctcctttggaggccagcagcctttcacaaaccctgcctctaaaagggcggtttcacatttgaccatgtttttgcattagcctcagaaactcttgtctttagctgataacctttgagggatgtgagaagcctagttggagcatctgagaaaatgatacctctcaccttcaaattaatcaaatagtttgtccttctagtccccttataaattaataaatggagggctggtcatggtggctcacgcctgtaatcccagcactttgggaggccgaggcgggtggatcacaaggtcaggagttcaagaccagcctgaccaatatggtgaaaccccatctctactaaaaatacaaaaattagccaggtgtagtggcacgctcctgtagtcccagctactcgggaggctgaggcaggagaatcgcttgaacccaggaggtggatgttgcagtgagccgagatcccgccactgcactgcagcctaggcgacagagcaagactccgtctcaaaaaaaaaaaaagaaaaaaaaagaaaagggaagggaatcccattttgtgatgatttgggcacactacttgagctgaggctagcagtcacatgattttggctgtctctgacctgaagcttttgaagtaaggttatgtctcttccctgaagctttgtttatagtggtaatttggtgagtttgagctttgagcttgtcttagaaaataagactgtccacctggggaggggagcttatagggaacccgtgttaactcagaatgctgaagaaagtgcttttagccaacaaaagtaagattactatctagaaggtggaaagaagtcattgcttctgttcctccagcagtcagttgactctaggtttcctttggtttatatccccagttcttaatactaaaacttatttgacttcctatcaggaagcacacaaaaaaagcgtcatttaaaaccctggatataggctttaaaggatacaaaaacagcagcattgtcgttttgccaggttcatcaccattttgatgtgctacccatccttccaccctccctttcctgcccccaagcctcccagccaggccagatgtgaagattctattaatcactgtttcagagaacattaattcttgtatagaataattatctactaaattgcttattatctgtgactaccttgcagagaacatctcaacagtgcagtaaaatagctctcctagacttgagcttccagccaggcatttagatcactcttaagcctttgtggaattctgaggaaaaaaagcaagatgcctcaatgccaatgctgggccataagattctactcccctccctgtagggtggggcgcgtggctcagctttggaaaatcattttgccagtaatattgcctgtgaatccctttaagaagtcgtcctgatctgagcctgtctttctgagcactttggtgctgaattgaaaatggtaagctaaagcagtgacagatccacgtagcctctttaacctctttattatcttgccaaaaaaaaagtttctcaggttaaacctttgtctttaacctccctttgttgtggagaaaatgtgtcactaatcagtggtccaagggatatctagctttggttactcagttcctgcagcataacagatatgacttatgccagggaaggtagaggctgattatggagacacccaggaacaggaataagaagggataggtctgctccacgtagaacctccccagatcggaagttaagtcttggagagtttccaaagtgctgaagtaaaaaggagacttggagggcctttgcttaatgagcaagaggcttgtgtcctcccaagaacatgagggagttcagaagggagctatagctcacagacagaaacctgcccgctcaccccatccctcgtgactgggagcatgtttgctcagaattttctaagaggactctcccttcaaaaatccaatttgctcccagaatgttgtttagcctctgagaatctcactctttcatttccatctgtgaatggacatagatgtgttgctcagggatcagaaacatcagagtccagggcccagtggcatggtgttgcattagtagttagaaaagtaattggtcagctctactgtaaaagaaataagtatgtagtacagttttgtaaatgtcaggtctgttctattgttttgtgatctgaagactgtcaaactggttgataatcaaagaaaaggttggttagaataagtaaaatttcagttagaaagatatagcttaccagttttccatgtgcttaaggaagtcaagaatatttcaggttgttgagaactgttgtaaaatggaattgaagctagtgtctctcaccttcttaggtgtatcagagagaggaagtggaaggccagtagtagcatcttcatacttacttttgccagcccagcctccatttcaaagactttgtcttccatcctatccaatgacatggtcagggatgggctctgaggaggcagtgaggccccaccttggtttgctccactgtggtgtgtagtctccaaacagcttaagggtttttaagttttctcacgattacctccactccactcatctactatcagcatcagaaaggttaacatccctgggaccattctacttataaaagagatgaactagtgtgctttctccccttttccaggtgtgccatccatatacaatctcctcttggccaagttcaacaaatgtttccagggaaccccgtgggttgaggcaaagtagccaagatgtattgagttaagtttttctagaggacaaaagtatttcttgtcccttttccctcatgctcatatgttttagctgaggcgtaaatggccaagttgagtaatatctgtggaactgagacagagagccagggacccatgtacccagggaccagtcccctggggaatcacacagtggctcagactagactgctctatcccaccagaactctgctgctgttcatttccatcaggaccacccaggaaagcaaataagttagccttctcatcattaggtcacctaatctcttgggttgcaggatgagagcatatatagatctcctgtttagagagtgtgttcataattgtagaaagggatagaaaatggaataaccaagaggctgtgtcattttttaagaggatggcaaggatgacctcaaatgagctcaacaaaactgggaatccaaggaatggtgcttgtagggaaagagaggtcagttgtggtccttaaacctcttggcaccttgtgcgggttataaaacaaggagctggagtaaaattgcccttacccccaatccaaatgctgtccaggatttaggagctacccaacctgtggttatatggtgttggtttccattttttgtttgtttgcttgtttccaaaatagccttgcttggtactgcatggaaagttcaagcttttcttcttgcccgctcagggctggcctcttccccgtgtcttcacagcgtccctaaggaagatttttgcagcactctctggagctgaggggagtgaaatttggtccagagaaggcggaaggaaatagttttcctgtttccttttctcgaggtggatgtcctcaggcttccttcacacctccttctcatgggtgcggctggcagtacagtcaggctgtggaggagggctgagaagaaaggggcactggtccagccccaggtttggtctgagacaggtacacagcagataccatcccaccttcctctctaaagaacaggccagccacacatataaccctttccctactttactaatgtatcccttatgtggtaccagcaatggaggacaggcagacttaccccctgccatctagagagaatgttgttattacccgtaaaacttgaccacccccatatcccactcctttttgtaaaaacaaatgcttaaacctgtgagcctgccgttcctttctatgtgttaatcagtttccttccatttgagctgtgtgggagggaagggcattgaaattgtaggttgtaatcttgtgccaaccaataaaaaccagtatttcacacacaaaaaaaaaaaaaaaaaaaaaaaaaaaaaaaaaaaaaaacccggggggctctttttctgcgggggcgggggaaaaggaggtttgagagaaggggcaggggccaaagggggttcccgggacccgagtttttttgggcaacaggggggagaaaccggggggccccccaaggggggggggggaaaaatcggaaaaacccggggttcccggtagatgttcggtcgaac

SEQ ID NO: 313679 - DNA, 7269 bp, Homo sapiens
cttagtttacatcctctcccccaatcttcacacacagagccaaagagcagttatattcttgggataccatgatacctctgggaaaggaattatattcccaaggagaggtcccattggataagaacaataccatgggacttgagtctgaatgccaacttactattcacacatccttcttaaaaacgaacacactgtttcttttcctgacctagagcattctaaagttctgttcaaataaataaagggcaaaataaagtagatttaaccaagtgccaggtggaattcaaaaaacacattcttccagataaattctacctttatggtatggatttgaaagtactttgcaggaaaacagtcagtactctttaaaaagggactgcagggctgggtgtagtggctcacacctgtaatcccagcactttgggaggccaaggcaggtgggtcacttgaggccaggagtttgagaccagcctgaccaacatggcaaaaccccatctctactaaaatacaaaaattagctgggcatgatggtgcactcctgtaatcccagctacttggtaggctgaagcatgagaattgcttaaacctgggaggcagaggttgcagtaagccaagatcatgccactgcattccagcctgggcaacagagtaagactctgtcttaataaataaataagaaaataaaacggaactgcagtgctaacagtaatttatacatttttaaatgttctgagtatgttttgactgggctagtgtaacaatatactaccctgaaagtgcagttttgattgttgttggtgtctttgggtcaggaaagtgaactgtgccaagaagtatttttcagtgacatgaatggattcctgttaattgacaaaaagaggctttgtccaacatcagaattgttgaaactggtgctgttttctgttgcactgggattctgatgatctgggattttccctccttggcacagtaaacaccatgactgtctttattgagaatgtcgtcacagtcctttagtgatagattagttagacccatggttgcaatacctttatctccccaaagaaaataatcaaaagaaagcacaaaagctaccctgtttgcagaatatttcactgacattgatttgtcattaattctaccagagctgacctcattcaggcttgatagaaacaggttcctatgtttagggcagatccctagcctctcgctcacagtgagtctgcatgtcctagattctggttattgctggagcatccattaaagtctaccaaactcaggacagaagaagatagcagtggatttgtaaaaatttttagtttataaattacagtcattggggaaacactagtaaggtcatgtgatcttttggaccaggattttctctctgtcttctctctgggtgtgtgtgtgtgtatgtacagaagggctaccaggaagtgtcaaccatgttagattttctgtagtcttccagaaacagtgcagcccatacaacaggaatcttaattttcctcacagcaaatataacaggatggaacagttagtgttttgttttcacaagtgtccaccactccatctgccctgcatggagagggctctctcactgctagatctaggctgagccatctggaaggatcaaagggtgtgggagtatcaccccctctcaggctgcagaaggtctcgagggtggcgtcacagcaggatttccgccttctgcattgcactgcacagccccatggaacatgaggcacttgaggccttgcttcttggagcctctggggagcagagtaggtcactgccctctgggagtgttttgcagtagttttgtaaatgtgttgctacatagtcaagttcctttgtggcaaagaaatattttgttttgatattaggagccagcccatgtaatgcctctcaggcttgcttgcttagaagaaaaaagtcaccctttgtggtttttaagaaaaaaattctgtgcagatctgttcctcctcctgctccttcccttttctctacatacagtgctcattggaggctcctgctaaaccttcttaaccagagaaataataggtatttgttagacctgagtgtacatttcacatgttatccttcacatatttctcattttcatctagtactttcttaatgcctttgttggagtccgcatcctcatctttaaaaaaaaaaaaaaaaaacagcttagcctaagccacattcactttttttagttcacaaaaaggatttaatagccacaatgtgatttttgccacaactgtgtgattttaatattctctaatatcaagggcggatttagaattgcaggaaatacctggagaaatcacagtggaatgaatttttgctttaagagaaatgagagttggctgtctctgtaattgataatacagcttcatcctagtcccatctgcatttcagaaaataaccctcatctttacaaaacacaggacacttgtgggacagttaactcaagcagctatggggagggaggagattattgaatggtgattaaataatgcaaatggctcttctgtttcttaaagactgtggaagaggtcagactgcccagttgaggtgggcagttcatactgctcagttgaggtggcagtcatttattctgagtcctgttggatagagcctatctcctcaaggctacagaggcttccaggatatggagctgtgcatgttaatggctcagccttgcctccatcagggcacctgcctaacttggagcaagtgggagagcaccctagagtcatcctctgtgctgtttcgtgagttttgcagcggagacttcaccatccggaggagctgtgtttctgtgtcacttgggatatcacctaaaaatgaaacatttgatattttaaggtataaaaaaaaagtaaattggggaacattggctgcagtccctaaaagatactgttgtctgtgcatcaggttagcttgaggtcaccacaggtcctgggagcccagagagtttaggcatactctcctttggaggccagcagcctttcacaaaccctgcctctaaaagggcggtttcacatttgaccatgtttttgcattagcctcagaaactcttgtctttagctgataacctttgagggatgtgagaagcctagttggagcatctgagaaaatgatacctctcaccttcaaattaatcaaatagtttgtccttctagtccccttataaattaataaatggagggctggtcatggtggctcacgcctgtaatcccagcactttgggaggccgaggcgggtggatcacaaggtcaggagttcaagaccagcctgaccaatatggtgaaaccccatctctactaaaaatacaaaaattagccaggtgtagtggcacgctcctgtagtcccagctactcgggaggctgaggcaggagaatcgcttgaacccaggaggtggatgttgcagtgagccgagatcccgccactgcactgcagcctaggcgacagagcaagactccgtctcaaaaaaaaaaaaagaaaaaaaaagaaaagggaagggaatcccattttgtgatgatttgggcacactacttgagctgaggctagcagtcacatgattttggctgtctctgacctgaagcttttgaagtaaggttatgtctcttccctgaagctttgtttatagtggtaatttggtgagtttgagctttgagcttgtcttagaaaataagactgtccacctggggaggggagcttatagggaacccgtgttaactcagaatgctgaagaaagtgcttttagccaacaaaagtaagattactatctagaaggtggaaagaagtcattgcttctgttcctccagcagtcagttgactctaggtttcctttggtttatatccccagttcttaatactaaaacttatttgacttcctatcaggaagcacacaaaaaaagcgtcatttaaaaccctggatataggctttaaaggatacaaaaacagcagcattgtcgttttgccaggttcatcaccattttgatgtgctacccatccttccaccctccctttcctgcccccaagcctcccagccaggccagatgtgaagattctattaatcactgtttcagagaacattaattcttgtatagaataattatctactaaattgcttattatctgtgactaccttgcagagaacatctcaacagtgcagtaaaatagctctcctagacttgagcttccagccaggcatttagatcactcttaagcctttgtggaattctgaggaaaaaaagcaagatgcctcaatgccaatgctgggccataagattctactcccctccctgtagggtggggcgcgtggctcagctttggaaaatcattttgccagtaatattgcctgtgaatccctttaagaagtcgtcctgatctgagcctgtctttctgagcactttggtgctgaattgaaaatggtaagctaaagcagtgacagatccacgtagcctctttaacctctttattatcttgccaaaaaaaaagtttctcaggttaaacctttgtctttaacctccctttgttgtggagaaaatgtgtcactaatcagtggtccaagggatatctagctttggttactcagttcctgcagcataacagatatgacttatgccagggaaggtagaggctgattatggagacacccaggaacaggaataagaagggataggtctgctccacgtagaacctccccagatcggaagttaagtcttggagagtttccaaagtgctgaagtaaaaaggagacttggagggcctttgcttaatgagcaagaggcttgtgtcctcccaagaacatgagggagttcagaagggagctatagctcacagacagaaacctgcccgctcaccccatccctcgtgactgggagcatgtttgctcagaattttctaagaggactctcccttcaaaaatccaatttgctcccagaatgttgtttagcctctgagaatctcactctttcatttccatctgtgaatggacatagatgtgttgctcagggatcagaaacatcagagtccagggcccagtggcatggtgttgcattagtagttagaaaagtaattggtcagctctactgtaaaagaaataagtatgtagtacagttttgtaaatgtcaggtctgttctattgttttgtgatctgaagactgtcaaactggttgataatcaaagaaaaggttggttagaataagtaaaatttcagttagaaagatatagcttaccagttttccatgtgcttaaggaagtcaagaatatttcaggttgttgagaactgttgtaaaatggaattgaagctagtgtctctcaccttcttaggtgtatcagagagaggaagtggaaggccagtagtagcatcttcatacttacttttgccagcccagcctccatttcaaagactttgtcttccatcctatccaatgacatggtcagggatgggctctgaggaggcagtgaggccccaccttggtttgctccactgtggtgtgtagtctccaaacagcttaagggtttttaagttttctcacgattacctccactccactcatctactatcagcatcagaaaggttaacatccctgggaccattctacttataaaagagatgaactagtgtgctttctccccttttccaggtgtgccatccatatacaatctcctcttggccaagttcaacaaatgtttccagggaaccccgtgggttgaggcaaagtagccaagatgtattgagttaagtttttctagaggacaaaagtatttcttgtcccttttccctcatgctcatatgttttagctgaggcgtaaatggccaagttgagtaatatctgtggaactgagacagagagccagggacccatgtacccagggaccagtcccctggggaatcacacagtggctcagactagactgctctatcccaccagaactctgctgctgttcatttccatcaggaccacccaggaaagcaaataagttagccttctcatcattaggtcacctaatctcttgggttgcaggatgagagcatatatagatctcctgtttagagagtgtgttcataattgtagaaagggatagaaaatggaataaccaagaggctgtgtcattttttaagaggatggcaaggatgacctcaaatgagctcaacaaaactgggaatccaaggaatggtgcttgtagggaaagagaggtcagttgtggtccttaaacctcttggcaccttgtgcgggttataaaacaaggagctggagtaaaattgcccttacccccaatccaaatgctgtccaggatttaggagctacccaacctgtggttatatggtgttggtttccattttttgtttgtttgcttgtttccaaaatagccttgcttggtactgcatggaaagttcaagcttttcttcttgcccgctcagggctggcctcttccccgtgtcttcacagcgtccctaaggaagatttttgcagcactctctggagctgaggggagtgaaatttggtccagagaaggcggaaggaaatagttttcctgtttccttttctcgaggtggatgtcctcaggcttccttcacacctccttctcatgggtgcggctggcagtacagtcaggctgtggaggagggctgagaagaaaggggcactggtccagccccaggtttggtctgagacaggtacacagcagataccatcccaccttcctctctaaagaacaggccagccacacatataaccctttccctactttactaatgtatcccttatgtggtaccagcaatggaggacaggcagacttaccccctgccatctagagagaatgttgttattacccgtaaaacttgaccacccccatatcccactcctttttgtaaaaacaaatgcttaaacctgtgagcctgccgttcctttctatgtgttaatcagtttccttccatttgagctgtgtgggagggaagggcattgaaattgtaggttgtaatcttgtgccaaccaataaaaaccagtatttcacacacaaaaaaaaaaaaaaaaaaaaaaaaaaaaaaaaaaaaaaacccggggggctctttttctgcgggggcgggggaaaaggaggtttgagagaaggggcaggggccaaagggggttcccgggacccgagtttttttgggcaacaggggggagaaaccggggggccccccaaggggggggggggaaaaatcggaaaaacccggggttcccggtagatgttcggtcgaac

SEQ ID NO: 313680 - DNA, 7278 bp, Homo sapiens
cttagtttacatcctctcccccaatcttcacacacagagccaaagagcagttatattcttgggataccatgatacctctgggaaaggaattatattcccaaggagaggtcccattggataagaacaataccatgggacttgagtctgaatgccaacttactattcacacatccttcttaaaaacgaacacactgtttcttttcctgacctagagcattctaaagttctgttcaaataaataaagggcaaaataaagtagatttaaccaagtgccaggtggaattcaaaaaacacattcttccagataaattctacctttatggtatggatttgaaagtactttgcaggaaaacagtcagtactctttaaaaagggactgcagggctgggtgtagtggctcacacctgtaatcccagcactttgggaggccaaggcaggtgggtcacttgaggccaggagtttgagaccagcctgaccaacatggcaaaaccccatctctactaaaatacaaaaattagctgggcatgatggtgcactcctgtaatcccagctacttggtaggctgaagcatgagaattgcttaaacctgggaggcagaggttgcagtaagccaagatcatgccactgcattccagcctgggcaacagagtaagactctgtcttaataaataaataagaaaataaaacggaactgcagtgctaacagtaatttatacatttttaaatgttctgagtatgttttgactgggctagtgtaacaatatactaccctgaaagtgcagttttgattgttgttggtgtctttgggtcaggaaagtgaactgtgccaagaagtatttttcagtgacatgaatggattcctgttaatgcaattgactgagagattgtgcttacgctttcttaactgacaaaaagaggctttgtccaacatcagaattgttgaaactggtgctgttttctgttgcactgggattctgatgatctgggattttccctccttggcacagtaaacaccatgactgtctttattgagaatgtcgtcacagtcctttagtgatagattagttagacccatggttgcaatacctttatctccccaaagaaaataatcaaaagaaagcacaaaagctaccctgtttgcagaatatttcactgacattgatttgtcattaattctaccagagctgacctcattcaggcttgatagaaacaggttcctatgtttagggcagatccctagcctctcgctcacagtgagtctgcatgtcctagattctggttattgctggagcatccattaaagtctaccaaactcaggacagaagaagatagcagtggatttgtaaaaatttttagtttataaattacagtcattggggaaacactagtaaggtcatgtgatcttttggaccaggattttctctctgtcttctctctgggtgtgtgtgtgtgtatgtacagaagggctaccaggaagtgtcaaccatgttagattttctgtagtcttccagaaacagtgcagcccatacaacaggaatcttaattttcctcacagcaaatataacaggatggaacagttagtgttttgttttcacaagtgtccaccactccatctgccctgcatggagagggctctctcactgctagatctaggctgagccatctggaaggatcaaagggtgtgggagtatcaccccctctcaggctgcagaaggtctcgagggtggcgtcacagcaggatttccgccttctgcattgcactgcacagccccatggaacatgaggcacttgaggccttgcttcttggagcctctggggagcagagtaggtcactgccctctgggagtgttttgcagtagttttgtaaatgtgttgctacatagtcaagttcctttgtggcaaagaaatattttgttttgatattaggagccagcccatgtaatgcctctcaggcttgcttgcttagaagaaaaaagtcaccctttgtggtttttaagaaaaaaattctgtgcagatctgttcctcctcctgctccttcccttttctctacatacagtgctcattggaggctcctgctaaaccttcttaaccagagaaataataggtatttgttagacctgagtgtacatttcacatgttatccttcacatatttctcattttcatctagtactttcttaatgcctttgttggagtccgcatcctcatctttaaaaaaaaaaaaaaaaaacagcttagcctaagccacattcactttttttagttcacaaaaagcacaactgtgtgattttaatattctctaatatcaagggcggatttagaattgcaggaaatacctggagaaatcacagtggaatgaatttttgctttaagagaaatgagagttggctgtctctgtaattgataatacagcttcatcctagtcccatctgcatttcagaaaataaccctcatctttacaaaacacaggacacttgtgggacagttaactcaagcagctatggggagggaggagattattgaatggtgattaaataatgcaaatggctcttctgtttcttaaagactgtggaagaggtcagactgcccagttgaggtgggcagttcatactgctcagttgaggtggcagtcatttattctgagtcctgttggatagagcctatctcctcaaggctacagaggcttccaggatatggagctgtgcatgttaatggctcagccttgcctccatcagggcacctgcctaacttggagcaagtgggagagcaccctagagtcatcctctgtgctgtttcgtgagttttgcagcggagacttcaccatccggaggagctgtgtttctgtgtcacttgggatatcacctaaaaatgaaacatttgatattttaaggtataaaaaaaaagtaaattggggaacattggctgcagtccctaaaagatactgttgtctgtgcatcaggttagcttgaggtcaccacaggtcctgggagcccagagagtttaggcatactctcctttggaggccagcagcctttcacaaaccctgcctctaaaagggcggtttcacatttgaccatgtttttgcattagcctcagaaactcttgtctttagctgataacctttgagggatgtgagaagcctagttggagcatctgagaaaatgatacctctcaccttcaaattaatcaaatagtttgtccttctagtccccttataaattaataaatggagggctggtcatggtggctcacgcctgtaatcccagcactttgggaggccgaggcgggtggatcacaaggtcaggagttcaagaccagcctgaccaatatggtgaaaccccatctctactaaaaatacaaaaattagccaggtgtagtggcacgctcctgtagtcccagctactcgggaggctgaggcaggagaatcgcttgaacccaggaggtggatgttgcagtgagccgagatcccgccactgcactgcagcctaggcgacagagcaagactccgtctcaaaaaaaaaaaaagaaaaaaaaagaaaagggaagggaatcccattttgtgatgatttgggcacactacttgagctgaggctagcagtcacatgattttggctgtctctgacctgaagcttttgaagtaaggttatgtctcttccctgaagctttgtttatagtggtaatttggtgagtttgagctttgagcttgtcttagaaaataagactgtccacctggggaggggagcttatagggaacccgtgttaactcagaatgctgaagaaagtgcttttagccaacaaaagtaagattactatctagaaggtggaaagaagtcattgcttctgttcctccagcagtcagttgactctaggtttcctttggtttatatccccagttcttaatactaaaacttatttgacttcctatcaggaagcacacaaaaaaagcgtcatttaaaaccctggatataggctttaaaggatacaaaaacagcagcattgtcgttttgccaggttcatcaccattttgatgtgctacccatccttccaccctccctttcctgcccccaagcctcccagccaggccagatgtgaagattctattaatcactgtttcagagaacattaattcttgtatagaataattatctactaaattgcttattatctgtgactaccttgcagagaacatctcaacagtgcagtaaaatagctctcctagacttgagcttccagccaggcatttagatcactcttaagcctttgtggaattctgaggaaaaaaagcaagatgcctcaatgccaatgctgggccataagattctactcccctccctgtagggtggggcgcgtggctcagctttggaaaatcattttgccagtaatattgcctgtgaatccctttaagaagtcgtcctgatctgagcctgtctttctgagcactttggtgctgaattgaaaatggtaagctaaagcagtgacagatccacgtagcctctttaacctctttattatcttgccaaaaaaaaagtttctcaggttaaacctttgtctttaacctccctttgttgtggagaaaatgtgtcactaatcagtggtccaagggatatctagctttggttactcagttcctgcagcataacagatatgacttatgccagggaaggtagaggctgattatggagacacccaggaacaggaataagaagggataggtctgctccacgtagaacctccccagatcggaagttaagtcttggagagtttccaaagtgctgaagtaaaaaggagacttggagggcctttgcttaatgagcaagaggcttgtgtcctcccaagaacatgagggagttcagaagggagctatagctcacagacagaaacctgcccgctcaccccatccctcgtgactgggagcatgtttgctcagaattttctaagaggactctcccttcaaaaatccaatttgctcccagaatgttgtttagcctctgagaatctcactctttcatttccatctgtgaatggacatagatgtgttgctcagggatcagaaacatcagagtccagggcccagtggcatggtgttgcattagtagttagaaaagtaattggtcagctctactgtaaaagaaataagtatgtagtacagttttgtaaatgtcaggtctgttctattgttttgtgatctgaagactgtcaaactggttgataatcaaagaaaaggttggttagaataagtaaaatttcagttagaaagatatagcttaccagttttccatgtgcttaaggaagtcaagaatatttcaggttgttgagaactgttgtaaaatggaattgaagctagtgtctctcaccttcttaggtgtatcagagagaggaagtggaaggccagtagtagcatcttcatacttacttttgccagcccagcctccatttcaaagactttgtcttccatcctatccaatgacatggtcagggatgggctctgaggaggcagtgaggccccaccttggtttgctccactgtggtgtgtagtctccaaacagcttaagggtttttaagttttctcacgattacctccactccactcatctactatcagcatcagaaaggttaacatccctgggaccattctacttataaaagagatgaactagtgtgctttctccccttttccaggtgtgccatccatatacaatctcctcttggccaagttcaacaaatgtttccagggaaccccgtgggttgaggcaaagtagccaagatgtattgagttaagtttttctagaggacaaaagtatttcttgtcccttttccctcatgctcatatgttttagctgaggcgtaaatggccaagttgagtaatatctgtggaactgagacagagagccagggacccatgtacccagggaccagtcccctggggaatcacacagtggctcagactagactgctctatcccaccagaactctgctgctgttcatttccatcaggaccacccaggaaagcaaataagttagccttctcatcattaggtcacctaatctcttgggttgcaggatgagagcatatatagatctcctgtttagagagtgtgttcataattgtagaaagggatagaaaatggaataaccaagaggctgtgtcattttttaagaggatggcaaggatgacctcaaatgagctcaacaaaactgggaatccaaggaatggtgcttgtagggaaagagaggtcagttgtggtccttaaacctcttggcaccttgtgcgggttataaaacaaggagctggagtaaaattgcccttacccccaatccaaatgctgtccaggatttaggagctacccaacctgtggttatatggtgttggtttccattttttgtttgtttgcttgtttccaaaatagccttgcttggtactgcatggaaagttcaagcttttcttcttgcccgctcagggctggcctcttccccgtgtcttcacagcgtccctaaggaagatttttgcagcactctctggagctgaggggagtgaaatttggtccagagaaggcggaaggaaatagttttcctgtttccttttctcgaggtggatgtcctcaggcttccttcacacctccttctcatgggtgcggctggcagtacagtcaggctgtggaggagggctgagaagaaaggggcactggtccagccccaggtttggtctgagacaggtacacagcagataccatcccaccttcctctctaaagaacaggccagccacacatataaccctttccctactttactaatgtatcccttatgtggtaccagcaatggaggacaggcagacttaccccctgccatctagagagaatgttgttattacccgtaaaacttgaccacccccatatcccactcctttttgtaaaaacaaatgcttaaacctgtgagcctgccgttcctttctatgtgttaatcagtttccttccatttgagctgtgtgggagggaagggcattgaaattgtaggttgtaatcttgtgccaaccaataaaaaccagtatttcacacacaaaaaaaaaaaaaaaaaaaaaaaaaaaaaaaaaaaaaaacccggggggctctttttctgcgggggcgggggaaaaggaggtttgagagaaggggcaggggccaaagggggttcccgggacccgagtttttttgggcaacaggggggagaaaccggggggccccccaaggggggggggggaaaaatcggaaaaacccggggttcccggtagatgttcggtcgaac

SEQ ID NO: 313681 - DNA, 7252 bp, Homo sapiens
cttagtttacatcctctcccccaatcttcacacacagagccaaagagcagttatattcttgggataccatgatacctctgggaaaggaattatattcccaaggagaggtcccattggataagaacaataccatgggacttgagtctgaatgccaacttactattcacacatccttcttaaaaacgaacacactgtttcttttcctgacctagagcattctaaagttctgttcaaataaataaagggcaaaataaagtagatttaaccaagtgccaggtggaattcaaaaaacacattcttccagataaattctacctttatggtatggatttgaaagtactttgcaggaaaacagtcagtactctttaaaaagggactgcagggctgggtgtagtggctcacacctgtaatcccagcactttgggaggccaaggcaggtgggtcacttgaggccaggagtttgagaccagcctgaccaacatggcaaaaccccatctctactaaaatacaaaaattagctgggcatgatggtgcactcctgtaatcccagctacttggtaggctgaagcatgagaattgcttaaacctgggaggcagaggttgcagtaagccaagatcatgccactgcattccagcctgggcaacagagtaagactctgtcttaataaataaataagaaaataaaacggaactgcagtgctaacagtaatttatacatttttaaatgttctgagtatgttttgactgggctagtgtaacaatatactaccctgaaagtgcagttttgattgttgttggtgtctttgggtcaggaaagtgaactgtgccaagaagtatttttcagtgacatgaatggattcctgttaatgcaattgactgagagattgtgcttacgctttcttaactgacaaaaagaggctttgtccaacatcagaattgttgaaactggtgctgttttctgttgcactgggattctgatgatctgggattttccctccttggcacagtaaacaccatgactgtctttattgagaatgtcgtcacagtcctttagtgatagattagttagacccatggttgcaatacctttatctccccaaagaaaataatcaaaagaaagcacaaaagctaccctgtttgcagaatatttcactgacattgatttgtcattaattctaccagagctgacctcattcaggcttgatagaaacaggttcctatgtttagggcagatccctagcctctcgctcacagtgagtctgcatgtcctagattctggttattgctggagcatccattaaagtctaccaaactcaggacagaagaagatagcagtggatttgtaaaaatttttagtttataaattacagtcattggggaaacactagtaaggtcatgtgatcttttggaccaggattttctctctgtcttctctctgggtgtgtgtgtgtgtatgtacagaagggctaccaggaagtgtcaaccatgttagattttctgtagtcttccagaaacagtgcagcccatacaacaggaatcttaattttcctcacagcaaatataacaggatggaacagttagtgttttgttttcacaagtgtccaccactccatctgccctgcatggagagggctctctcactgctagatctaggctgagccatctggaaggatcaaagggtgtgggagtatcaccccctctcaggctgcagaaggtctcgagggtggcgtcacagcaggatttccgccttctgcattgcactgcacagccccatggaacatgaggcacttgaggccttgcttcttggagcctctggggagcagagtaggtcactgccctctgggagtgttttgcagtagttttgtaaatgtgttgctacatagtcaagttcctttgtggcaaagaaatattttgttttgatattaggagccagcccatgtaatgcctctcaggcttgcttgcttagaagaaaaaagtcaccctttgtggtttttaagaaaaaaattctgtgcagatctgttcctcctcctgctccttcccttttctctacatacagtgctcattggaggctcctgctaaaccttcttaaccagagaaataataggtatttgttagacctgagtgtacatttcacatgttatccttcacatatttctcattttcatctagtactttcttaatgcctttgttggagtccgcatcctcatctttaaaaaaaaaaaaaaaaaacagcttagcctaagccacattcactttttttagttcacaaaaaggatttaatagccacaatgtgatttttgccacaactgtgtgattttaatattctctaatatcaagggcggatttagaattgcaggaaatacctggagaaatcacagtggaatgaatttttgctttaagagaaatgagagttggctgtctctgtaattgataatacagcttcatcctagtcccatctgcatttcagaaaataaccctcatctttacaaaacacaggacacttgtgggacagttaactcaagcagctatggggagggaggagattattgaatggtgattaaataatgcaaatggctcttctgtttcttaaagactgtggaagaggtcagactgcccagttgaggtgggcagttcatactgctcagttgaggtggcagtcatttattctgagtcctgttggatagagcctatctcctcaaggctacagaggcttccaggatatggagctgtgcatgttaatggctcagccttgcctccatcagggcacctgcctaacttggagcaagtgggagagcaccctagagtcatcctctgtgctgtttcgtgagttttgcagcggagacttcaccatccggaggagctgtgtttctgtgtcacttgggatatcacctaaaaatgaaacatttgatattttaaggtataaaaaaaaagtaaattggggaacattggctgcagtccctaaaagatactgttgtctgtgcatcaggttagcttgaggtcaccacaggtcctgggagcccagagagtttaggcatactctcctttggaggccagcagcctttcacaaaccctgcctctaaaagggcggtttcacatttgaccatgtttttgcattagcctcagaaactcttgtctttagctgataacctttgagggatgtgagaagcctagttggagcatctgagaaaatgatacctctcaccttcaaattaatcaaatagtttgtccttctagtccccttataaattaataaatggagggctggtcatggtggctcacgcctgtaatcccagcactttgggaggccgaggcgggtggatcacaaggtcaggagttcaagaccagcctgaccaatatggtgaaaccccatctctactaaaaatacaaaagcaggagaatcgcttgaacccaggaggtggatgttgcagtgagccgagatcccgccactgcactgcagcctaggcgacagagcaagactccgtctcaaaaaaaaaaaaagaaaaaaaaagaaaagggaagggaatcccattttgtgatgatttgggcacactacttgagctgaggctagcagtcacatgattttggctgtctctgacctgaagcttttgaagtaaggttatgtctcttccctgaagctttgtttatagtggtaatttggtgagtttgagctttgagcttgtcttagaaaataagactgtccacctggggaggggagcttatagggaacccgtgttaactcagaatgctgaagaaagtgcttttagccaacaaaagtaagattactatctagaaggtggaaagaagtcattgcttctgttcctccagcagtcagttgactctaggtttcctttggtttatatccccagttcttaatactaaaacttatttgacttcctatcaggaagcacacaaaaaaagcgtcatttaaaaccctggatataggctttaaaggatacaaaaacagcagcattgtcgttttgccaggttcatcaccattttgatgtgctacccatccttccaccctccctttcctgcccccaagcctcccagccaggccagatgtgaagattctattaatcactgtttcagagaacattaattcttgtatagaataattatctactaaattgcttattatctgtgactaccttgcagagaacatctcaacagtgcagtaaaatagctctcctagacttgagcttccagccaggcatttagatcactcttaagcctttgtggaattctgaggaaaaaaagcaagatgcctcaatgccaatgctgggccataagattctactcccctccctgtagggtggggcgcgtggctcagctttggaaaatcattttgccagtaatattgcctgtgaatccctttaagaagtcgtcctgatctgagcctgtctttctgagcactttggtgctgaattgaaaatggtaagctaaagcagtgacagatccacgtagcctctttaacctctttattatcttgccaaaaaaaaagtttctcaggttaaacctttgtctttaacctccctttgttgtggagaaaatgtgtcactaatcagtggtccaagggatatctagctttggttactcagttcctgcagcataacagatatgacttatgccagggaaggtagaggctgattatggagacacccaggaacaggaataagaagggataggtctgctccacgtagaacctccccagatcggaagttaagtcttggagagtttccaaagtgctgaagtaaaaaggagacttggagggcctttgcttaatgagcaagaggcttgtgtcctcccaagaacatgagggagttcagaagggagctatagctcacagacagaaacctgcccgctcaccccatccctcgtgactgggagcatgtttgctcagaattttctaagaggactctcccttcaaaaatccaatttgctcccagaatgttgtttagcctctgagaatctcactctttcatttccatctgtgaatggacatagatgtgttgctcagggatcagaaacatcagagtccagggcccagtggcatggtgttgcattagtagttagaaaagtaattggtcagctctactgtaaaagaaataagtatgtagtacagttttgtaaatgtcaggtctgttctattgttttgtgatctgaagactgtcaaactggttgataatcaaagaaaaggttggttagaataagtaaaatttcagttagaaagatatagcttaccagttttccatgtgcttaaggaagtcaagaatatttcaggttgttgagaactgttgtaaaatggaattgaagctagtgtctctcaccttcttaggtgtatcagagagaggaagtggaaggccagtagtagcatcttcatacttacttttgccagcccagcctccatttcaaagactttgtcttccatcctatccaatgacatggtcagggatgggctctgaggaggcagtgaggccccaccttggtttgctccactgtggtgtgtagtctccaaacagcttaagggtttttaagttttctcacgattacctccactccactcatctactatcagcatcagaaaggttaacatccctgggaccattctacttataaaagagatgaactagtgtgctttctccccttttccaggtgtgccatccatatacaatctcctcttggccaagttcaacaaatgtttccagggaaccccgtgggttgaggcaaagtagccaagatgtattgagttaagtttttctagaggacaaaagtatttcttgtcccttttccctcatgctcatatgttttagctgaggcgtaaatggccaagttgagtaatatctgtggaactgagacagagagccagggacccatgtacccagggaccagtcccctggggaatcacacagtggctcagactagactgctctatcccaccagaactctgctgctgttcatttccatcaggaccacccaggaaagcaaataagttagccttctcatcattaggtcacctaatctcttgggttgcaggatgagagcatatatagatctcctgtttagagagtgtgttcataattgtagaaagggatagaaaatggaataaccaagaggctgtgtcattttttaagaggatggcaaggatgacctcaaatgagctcaacaaaactgggaatccaaggaatggtgcttgtagggaaagagaggtcagttgtggtccttaaacctcttggcaccttgtgcgggttataaaacaaggagctggagtaaaattgcccttacccccaatccaaatgctgtccaggatttaggagctacccaacctgtggttatatggtgttggtttccattttttgtttgtttgcttgtttccaaaatagccttgcttggtactgcatggaaagttcaagcttttcttcttgcccgctcagggctggcctcttccccgtgtcttcacagcgtccctaaggaagatttttgcagcactctctggagctgaggggagtgaaatttggtccagagaaggcggaaggaaatagttttcctgtttccttttctcgaggtggatgtcctcaggcttccttcacacctccttctcatgggtgcggctggcagtacagtcaggctgtggaggagggctgagaagaaaggggcactggtccagccccaggtttggtctgagacaggtacacagcagataccatcccaccttcctctctaaagaacaggccagccacacatataaccctttccctactttactaatgtatcccttatgtggtaccagcaatggaggacaggcagacttaccccctgccatctagagagaatgttgttattacccgtaaaacttgaccacccccatatcccactcctttttgtaaaaacaaatgcttaaacctgtgagcctgccgttcctttctatgtgttaatcagtttccttccatttgagctgtgtgggagggaagggcattgaaattgtaggttgtaatcttgtgccaaccaataaaaaccagtatttcacacacaaaaaaaaaaaaaaaaaaaaaaaaaaaaaaaaaaaaaaacccggggggctctttttctgcgggggcgggggaaaaggaggtttgagagaaggggcaggggccaaagggggttcccgggacccgagtttttttgggcaacaggggggagaaaccggggggccccccaaggggggggggggaaaaatcggaaaaacccggggttcccggtagatgttcggtcgaac

SEQ ID NO: 313682 - DNA, 7252 bp, Homo sapiens
cttagtttacatcctctcccccaatcttcacacacagagccaaagagcagttatattcttgggataccatgatacctctgggaaaggaattatattcccaaggagaggtcccattggataagaacaataccatgggacttgagtctgaatgccaacttactattcacacatccttcttaaaaacgaacacactgtttcttttcctgacctagagcattctaaagttctgttcaaataaataaagggcaaaataaagtagatttaaccaagtgccaggtggaattcaaaaaacacattcttccagataaattctacctttatggtatggatttgaaagtactttgcaggaaaacagtcagtactctttaaaaagggactgcagggctgggtgtagtggctcacacctgtaatcccagcactttgggaggccaaggcaggtgggtcacttgaggccaggagtttgagaccagcctgaccaacatggcaaaaccccatctctactaaaatacaaaaattagctgggcatgatggtgcactcctgtaatcccagctacttggtaggctgaagcatgagaattgcttaaacctgggaggcagaggttgcagtaagccaagatcatgccactgcattccagcctgggcaacagagtaagactctgtcttaataaataaataagaaaataaaacggaactgcagtgctaacagtaatttatacatttttaaatgttctgagtatgttttgactgggctagtgtaacaatatactaccctgaaagtgcagttttgattgttgttggtgtctttgggtcaggaaagtgaactgtgccaagaagtatttttcagtgacatgaatggattcctgttaatgcaattgactgagagattgtgcttacgctttcttaactgacaaaaagaggctttgtccaacatcagaattgttgaaactggtgctgttttctgttgcactgggattctgatgatctgggattttccctccttggcacagtaaacaccatgactgtctttattgagaatgtcgtcacagtcctttagtgatagattagttagacccatggttgcaatacctttatctccccaaagaaaataatcaaaagaaagcacaaaagctaccctgtttgcagaatatttcactgacattgatttgtcattaattctaccagagctgacctcattcaggcttgatagaaacaggttcctatgtttagggcagatccctagcctctcgctcacagtgagtctgcatgtcctagattctggttattgctggagcatccattaaagtctaccaaactcaggacagaagaagatagcagtggatttgtaaaaatttttagtttataaattacagtcattggggaaacactagtaaggtcatgtgatcttttggaccaggattttctctctgtcttctctctgggtgtgtgtgtgtgtatgtacagaagggctaccaggaagtgtcaaccatgttagattttctgtagtcttccagaaacagtgcagcccatacaacaggaatcttaattttcctcacagcaaatataacaggatggaacagttagtgttttgttttcacaagtgtccaccactccatctgccctgcatggagagggctctctcactgctagatctaggctgagccatctggaaggatcaaagggtgtgggagtatcaccccctctcaggctgcagaaggtctcgagggtggcgtcacagcaggatttccgccttctgcattgcactgcacagccccatggaacatgaggcacttgaggccttgcttcttggagcctctggggagcagagtaggtcactgccctctgggagtgttttgcagtagttttgtaaatgtgttgctacatagtcaagttcctttgtggcaaagaaatattttgttttgatattaggagccagcccatgtaatgcctctcaggcttgcttgcttagaagaaaaaagtcaccctttgtggtttttaagaaaaaaattctgtgcagatctgttcctcctcctgctccttcccttttctctacatacagtgctcattggaggctcctgctaaaccttcttaaccagagaaataataggtatttgttagacctgagtgtacatttcacatgttatccttcacatatttctcattttcatctagtactttcttaatgcctttgttggagtccgcatcctcatctttaaaaaaaaaaaaaaaaaacagcttagcctaagccacattcactttttttagttcacaaaaaggatttaatagccacaatgtgatttttgccacaactgtgtgattttaatattctctaatatcaagggcggatttagaattgcaggaaatacctggagaaatcacagtggaatgaatttttgctttaagagaaatgagagttggctgtctctgtaattgataatacagcttcatcctagtcccatctgcatttcagaaaataaccctcatctttacaattattgaatggtgattaaataatgcaaatggctcttctgtttcttaaagactgtggaagaggtcagactgcccagttgaggtgggcagttcatactgctcagttgaggtggcagtcatttattctgagtcctgttggatagagcctatctcctcaaggctacagaggcttccaggatatggagctgtgcatgttaatggctcagccttgcctccatcagggcacctgcctaacttggagcaagtgggagagcaccctagagtcatcctctgtgctgtttcgtgagttttgcagcggagacttcaccatccggaggagctgtgtttctgtgtcacttgggatatcacctaaaaatgaaacatttgatattttaaggtataaaaaaaaagtaaattggggaacattggctgcagtccctaaaagatactgttgtctgtgcatcaggttagcttgaggtcaccacaggtcctgggagcccagagagtttaggcatactctcctttggaggccagcagcctttcacaaaccctgcctctaaaagggcggtttcacatttgaccatgtttttgcattagcctcagaaactcttgtctttagctgataacctttgagggatgtgagaagcctagttggagcatctgagaaaatgatacctctcaccttcaaattaatcaaatagtttgtccttctagtccccttataaattaataaatggagggctggtcatggtggctcacgcctgtaatcccagcactttgggaggccgaggcgggtggatcacaaggtcaggagttcaagaccagcctgaccaatatggtgaaaccccatctctactaaaaatacaaaaattagccaggtgtagtggcacgctcctgtagtcccagctactcgggaggctgaggcaggagaatcgcttgaacccaggaggtggatgttgcagtgagccgagatcccgccactgcactgcagcctaggcgacagagcaagactccgtctcaaaaaaaaaaaaagaaaaaaaaagaaaagggaagggaatcccattttgtgatgatttgggcacactacttgagctgaggctagcagtcacatgattttggctgtctctgacctgaagcttttgaagtaaggttatgtctcttccctgaagctttgtttatagtggtaatttggtgagtttgagctttgagcttgtcttagaaaataagactgtccacctggggaggggagcttatagggaacccgtgttaactcagaatgctgaagaaagtgcttttagccaacaaaagtaagattactatctagaaggtggaaagaagtcattgcttctgttcctccagcagtcagttgactctaggtttcctttggtttatatccccagttcttaatactaaaacttatttgacttcctatcaggaagcacacaaaaaaagcgtcatttaaaaccctggatataggctttaaaggatacaaaaacagcagcattgtcgttttgccaggttcatcaccattttgatgtgctacccatccttccaccctccctttcctgcccccaagcctcccagccaggccagatgtgaagattctattaatcactgtttcagagaacattaattcttgtatagaataattatctactaaattgcttattatctgtgactaccttgcagagaacatctcaacagtgcagtaaaatagctctcctagacttgagcttccagccaggcatttagatcactcttaagcctttgtggaattctgaggaaaaaaagcaagatgcctcaatgccaatgctgggccataagattctactcccctccctgtagggtggggcgcgtggctcagctttggaaaatcattttgccagtaatattgcctgtgaatccctttaagaagtcgtcctgatctgagcctgtctttctgagcactttggtgctgaattgaaaatggtaagctaaagcagtgacagatccacgtagcctctttaacctctttattatcttgccaaaaaaaaagtttctcaggttaaacctttgtctttaacctccctttgttgtggagaaaatgtgtcactaatcagtggtccaagggatatctagctttggttactcagttcctgcagcataacagatatgacttatgccagggaaggtagaggctgattatggagacacccaggaacaggaataagaagggataggtctgctccacgtagaacctccccagatcggaagttaagtcttggagagtttccaaagtgctgaagtaaaaaggagacttggagggcctttgcttaatgagcaagaggcttgtgtcctcccaagaacatgagggagttcagaagggagctatagctcacagacagaaacctgcccgctcaccccatccctcgtgactgggagcatgtttgctcagaattttctaagaggactctcccttcaaaaatccaatttgctcccagaatgttgtttagcctctgagaatctcactctttcatttccatctgtgaatggacatagatgtgttgctcagggatcagaaacatcagagtccagggcccagtggcatggtgttgcattagtagttagaaaagtaattggtcagctctactgtaaaagaaataagtatgtagtacagttttgtaaatgtcaggtctgttctattgttttgtgatctgaagactgtcaaactggttgataatcaaagaaaaggttggttagaataagtaaaatttcagttagaaagatatagcttaccagttttccatgtgcttaaggaagtcaagaatatttcaggttgttgagaactgttgtaaaatggaattgaagctagtgtctctcaccttcttaggtgtatcagagagaggaagtggaaggccagtagtagcatcttcatacttacttttgccagcccagcctccatttcaaagactttgtcttccatcctatccaatgacatggtcagggatgggctctgaggaggcagtgaggccccaccttggtttgctccactgtggtgtgtagtctccaaacagcttaagggtttttaagttttctcacgattacctccactccactcatctactatcagcatcagaaaggttaacatccctgggaccattctacttataaaagagatgaactagtgtgctttctccccttttccaggtgtgccatccatatacaatctcctcttggccaagttcaacaaatgtttccagggaaccccgtgggttgaggcaaagtagccaagatgtattgagttaagtttttctagaggacaaaagtatttcttgtcccttttccctcatgctcatatgttttagctgaggcgtaaatggccaagttgagtaatatctgtggaactgagacagagagccagggacccatgtacccagggaccagtcccctggggaatcacacagtggctcagactagactgctctatcccaccagaactctgctgctgttcatttccatcaggaccacccaggaaagcaaataagttagccttctcatcattaggtcacctaatctcttgggttgcaggatgagagcatatatagatctcctgtttagagagtgtgttcataattgtagaaagggatagaaaatggaataaccaagaggctgtgtcattttttaagaggatggcaaggatgacctcaaatgagctcaacaaaactgggaatccaaggaatggtgcttgtagggaaagagaggtcagttgtggtccttaaacctcttggcaccttgtgcgggttataaaacaaggagctggagtaaaattgcccttacccccaatccaaatgctgtccaggatttaggagctacccaacctgtggttatatggtgttggtttccattttttgtttgtttgcttgtttccaaaatagccttgcttggtactgcatggaaagttcaagcttttcttcttgcccgctcagggctggcctcttccccgtgtcttcacagcgtccctaaggaagatttttgcagcactctctggagctgaggggagtgaaatttggtccagagaaggcggaaggaaatagttttcctgtttccttttctcgaggtggatgtcctcaggcttccttcacacctccttctcatgggtgcggctggcagtacagtcaggctgtggaggagggctgagaagaaaggggcactggtccagccccaggtttggtctgagacaggtacacagcagataccatcccaccttcctctctaaagaacaggccagccacacatataaccctttccctactttactaatgtatcccttatgtggtaccagcaatggaggacaggcagacttaccccctgccatctagagagaatgttgttattacccgtaaaacttgaccacccccatatcccactcctttttgtaaaaacaaatgcttaaacctgtgagcctgccgttcctttctatgtgttaatcagtttccttccatttgagctgtgtgggagggaagggcattgaaattgtaggttgtaatcttgtgccaaccaataaaaaccagtatttcacacacaaaaaaaaaaaaaaaaaaaaaaaaaaaaaaaaaaaaaaacccggggggctctttttctgcgggggcgggggaaaaggaggtttgagagaaggggcaggggccaaagggggttcccgggacccgagtttttttgggcaacaggggggagaaaccggggggccccccaaggggggggggggaaaaatcggaaaaacccggggttcccggtagatgttcggtcgaac

SEQ ID NO: 313683 - DNA, 7252 bp, Homo sapiens
cttagtttacatcctctcccccaatcttcacacacagagccaaagagcagttatattcttgggataccatgatacctctgggaaaggaattatattcccaaggagaggtcccattggataagaacaataccatgggacttgagtctgaatgccaacttactattcacacatccttcttaaaaacgaacacactgtttcttttcctgacctagagcattctaaagttctgttcaaataaataaagggcaaaataaagtagatttaaccaagtgccaggtggaattcaaaaaacacattcttccagataaattctacctttatggtatggatttgaaagtactttgcaggaaaacagtcagtactctttaaaaagggactgcagggctgggtgtagtggctcacacctgtaatcccagcactttgggaggccaaggcaggtgggtcacttgaggccaggagtttgagaccagcctgaccaacatggcaaaaccccatctctactaaaatacaaaaattagctgggcatgatggtgcactcctgtaatcccagctacttggtaggctgaagcatgagaattgcttaaacctgggaggcagaggttgcagtaagccaagatcatgccactgcattccagcctgggcaacagagtaagactctgtcttaataaataaataagaaaataaaacggaactgcagtgctaacagtaatttatacatttttaaatgttctgagtatgttttgactgggctagtgtaacaatatactaccctgaaagtgcagttttgattgttgttggtgtctttgggtcaggaaagtgaactgtgccaagaagtatttttcagtgacatgaatggattcctgttaatgcaattgactgagagattgtgcttacgctttcttaactgacaaaaagaggctttgtccaacatcagaattgttgaaactggtgctgttttctgttgcactgggattctgatgatctgggattttccctccttggcacagtaaacaccatgactgtctttattgagaatgtcgtcacagtcctttagtgatagattagttagacccatggttgcaatacctttatctccccaaagaaaataatcaaaagaaagcacaaaagctaccctgtttgcagaatatttcactgacattgatttgtcattaattctaccagagctgacctcattcaggcttgatagaaacaggttcctatgtttagggcagatccctagcctctcgctcacagtgagtctgcatgtcctagattctggttattgctggagcatccattaaagtctaccaaactcaggacagaagaagatagcagtggatttgtaaaaatttttagtttataaattacagtcattggggaaacactagtaaggtcatgtgatcttttggaccaggattttctctctgtcttctctctgggtgtgtgtgtgtgtatgtacagaagggctaccaggaagtgtcaaccatgttagattttctgtagtcttccagaaacagtgcagcccatacaacaggaatcttaattttcctcacagcaaatataacaggatggaacagttagtgttttgttttcacaagtgtccaccactccatctgccctgcatggagagggctctctcactgctagatctaggctgagccatctggaaggatcaaagggtgtgggagtatcaccccctctcaggctgcagaaggtctcgagggtggcgtcacagcaggatttccgccttctgcattgcactgcacagccccatggaacatgaggcacttgaggccttgcttcttggagcctctggggagcagagtaggtcactgccctctgggagtgttttgcagtagttttgtaaatgtgttgctacatagtcaagttcctttgtggcaaagaaatattttgttttgatattaggagccagcccatgtaatgcctctcaggcttgcttgcttagaagaaaaaagtcaccctttgtggtttttaagaaaaaaattctgtgcagatctgttcctcctcctgctccttcccttttctctacatacagtgctcattggaggctcctgctaaaccttcttaaccagagaaataataggtatttgttagacctgagtgtacatttcacatgttatccttcacatatttctcattttcatctagtactttcttaatgcctttgttggagtccgcatcctcatctttaaaaaaaaaaaaaaaaaacagcttagcctaagccacattcactttttttagttcacaaaaaggatttaatagccacaatgtgatttttgccacaactgtgtgattttaatattctctaatatcaagggcggatttagaattgcaggaaatacctggagaaatcacagtggaatgaatttttgctttaagagaaatgagagttggctgtctctgtaattgataatacagcttcatcctagtcccatctgcatttcagaaaataaccctcatctttacaaaacacaggacacttgtgggacagttaactcaagcagctatggggagggaggagattattgaatggtgattaaataatgcaaatggctcttctgtttcttaaagactgtggaagaggtcagactgcccagttgaggtgggcagttcatactgctcagttgaggtggcagtcatttattctgagtcctgttggatagagcctatctcctcaaggctacagaggcttccaggatatggagctgtgcatgttaatggctcagccttgcctccatcagggcacctgcctaacttggagcaagtgggagagcaccctagagtcatcctctgtgctgtttcgtgagttttgcagcggagacttcaccatccggaggagctgtgtttctgtgtcacttgggatatcacctaaaaatgaaacatttgatattttaaggtataaaaaaaaagtaaattggggaacattggctgcagtccctaaaagatactgttgtctgtgcatcaggttagcttgaggtcaccacaggtcctgggagcccagagagtttaggcatactctcctttggaggccagcagcctttcacaaaccctgcctctaaaagggcggtttcacatttgaccatgtttttgcattagcctcagaaactcttgtctttagctgataacctttgagggatgtgagaagcctagttggagcatctgagttataaattaataaatggagggctggtcatggtggctcacgcctgtaatcccagcactttgggaggccgaggcgggtggatcacaaggtcaggagttcaagaccagcctgaccaatatggtgaaaccccatctctactaaaaatacaaaaattagccaggtgtagtggcacgctcctgtagtcccagctactcgggaggctgaggcaggagaatcgcttgaacccaggaggtggatgttgcagtgagccgagatcccgccactgcactgcagcctaggcgacagagcaagactccgtctcaaaaaaaaaaaaagaaaaaaaaagaaaagggaagggaatcccattttgtgatgatttgggcacactacttgagctgaggctagcagtcacatgattttggctgtctctgacctgaagcttttgaagtaaggttatgtctcttccctgaagctttgtttatagtggtaatttggtgagtttgagctttgagcttgtcttagaaaataagactgtccacctggggaggggagcttatagggaacccgtgttaactcagaatgctgaagaaagtgcttttagccaacaaaagtaagattactatctagaaggtggaaagaagtcattgcttctgttcctccagcagtcagttgactctaggtttcctttggtttatatccccagttcttaatactaaaacttatttgacttcctatcaggaagcacacaaaaaaagcgtcatttaaaaccctggatataggctttaaaggatacaaaaacagcagcattgtcgttttgccaggttcatcaccattttgatgtgctacccatccttccaccctccctttcctgcccccaagcctcccagccaggccagatgtgaagattctattaatcactgtttcagagaacattaattcttgtatagaataattatctactaaattgcttattatctgtgactaccttgcagagaacatctcaacagtgcagtaaaatagctctcctagacttgagcttccagccaggcatttagatcactcttaagcctttgtggaattctgaggaaaaaaagcaagatgcctcaatgccaatgctgggccataagattctactcccctccctgtagggtggggcgcgtggctcagctttggaaaatcattttgccagtaatattgcctgtgaatccctttaagaagtcgtcctgatctgagcctgtctttctgagcactttggtgctgaattgaaaatggtaagctaaagcagtgacagatccacgtagcctctttaacctctttattatcttgccaaaaaaaaagtttctcaggttaaacctttgtctttaacctccctttgttgtggagaaaatgtgtcactaatcagtggtccaagggatatctagctttggttactcagttcctgcagcataacagatatgacttatgccagggaaggtagaggctgattatggagacacccaggaacaggaataagaagggataggtctgctccacgtagaacctccccagatcggaagttaagtcttggagagtttccaaagtgctgaagtaaaaaggagacttggagggcctttgcttaatgagcaagaggcttgtgtcctcccaagaacatgagggagttcagaagggagctatagctcacagacagaaacctgcccgctcaccccatccctcgtgactgggagcatgtttgctcagaattttctaagaggactctcccttcaaaaatccaatttgctcccagaatgttgtttagcctctgagaatctcactctttcatttccatctgtgaatggacatagatgtgttgctcagggatcagaaacatcagagtccagggcccagtggcatggtgttgcattagtagttagaaaagtaattggtcagctctactgtaaaagaaataagtatgtagtacagttttgtaaatgtcaggtctgttctattgttttgtgatctgaagactgtcaaactggttgataatcaaagaaaaggttggttagaataagtaaaatttcagttagaaagatatagcttaccagttttccatgtgcttaaggaagtcaagaatatttcaggttgttgagaactgttgtaaaatggaattgaagctagtgtctctcaccttcttaggtgtatcagagagaggaagtggaaggccagtagtagcatcttcatacttacttttgccagcccagcctccatttcaaagactttgtcttccatcctatccaatgacatggtcagggatgggctctgaggaggcagtgaggccccaccttggtttgctccactgtggtgtgtagtctccaaacagcttaagggtttttaagttttctcacgattacctccactccactcatctactatcagcatcagaaaggttaacatccctgggaccattctacttataaaagagatgaactagtgtgctttctccccttttccaggtgtgccatccatatacaatctcctcttggccaagttcaacaaatgtttccagggaaccccgtgggttgaggcaaagtagccaagatgtattgagttaagtttttctagaggacaaaagtatttcttgtcccttttccctcatgctcatatgttttagctgaggcgtaaatggccaagttgagtaatatctgtggaactgagacagagagccagggacccatgtacccagggaccagtcccctggggaatcacacagtggctcagactagactgctctatcccaccagaactctgctgctgttcatttccatcaggaccacccaggaaagcaaataagttagccttctcatcattaggtcacctaatctcttgggttgcaggatgagagcatatatagatctcctgtttagagagtgtgttcataattgtagaaagggatagaaaatggaataaccaagaggctgtgtcattttttaagaggatggcaaggatgacctcaaatgagctcaacaaaactgggaatccaaggaatggtgcttgtagggaaagagaggtcagttgtggtccttaaacctcttggcaccttgtgcgggttataaaacaaggagctggagtaaaattgcccttacccccaatccaaatgctgtccaggatttaggagctacccaacctgtggttatatggtgttggtttccattttttgtttgtttgcttgtttccaaaatagccttgcttggtactgcatggaaagttcaagcttttcttcttgcccgctcagggctggcctcttccccgtgtcttcacagcgtccctaaggaagatttttgcagcactctctggagctgaggggagtgaaatttggtccagagaaggcggaaggaaatagttttcctgtttccttttctcgaggtggatgtcctcaggcttccttcacacctccttctcatgggtgcggctggcagtacagtcaggctgtggaggagggctgagaagaaaggggcactggtccagccccaggtttggtctgagacaggtacacagcagataccatcccaccttcctctctaaagaacaggccagccacacatataaccctttccctactttactaatgtatcccttatgtggtaccagcaatggaggacaggcagacttaccccctgccatctagagagaatgttgttattacccgtaaaacttgaccacccccatatcccactcctttttgtaaaaacaaatgcttaaacctgtgagcctgccgttcctttctatgtgttaatcagtttccttccatttgagctgtgtgggagggaagggcattgaaattgtaggttgtaatcttgtgccaaccaataaaaaccagtatttcacacacaaaaaaaaaaaaaaaaaaaaaaaaaaaaaaaaaaaaaaacccggggggctctttttctgcgggggcgggggaaaaggaggtttgagagaaggggcaggggccaaagggggttcccgggacccgagtttttttgggcaacaggggggagaaaccggggggccccccaaggggggggggggaaaaatcggaaaaacccggggttcccggtagatgttcggtcgaac

SEQ ID NO: 313684 - DNA, 7252 bp, Homo sapiens
cttagtttacatcctctcccccaatcttcacacacagagccaaagagcagttatattcttgggataccatgatacctctgggaaaggaattatattcccaaggagaggtcccattggataagaacaataccatgggacttgagtctgaatgccaacttactattcacacatccttcttaaaaacgaacacactgtttcttttcctgacctagagcattctaaagttctgttcaaataaataaagggcaaaataaagtagatttaaccaagtgccaggtggaattcaaaaaacacattcttccagataaattctacctttatggtatggatttgaaagtactttgcaggaaaacagtcagtactctttaaaaagggactgcagggctgggtgtagtggctcacacctgtaatcccagcactttgggaggccaaggcaggtgggtcacttgaggccaggagtttgagaccagcctgaccaacatggcaaaaccccatctctactaaaatacaaaaattagctgggcatgatggtgcactcctgtaatcccagctacttggtaggctgaagcatgagaattgcttaaacctgggaggcagaggttgcagtaagccaagatcatgccactgcattccagcctgggcaacagagtaagactctgtcttaataaataaataagaaaataaaacggaactgcagtgctaacagtaatttatacatttttaaatgttctgagtatgttttgactgggctagtgtaacaatatactaccctgaaagtgcagttttgattgttgttggtgtctttgggtcaggaaagtgaactgtgccaagaagtatttttcagtgacatgaatggattcctgttaatgcaattgactgagagattgtgcttacgctttcttaactgacaaaaagaggctttgtccaacatcagaattgttgaaactggtgctgttttctgttgcactgggattctgatgatctgggattttccctccttggcacagtaaacaccatgactgtctttattgagaatgtcgtcacagtcctttagtgatagattagttagacccatggttgcaatacctttatctccccaaagaaaataatcaaaagaaagcacaaaagctaccctgtttgcagaatatttcactgacattgatttgtcattaattctaccagagctgacctcattcaggcttgatagaaacaggttcctatgtttagggcagatccctagcctctcgctcacagtgagtctgcatgtcctagattctggttattgctggagcatccattaaagtctaccaaactcaggacagaagaagatagcagtggatttgtaaaaatttttagtttataaattacagtcattggggaaacactagtaaggtcatgtgatcttttggaccaggattttctctctgtcttctctctgggtgtgtgtgtgtgtatgtacagaagggctaccaggaagtgtcaaccatgttagattttctgtagtcttccagaaacagtgcagcccatacaacaggaatcttaattttcctcacagcaaatataacaggatggaacagttagtgttttgttttcacaagtgtccaccactccatctgccctgcatggagagggctctctcactgctagatctaggctgagccatctggaaggatcaaagggtgtgggagtatcaccccctctcaggctgcagaaggtctcgagggtggcgtcacagcaggatttccgccttctgcattgcactgcacagccccatggaacatgaggcacttgaggccttgcttcttggagcctctggggagcagagtaggtcactgccctctgggagtgttttgcagtagttttgtaaatgtgttgctacatagtcaagttcctttgtggcaaagaaatattttgttttgatattaggagccagcccatgtaatgcctctcaggcttgcttgcttagaagaaaaaagtcaccctttgtggtttttaagaaaaaaattctgtgcagatctgttcctcctcctgctccttcccttttctctacatacagtgctcattggaggctcctgctaaaccttcttaaccagagaaataataggtatttgttagacctgagtgtacatttcacatgttatccttcacatatttctcattttcatctagtactttcttaatgcctttgttggagtccgcatcctcatctttaaaaaaaaaaaaaaaaaacagcttagcctaagccacattcactttttttagttcacaaaaaggatttaatagccacaatgtgatttttgccacaactgtgtgattttaatattctctaatatcaagggcggatttagaattgcaggaaatacctggagaaatcacagtggaatgaatttttgctttaagagaaatgagagttggctgtctctgtaattgataatacagcttcatcctagtcccatctgcatttcagaaaataaccctcatctttacaaaacacaggacacttgtgggacagttaactcaagcagctatggggagggaggagattattgaatggtgattaaataatgcaaatggctcttctgtttcttaaagactgtggaagaggtcagactgcccagttgaggtgggcagttcatactgctcagttgaggtggcagtcatttattctgagtcctgttggatagagcctatctcctcaaggctacagaggcttccaggatatggagctgtgcatgttaatggctcagccttgcctccatcagggcacctgcctaacttggagcaagtgggagagcaccctagagtcatcctctgtgctgtttcgtgagttttgcagcggagacttcaccatccggaggagctgtgtttctgtgtcacttgggatatcacctaaaaatgaaacatttgatattttaaggtataaaaaaaaagtaaattggggaacattggctgcagtccctaaaagatactgttgtctgtgcatcaggttagcttgaggtcaccacaggtcctgggagcccagagagtttaggcatactctcctttggaggccagcagcctttcacaaaccctgcctctaaaagggcggtttcacatttgaccatgtttttgcattagcctcagaaactcttgtctttagctgataacctttgagggatgtgagaagcctagttggagcatctgagaaaatgatacctctcaccttcaaattaatcaaatagtttgtccttctagtccccttataaattaataaatggagggctggtcatggtggctcacgcctgtaatcccagcactttgggaggccgaggcgggtggatcacaaggtcaggagttcaagaccagcctgaccaatatggtgaaaccccatctctactaaaaatacaaaaattagccaggtgtagtggcacgctcctgtagtcccagctactcgggaggctgaggcaggagaatcgcttgaacccaggaggtggatgttgcagtgagccgagatcccgccactgcactgcagcctaggcgacagagcaagactccgtctcaaaaaaaaaaaaagaaaaaaaaagaaaagggaagggaatcccattttgtgatgatttgggcacactacttgagctgaggctagcagtcacatgattttggctgtctctgacctgaagcttttgaagtaaggttatgtctcttccctgaagctttgtttatagtggtaatttggtgagtttgagctttgagcttgtcttagaaaataagactgtccacctggggaggggagcttatagggaacccgtgttaactcagaatgctgaagaaagtgcttttagccaacaaaagtaagattactatctagaaggtggaaagaagtcattgcttctgttcctccagcagtcagttgactctaggtttcctttggtttatatccccagttcttaatactaaaacttatttgacttcctatcaggaagcacacaaaaaaagcgtcatttaaaaccctggatataggctttaaaggatacaaaaacagcagcattgtcgttttgccaggttcatcaccattttgatgtgctacccatccttccaccctccctttcctgcccccaagcctcccagccaggccagatgtgaagattctattaatcactgtttcagagaacattaattcttgtatagaataattatctactaaattgcttattatctgtgactaccttgcagagaacatctcaacagtgcagtaaaatagctctcctagacttgagcttccagccaggcatttagatcactcttaagcctttgtggaattctgaggaaaaaaagcaagatgcctcaatgccaatgctgggccataagattctactcccctccctgtagggtggggcgcgtggctcagctttggaaaatcattttgccagtaatattgcctgtgaatccctttaagaagtcgtcctgatctgagcctgtctttctgagcactttggtgctgaattgaaaatggtaagctaaagcagtgacagatccacgtagcctctttaacctctttattatcttgccaaaaaaaaagtttctcaggttaaacctttgtctttaacctccctttgttgtggagaaaatgtgtcactaatcagtggtccaagggatatctagctttggttactcagttcctgcagcataacagatatgacttatgccagggaaggtagaggctgattatggagacacccaggaacaggaataagaagggataggtctgctccacgtagaacctccccagatcggaagttaagtcttggagagtttccaaagtgctgaagtaaaaaggagacttggagggcctttgcttaatgagcaagaggcttgtgtcctcccaagaacatgagggagttcagaagggagctatagctcacagacagaaacctgcccgctcaccccatccctcgtgactgggagcatgtttgctcagaattttctaagaggactctcccttcaaaaatccaatttgctcccagaatgttgtttagcctctgagaatctcactctttcatttccatctgtgaatggacatagatgtgttgctcagggatcagaaacatcagagtccagggcccagtggcatggtgttgcattagtagttagaaaagtaattggtcagctctactgtaaaagaaataagtatgtagtacagttttgtaaatgtcaggtctgttctattgttttgtgatctgaagactgtcaaactggttgataatcaaagaaaaggttggttagaataagtaaaatttcagttagaaagatatagcttaccagttttccatgtgcttaaggaagtcaagaatatttcaggttgttgagaactgttgtaaaatggaattgaagctagtgtctctcaccttcttaggtgtatcagagagaggaagtggaaggccagtagtagcatcttcatacttacttttgccagcccagcctccatttcaaagactttgtcttccatcctatccaatgacatggtcagggatgggctctgaggaggcagtgaggccccaccttggtttgctccactgtggtgtgtagtctccaaacagcttaagggtttttaagttttctcacgattacctccactccactcatctactatcagcatcagaaaggttaacatccctgggaccattctacttataaaagagatgaactagtgtgctttctccccttttccaggtgtgccatccatatacaatctcctcttggccaagttcaacaaatgtttccagggaaccccgtgggttgaggcaaagtagccaagatgtattgagttaagtttttctagaggacaaaagtatttcttgtcccttttccctcatgctcatatgttttagctgaggcgtaaatggccaagttgagtaatatctgtggaactgagacagagagccagggacccatgtacccagggaccagtcccctggggaatcacacagtggctcagactagactgctctatcccaccagaactctgctgctgttcatttccatcaggaccacccaggaaagcaaataagttagccttctcatcattaggtcacctaatctcttgggttgcaggatgagagcatatatagatctcctgtttagagagtgtgttcataattgtagaaagggatagaaaatggaataaccaagaggctgtgtcattttttaagaggatggcaaggatgacctcaaatgagctcaacaaaactgggaatccaaggaatggtgcttgtagggaaagagaggtcagttgtggtccttaaacctcttggcaccttgtgcgggttataaaacaaggagctggagtaaaattgcccttacccccaatccaaatgctgtccaggatttaggagctacccaacctgtggttatatggtgttggtttccattttttgtttgtttgcttgtttcctcagggctggcctcttccccgtgtcttcacagcgtccctaaggaagatttttgcagcactctctggagctgaggggagtgaaatttggtccagagaaggcggaaggaaatagttttcctgtttccttttctcgaggtggatgtcctcaggcttccttcacacctccttctcatgggtgcggctggcagtacagtcaggctgtggaggagggctgagaagaaaggggcactggtccagccccaggtttggtctgagacaggtacacagcagataccatcccaccttcctctctaaagaacaggccagccacacatataaccctttccctactttactaatgtatcccttatgtggtaccagcaatggaggacaggcagacttaccccctgccatctagagagaatgttgttattacccgtaaaacttgaccacccccatatcccactcctttttgtaaaaacaaatgcttaaacctgtgagcctgccgttcctttctatgtgttaatcagtttccttccatttgagctgtgtgggagggaagggcattgaaattgtaggttgtaatcttgtgccaaccaataaaaaccagtatttcacacacaaaaaaaaaaaaaaaaaaaaaaaaaaaaaaaaaaaaaaacccggggggctctttttctgcgggggcgggggaaaaggaggtttgagagaaggggcaggggccaaagggggttcccgggacccgagtttttttgggcaacaggggggagaaaccggggggccccccaaggggggggggggaaaaatcggaaaaacccggggttcccggtagatgttcggtcgaac

SEQ ID NO: 313685 - DNA, 7306 bp, Homo sapiens
  misc_feature (6411)..(6412): n is a, c, g, or t
  misc_feature (6415)..(6415): n is a, c, g, or t
  misc_feature (6423)..(6423): n is a, c, g, or t
  misc_feature (6436)..(6437): n is a, c, g, or t
  misc_feature (6442)..(6442): n is a, c, g, or t
  misc_feature (6463)..(6463): n is a, c, g, or t
  misc_feature (6481)..(6481): n is a, c, g, or t
  misc_feature (6488)..(6488): n is a, c, g, or t
  misc_feature (6493)..(6493): n is a, c, g, or t
  misc_feature (6495)..(6495): n is a, c, g, or t
cttagtttacatcctctcccccaatcttcacacacagagccaaagagcagttatattcttgggataccatgatacctctgggaaaggaattatattcccaaggagaggtcccattggataagaacaataccatgggacttgagtctgaatgccaacttactattcacacatccttcttaaaaacgaacacactgtttcttttcctgacctagagcattctaaagttctgttcaaataaataaagggcaaaataaagtagatttaaccaagtgccaggtggaattcaaaaaacacattcttccagataaattctacctttatggtatggatttgaaagtactttgcaggaaaacagtcagtactctttaaaaagggactgcagggctgggtgtagtggctcacacctgtaatcccagcactttgggaggccaaggcaggtgggtcacttgaggccaggagtttgagaccagcctgaccaacatggcaaaaccccatctctactaaaatacaaaaattagctgggcatgatggtgcactcctgtaatcccagctacttggtaggctgaagcatgagaattgcttaaacctgggaggcagaggttgcagtaagccaagatcatgccactgcattccagcctgggcaacagagtaagactctgtcttaataaataaataagaaaataaaacggaactgcagtgctaacagtaatttatacatttttaaatgttctgagtatgttttgactgggctagtgtaacaatatactaccctgaaagtgcagttttgattgttgttggtgtctttgggtcaggaaagtgaactgtgccaagaagtatttttcagtgacatgaatggattcctgttaatgcaattgactgagagattgtgcttacgctttcttaactgacaaaaagaggctttgtccaacatcagaattgttgaaactggtgctgttttctgttgcactgggattctgatgatctgggattttccctccttggcacagtaaacaccatgactgtctttattgagaatgtcgtcacagtcctttagtgatagattagttagacccatggttgcaatacctttatctccccaaagaaaataatcaaaagaaagcacaaaagctaccctgtttgcagaatatttcactgacattgatttgtcattaattctaccagagctgacctcattcaggcttgatagaaacaggttcctatgtttagggcagatccctagcctctcgctcacagtgagtctgcatgtcctagattctggttattgctggagcatccattaaagtctaccaaactcaggacagaagaagatagcagtggatttgtaaaaatttttagtttataaattacagtcattggggaaacactagtaaggtcatgtgatcttttggaccaggattttctctctgtcttctctctgggtgtgtgtgtgtgtatgtacagaagggctaccaggaagtgtcaaccatgttagattttctgtagtcttccagaaacagtgcagcccatacaacaggaatcttaattttcctcacagcaaatataacaggatggaacagttagtgttttgttttcacaagtgtccaccactccatctgccctgcatggagagggctctctcactgctagatctaggctgagccatctggaaggatcaaagggtgtgggagtatcaccccctctcaggctgcagaaggtctcgagggtggcgtcacagcaggatttccgccttctgcattgcactgcacagccccatggaacatgaggcacttgaggccttgcttcttggagcctctggggagcagagtaggtcactgccctctgggagtgttttgcagtagttttgtaaatgtgttgctacatagtcaagttcctttgtggcaaagaaatattttgttttgatattaggagccagcccatgtaatgcctctcaggcttgcttgcttagaagaaaaaagtcaccctttgtggtttttaagaaaaaaattctgtgcagatctgttcctcctcctgctccttcccttttctctacatacagtgctcattggaggctcctgctaaaccttcttaaccagagaaataataggtatttgttagacctgagtgtacatttcacatgttatccttcacatatttctcattttcatctagtactttcttaatgcctttgttggagtccgcatcctcatctttaaaaaaaaaaaaaaaaaacagcttagcctaagccacattcactttttttagttcacaaaaaggatttaatagccacaatgtgatttttgccacaactgtgtgattttaatattctctaatatcaagggcggatttagaattgcaggaaatacctggagaaatcacagtggaatgaatttttgctttaagagaaatgagagttggctgtctctgtaattgataatacagcttcatcctagtcccatctgcatttcagaaaataaccctcatctttacaaaacacaggacacttgtgggacagttaactcaagcagctatggggagggaggagattattgaatggtgattaaataatgcaaatggctcttctgtttcttaaagactgtggaagaggtcagactgcccagttgaggtgggcagttcatactgctcagttgaggtggcagtcatttattctgagtcctgttggatagagcctatctcctcaaggctacagaggcttccaggatatggagctgtgcatgttaatggctcagccttgcctccatcagggcacctgcctaacttggagcaagtgggagagcaccctagagtcatcctctgtgctgtttcgtgagttttgcagcggagacttcaccatccggaggagctgtgtttctgtgtcacttgggatatcacctaaaaatgaaacatttgatattttaaggtataaaaaaaaagtaaattggggaacattggctgcagtccctaaaagatactgttgtctgtgcatcaggttagcttgaggtcaccacaggtcctgggagcccagagagtttaggcatactctcctttggaggccagcagcctttcacaaaccctgcctctaaaagggcggtttcacatttgaccatgtttttgcattagcctcagaaactcttgtctttagctgataacctttgagggatgtgagaagcctagttggagcatctgagaaaatgatacctctcaccttcaaattaatcaaatagtttgtccttctagtccccttataaattaataaatggagggctggtcatggtggctcacgcctgtaatcccagcactttgggaggccgaggcgggtggatcacaaggtcaggagttcaagaccagcctgaccaatatggtgaaaccccatctctactaaaaatacaaaaattagccaggtgtagtggcacgctcctgtagtcccagctactcgggaggctgaggcaggagaatcgcttgaacccaggaggtggatgttgcagtgagccgagatcccgccactgcactgcagcctaggcgacagagcaagactccgtctcaaaaaaaaaaaaagaaaaaaaaagaaaagggaagggaatcccattttgtgatgatttgggcacactacttgagctgaggctagcagtcacatgattttggctgtctctgacctgaagcttttgaagtaaggttatgtctcttccctgaagctttgtttatagtggtaatttggtgagtttgagctttgagcttgtcttagaaaataagactgtccacctggggaggggagcttatagggaacccgtgttaactcagaatgctgaagaaagtgcttttagccaacaaaagtaagattactatctagaaggtggaaagaagtcattgcttctgttcctccagcagtcagttgactctaggtttcctttggtttatatccccagttcttaatactaaaacttatttgacttcctatcaggaagcacacaaaaaaagcgtcatttaaaaccctggatataggctttaaaggatacaaaaacagcagcattgtcgttttgccaggttcatcaccattttgatgtgctacccatccttccaccctccctttcctgcccccaagcctcccagccaggccagatgtgaagattctattaatcactgtttcagagaacattaattcttgtatagaataattatctactaaattgcttattatctgtgactaccttgcagagaacatctcaacagtgcagtaaaatagctctcctagacttgagcttccagccaggcatttagatcactcttaagcctttgtggaattctgaggaaaaaaagcaagatgcctcaatgccaatgctgggccataagattctactcccctccctgtagggtggggcgcgtggctcagctttggaaaatcattttgccagtaatattgcctgtgaatccctttaagaagtcgtcctgatctgagcctgtctttctgagcactttggtgctgaattgaaaatggtaagctaaagcagtgacagatccacgtagcctctttaacctctttattatcttgccaaaaaaaaagtttctcaggttaaacctttgtctttaacctccctttgttgtggagaaaatgtgtcactaatcagtggtccaagggatatctagctttggttactcagttcctgcagcataacagatatgacttatgccagggaaggtagaggctgattatggagacacccaggaacaggaataagaagggataggtctgctccacgtagaacctccccagatcggaagttaagtcttggagagtttccaaagtgctgaagtaaaaaggagacttggagggcctttgcttaatgagcaagaggcttgtgtcctcccaagaacatgagggagttcagaagggagctatagctcacagacagaaacctgcccgctcaccccatccctcgtgactgggagcatgtttgctcagaattttctaagaggactctcccttcaaaaatccaatttgctcccagaatgttgtttagcctctgagaatctcactctttcatttccatctgtgaatggacatagatgtgttgctcagggatcagaaacatcagagtccagggcccagtggcatggtgttgcattagtagttagaaaagtaattggtcagctctactgtaaaagaaataagtatgtagtacagttttgtaaatgtcaggtctgttctattgttttgtgatctgaagactgtcaaactggttgataatcaaagaaaaggttggttagaataagtaaaatttcagttagaaagatatagcttaccagttttccatgtgcttaaggaagtcaagaatatttcaggttgttgagaactgttgtaaaatggaattgaagctagtgtctctcaccttcttaggtgtatcagagagaggaagtggaaggccagtagtagcatcttcatacttacttttgccagcccagcctccatttcaaagactttgtcttccatcctatccaatgacatggtcagggatgggctctgaggaggcagtgaggccccaccttggtttgctccactgtggtgtgtagtctccaaacagcttaagggtttttaagttttctcacgattacctccactccactcatctactatcagcatcagaaaggttaacatccctgggaccattctacttataaaagagatgaactagtgtgctttctccccttttccaggtgtgccatccatatacaatctcctcttggccaagttcaacaaatgtttccagggaaccccgtgggttgaggcaaagtagccaagatgtattgagttaagtttttctagaggacaaaagtatttcttgtcccttttccctcatgctcatatgttttagctgaggcgtaaatggccaagttgagtaatatctgtggaactgagacagagagccagggacccatgtacccagggaccagtcccctggggaatcacacagtggctcagactagactgctctatcccaccagaactctgctgctgttcatttccatcaggaccacccaggaaagcaaataagttagccttctcatcattaggtcacctaatctcttgggttgcaggatgagagcatatatagatctcctgtttagagagtgtgttcataattgtagaaagggatagaaaatggaataaccaagaggctgtgtcattttttaagaggatggcaaggatgacctcaaatgagctcaacaaaactgggaatccaaggaatggtgcttgtagggaaagagaggtcagttgtggtccttaaacctcttggcaccttgtgcgggttataaaacaaggagctggagtaaaattgcccttacccccaatccaaatgctgtccaggatttaggagctacccaacctgtggttatatggtgttgggggccagggggggnnggngggcgggnggccaaaagagcnnggcgnggggcggcggggaaagggcangcggggcggcgggcccgngcagggngggcngnggccccggggcggcacagcgtccctaaggaagatttttgcagcactctctggagctgaggggagtgaaatttggtccagagaaggcggaaggaaatagttttcctgtttccttttctcgaggtggatgtcctcaggcttccttcacacctccttctcatgggtgcggctggcagtacagtcaggctgtggaggagggctgagaagaaaggggcactggtccagccccaggtttggtctgagacaggtacacagcagataccatcccaccttcctctctaaagaacaggccagccacacatataaccctttccctactttactaatgtatcccttatgtggtaccagcaatggaggacaggcagacttaccccctgccatctagagagaatgttgttattacccgtaaaacttgaccacccccatatcccactcctttttgtaaaaacaaatgcttaaacctgtgagcctgccgttcctttctatgtgttaatcagtttccttccatttgagctgtgtgggagggaagggcattgaaattgtaggttgtaatcttgtgccaaccaataaaaaccagtatttcacacacaaaaaaaaaaaaaaaaaaaaaaaaaaaaaaaaaaaaaaacccggggggctctttttctgcgggggcgggggaaaaggaggtttgagagaaggggcaggggccaaagggggttcccgggacccgagtttttttgggcaacaggggggagaaaccggggggccccccaaggggggggggggaaaaatcggaaaaacccggggttcccggtagatgttcggtcgaac

SEQ ID NO: 313686 - DNA, 3605 bp, Homo sapiens
  misc_feature (15)..(15): n is a, c, g, or t
ccttgtctggttacnccctcggagtattggatatcagtcgatcacacgcgctcagggagggagagcgggagtagcggaacccgtgttaactcagaatgctgaagaaagtgcttttagccaacaaaagtaagattactatctagaaggtggaaagaagtcattgcttctgttcctccagcagtcagttgactctaggtttcctttggtttatatccccagttcttaatactaaaacttatttgacttcctatcaggaagcacacaaaaaaagcgtcatttaaaaccctggatataggctttaaaggatacaaaaacagcagcattgtcgttttgccaggttcatcaccattttgatgtgctacccatccttccaccctccctttcctgcccccaagcctcccagccaggccagatgtgaagattctattaatcactgtttcagagaacattaattcttgtatagaataattatctactaaattgcttattatctgtgactaccttgcagagaacatctcaacagtgcagtaaaatagctctcctagacttgagcttccagccaggcatttagatcactcttaagcctttgtggaattctgaggaaaaaaagcaagatgcctcaatgccaatgctgggccataagattctactcccctccctgtagggtggggcgcgtggctcagctttggaaaatcattttgccagtaatattgcctgtgaatccctttaagaagtcgtcctgatctgagcctgtctttctgagcactttggtgctgaattgaaaatggtaagctaaagcagtgacagatccacgtagcctctttaacctctttattatcttgccaaaaaaaaagtttctcaggttaaacctttgtctttaacctccctttgttgtggagaaaatgtgtcactaatcagtggtccaagggatatctagctttggttactcagttcctgcagcataacagatatgacttatgccagggaaggtagaggctgattatggagacacccaggaacaggaataagaagggataggtctgctccacgtagaacctccccagatcggaagttaagtcttggagagtttccaaagtgctgaagtaaaaaggagacttggagggcctttgcttaatgagcaagaggcttgtgtcctcccaagaacatgagggagttcagaagggagctatagctcacagacagaaacctgcccgctcaccccatccctcgtgactgggagcatgtttgctcagaattttctaagaggactctcccttcaaaaatccaatttgctcccagaatgttgtttagcctctgagaatctcactctttcatttccatctgtgaatggacatagatgtgttgctcagggatcagaaacatcagagtccagggcccagtggcatggtgttgcattagtagttagaaaagtaattggtcagctctactgtaaaagaaataagtatgtagtacagttttgtaaatgtcaggtctgttctattgttttgtgatctgaagactgtcaaactggttgataatcaaagaaaaggttggttagaataagtaaaatttcagttagaaagatatagcttaccagttttccatgtgcttaaggaagtcaagaatatttcaggttgttgagaactgttgtaaaatggaattgaagctagtgtctctcaccttcttaggtgtatcagagagaggaagtggaaggccagtagtagcatcttcatacttacttttgccagcccagcctccatttcaaagactttgtcttccatcctatccaatgacatggtcagggatgggctctgaggaggcagtgaggccccaccttggtttgctccactgtggtgtgtagtctccaaacagcttaagggtttttaagttttctcacgattacctccactccactcatctactatcagcatcagaaaggttaacatccctgggaccattctacttataaaagagatgaactagtgtgctttctccccttttccaggtgtgccatccatatacaatctcctcttggccaagttcaacaaatgtttccagggaaccccgtgggttgaggcaaagtagccaagatgtattgagttaagtttttctagaggacaaaagtatttcttgtcccttttccctcatgctcatatgttttagctgaggcgtaaatggccaagttgagtaatatctgtggaactgagacagagagccagggacccatgtacccagggaccagtcccctggggaatcacacagtggctcagactagactgctctatcccaccagaactctgctgctgttcatttccatcaggaccacccaggaaagcaaataagttagccttctcatcattaggtcacctaatctcttgggttgcaggatgagagcatatatagatctcctgtttagagagtgtgttcataattgtagaaagggatagaaaatggaataaccaagaggctgtgtcattttttaagaggatggcaaggatgacctcaaatgagctcaacaaaactgggaatccaaggaatggtgcttgtagggaaagagaggtcagttgtggtccttaaacctcttggcaccttgtgcgggttataaaacaaggagctggagtaaaattgcccttacccccaatccaaatgctgtccaggatttaggagctacccaacctgtggttatatggtgttggtttccattttttgtttgtttgcttgtttccaaaatagccttgcttggtactgcatggaaagttcaagcttttcttcttgcccgctcagggctggcctcttccccgtgtcttcacagcgtccctaaggaagatttttgcagcactctctggagctgaggggagtgaaatttggtccagagaaggcggaaggaaatagttttcctgtttccttttctcgaggtggatgtcctcaggcttccttcacacctccttctcatgggtgcggctggcagtacagtcaggctgtggaggagggctgagaagaaaggggcactggtccagccccaggtttggtctgagacaggtacacagcagataccatcccaccttcctctctaaagaacaggccagccacacatataaccctttccctactttactaatgtatcccttatgtggtaccagcaatggaggacaggcagacttaccccctgccatctagagagaatgttgttattacccgtaaaacttgaccacccccatatcccactcctttttgtaaaaacaaatgcttaaacctgtgagcctgccgttcctttctatgtgttaatcagtttccttccatttgagctgtgtgggagggaagggcattgaaattgtaggttgtaatcttgtgccaaccaataaaaaccagtatttcacacacaaaaaaaaaaaaaaaaaaaaaaaaaaaaaaaaaaaaaaacccggggggctctttttctgcgggggcgggggaaaaggaggtttgagagaaggggcaggggccaaagggggttcccgggacccgagtttttttgggcaacaggggggagaaaccggggggccccccaaggggggggggggaaaaatcggaaaaacccggggttcccggtagatgttcggtcgaac

SEQ ID NO: 313687 - DNA, 7250 bp, Homo sapiens
cttagtttacatcctctcccccaatcttcacacacagagccaaagagcagttatattcttgggataccatgatacctctgggaaaggaattatattcccaaggagaggtcccattggataagaacaataccatgggacttgagtctgaatgccaacttactattcacacatccttcttaaaaacgaacacactgtttcttttcctgacctagagcattctaaagttctgttcaaataaataaagggcaaaataaagtagatttaaccaagtgccaggtggaattcaaaaaacacattcttccagataaattctacctttatggtatggatttgaaagtactttgcaggaaaacagtcagtactctttaaaaagggactgcagggctgggtgtagtggctcacacctgtaatcccagcactttgggaggccaaggcaggtgggtcacttgaggccaggagtttgagaccagcctgaccaacatggcaaaaccccatctctactaaaatacaaaaattagctgggcatgatggtgcactcctgtaatcccagctacttggtaggctgaagcatgagaattgcttaaacctgggaggcagaggttgcagtaagccaagatcatgccactgcattccagcctgggcaacagagtaagactctgtcttaataaataaataagaaaataaaacggaactgcagtgctaacagtaatttatacatttttaaatgttctgagtatgttttgactgggctagtgtaacaatatactaccctgaaagtgcagttttgattgttgttggtgtctttgggtcaggaaagtgaactgtgccaagaagtatttttcagtgacatgaatggattcctgttaatgcaattgactgagagattgtgcttacgctttcttaactgacaaaaagaggctttgtccaacatcagaattgttgaaactggtgctgttttctgttgcactgggattctgatgatctgggattttccctccttggcacagtaaacaccatgactgtctttattgagaatgtcgtcacagtcctttagtgatagattagttagacccatggttgcaatacctttatctccccaaagaaaataatcaaaagaaagcacaaaagctaccctgtttgcagaatatttcactgacattgatttgtcattaattctaccagagctgacctcattcaggcttgatagaaacaggttcctatgtttagggcagatccctagcctctcgctcacagtgagtctgcatgtcctagattctggttattgctggagcatccattaaagtctaccaaactcaggacagaagaagatagcagtggatttgtaaaaatttttagtttataaattacagtcattggggaaacactagtaaggtcatgtgatcttttggaccaggattttctctctgtcttctctctgggtgtgtgtgtgtgtatgtacagaagggctaccaggaagtgtcaaccatgttagattttctgtagtcttccagaaacagtgcagcccatacaacaggaatcttaattttcctcacagcaaatataacaggatggaacagttagtgttttgttttcacaagtgtccaccactccatctgccctgcatggagagggctctctcactgctagatctaggctgagccatctggaaggatcaaagggtgtgggagtatcaccccctctcaggctgcagaaggtctcgagggtggcgtcacagcaggatttccgccttctgcattgcactgcacagccccatggaacatgaggcacttgaggccttgcttcttggagcctctggggagcagagtaggtcactgccctctgggagtgttttgcagtagttttgtaaatgtgttgctacatagtcaagttcctttgtggcaaagaaatattttgttttgatattaggagccagcccatgtaatgcctctcaggcttgcttgcttagaagaaaaaagtcaccctttgtggtttttaagaaaaaaattctgtgcagatctgttcctcctcctgctccttcccttttctctacatacagtgctcattggaggctcctgctaaaccttcttaaccagagaaataataggtatttgttagacctgagtgtacatttcacatgttatccttcacatatttctcattttcatctagtactttcttaatgcctttgttggagtccgcatcctcatctttaaaaaaaaaaaaaaaaaacagcttagcctaagccacattcactttttttagttcacaaaaaggatttaatagccacaatgtgatttttgccacaactgtgtgattttaatattctctaatatcaagggcggatttagaattgcaggaaatacctggagaaatcacagtggaatgaatttttgctttaagagaaatgagagttggctgtctctgtaattgataatacagcttcatcctagtcccatctgcatttcagaaaataaccctcatctttacaaaacacaggacacttgtgggacagttaactcaagcagctatggggagggaggagattattgaatggtgattaaataatgcaaatggctcttctgtttcttaaagactgtggaagaggtcagactgcccagttgaggtgggcagttcatactgctcagttgaggtggcagtcatttattctgagtcctgttggatagagcctatctcctcaaggctacagaggcttccaggatatggagctgtgcatgttaatggctcagccttgcctccatcagggcacctgcctaacttggagcaagtgggagagcaccctagagtcatcctctgtgctgtttcgtgagttttgcagcggagacttcaccatccggaggagctgtgtttctgtgtcacttgggatatcacctaaaaatgaaacatttgatattttaaggtataaaaaaaaagtaaattggggaacattggctgcagtccctaaaagatactgttgtctgtgcatcaggttagcttgaggtcaccacaggtcctgggagcccagagagtttaggcatactctcctttggaggccagcagcctttcacaaaccctgcctctaaaagggcggtttcacatttgaccatgtttttgcattagcctcagaaactcttgtctttagctgataacctttgagggatgtgagaagcctagttggagcatctgagaaaatgatacctctcaccttcaaattaatcaaatagtttgtccttctagtccccttataaattaataaatggagggctggtcatggtggctcacgcctgtaatcccagcactttgggaggccgaggcgggtggatcacaaggtcaggagttcaagaccagcctgaccaatatggtgaaaccccatctctactaaaaatacaaaaattagccaggtgtagtggcacgctcctgtagtcccagctactcgggaggctgaggcaggagaatcgcttgaacccaggaggtggatgttgcagtgagccgagatcccgccactgcactgcagcctaggcgacagagcaagactccgtctcaaaaaaaaaaaaagaaaaaaaaagaaaagggaagggaatcccattttgtgatgatttgggcacactacttgagctgaggctagcagtcacatgattttggctgtctctgacctgaagcttttgaagtaaggttatgtctcttccctgaagctttgtttatagtggtaatttggtgagtttgagctttgagcttgtcttagaaaataagactgtccacctggggaggggagcttatagggaacccgtgttaactcagaatgctgaagaaagtgcttttagccaacaaaagtaagattactatctagaaggtggaaagaagtcattgcttctgttcctccagcagtcagttgactctaggtttcctttggtttatatccccagttcttaatactaaaacttatttgacttcctatcaggaagcacacaaaaaaagcgtcatttaaaaccctggatataggctttaaaggatacaaaaacagcagcattgtcgttttgccaggttcatcaccattttgatgtgctacccatccttccaccctccctttcctgcccccaagcctcccagccaggccagatgtgaagattctattaatcactgtttcagagaacattaattcttgtatagaataattatctactaaattgcttattatctgtgactaccttgcagagaacatctcaacagtgcagtaaaatagctctcctagacttgagcttccagccaggcatttagatcactcttaagcctttgtggaattctgaggaaaaaaagcaagatgcctcaatgccaatgctgggccataagattctactcccctccctgtagggtggggcgcgtggctcagctttggaaaatcattttgccagtaatattgcctgtgaatccctttaagaagtcgtcctgatctgagcctgtctttctgagcactttggtgctgaattgaaaatggtaagctaaagcagtgacagatccacgtagcctctttaacctctttattatcttgccaaaaaaaaagtttctcaggttaaacctttgtctttaacctccctttgttgtggagaaaatgtgtcactaatcagtggtccaagggatatctagctttggttactcagttcctgcagcataacagatatgacttatgccagggaaggtagaggctgattatggagacacccaggaacaggaataagaagggataggtctgctccacgtagaacctccccagatcggaagttaagtcttggagagtttccaaagtgctgaagtaaaaaggagacttggagggcctttgcttaatgagcaagaggcttgtgtcctcccaagaacatgagggagttcagaagggagctatagctcacagacagaaacctgcccgctcaccccatccctcgtgactgggagcatgtttgctcagaattttctaagaggactctcccttcaaaaatccaatttgctcccagaatgttgtttagcctctgagaatctcactctttcatttccatctgtgaatggacatagatgtgttgctcagggatcagaaacatcagagtccagggcccagtggcatggtgttgcattagtagttagaaaagtaattggtcagctctactgtaaaagaaataagtatgtagtacagttttgtaaatgtcaggtctgttctattgttttgtgatctgaagactgtcaaactggttgataatcaaagaaaaggttggttagaataagtaaaatttcagttagaaagatatagcttaccagttttccatgtgcttaaggaagtcaagaatatttcaggttgttgagaactgttgtaaaatggaattgaagctagtgtctctcaccttcttaggtgtatcagagagaggaagtggaaggccagtagtagcatcttcatacttacttttgccagcccagcctccatttcaaagactttgtcttccatcctatccaatgacatggtcagggatgggctctgaggaggcagtgaggccccaccttggtttgctccactgtggtgtgtagtctccaaacagcttaagggtttttaagttttctcacgattacctccactccactcatctactatcagcatcagaaaggttaacatccctgggaccattctacttataaaagagatgaactagtgtgctttctccccttttccaggtgtgccatccatatacaatctcctcttggccaagttcaacaaatgtttccagggaaccccgtgggttgaggcaaagtagccaagatgtattgagttaagtttttctagaggacaaaagtatttcttgtcccttttccctcatgctcatatgttttagctgaggcgtaaatggccaagttgagtaatatctgtggaactgagacagagagccagggacccatgtacccagggaccagtcccctggggaatcacacagtggctcagactagactgctctatcccaccagaactctgctgctgttcatttccatcaggaccacccaggaaagcaaataagttagccttctcatcattaggtcacctaatctcttgggttgcaggatgagagcatatatagatctcctgtttagagagtgtgttcataattgtagaaagggatagaaaatggaataaccaagaggctgtgtcattttttaagaggatggcaaggatgacctcaaatgagctcaacaaaactgggaatccaaggaatggtgcttgtagggaaagagaggtcagttgtggtccttaaacctcttggcaccttgtgcgggttataaaacaaggagctggagtaaaattgcccttacccccaatccaaatgctgtccaggatttaggagctacccaacctgtggttatatggtgttggtttccattttttgtttgtttgcttgtttccaaaatagccttgcttggtactgcatggaaagttcaagcttttcttcttgcccgctcagggctggcctcttccccgtgtcttcacagcgtccctaaggaagatttttgcagcactctctggagctgaggggagtgaaatttggtccagagaaggcggaaggctccttctcatgggtgcggctggcagtacagtcaggctgtggaggagggctgagaagaaaggggcactggtccagccccaggtttggtctgagacaggtacacagcagataccatcccaccttcctctctaaagaacaggccagccacacatataaccctttccctactttactaatgtatcccttatgtggtaccagcaatggaggacaggcagacttaccccctgccatctagagagaatgttgttattacccgtaaaacttgaccacccccatatcccactcctttttgtaaaaacaaatgcttaaacctgtgagcctgccgttcctttctatgtgttaatcagtttccttccatttgagctgtgtgggagggaagggcattgaaattgtaggttgtaatcttgtgccaaccaataaaaaccagtatttcacacacaaaaaaaaaaaaaaaaaaaaaaaaaaaaaaaaaaaaaaacccggggggctctttttctgcgggggcgggggaaaaggaggtttgagagaaggggcaggggccaaagggggttcccgggacccgagtttttttgggcaacaggggggagaaaccggggggccccccaaggggggggggggaaaaatcggaaaaacccggggttcccggtagatgttcggtcgaac

SEQ ID NO: 313688 - DNA, 7085 bp, Homo sapiens
cttagtttacatcctctcccccaatcttcacacacagagccaaagagcagttatattcttgggataccatgatacctctgggaaaggaattatattcccaaggagaggtcccattggataagaacaataccatgggacttgagtctgaatgccaacttactattcacacatccttcttaaaaacgaacacactgtttcttttcctgacctagagcattctaaagttctgttcaaataaataaagggcaaaataaagtagatttaaccaagtgccaggtggaattcaaaaaacacattcttccagataaattctacctttatggtatggatttgaaagtactttgcaggaaaacagtcagtactctttaaaaagggactgcagggctgggtgtagtggctcacacctgtaatcccagcactttgggaggccaaggcaggtgggtcacttgaggccaggagtttgagaccagcctgaccaacatggcaaaaccccatctctactaaaatacaaaaattagctgggcatgatggtgcactcctgtaatcccagctacttggtaggctgaagcatgagaattgcttaaacctgggaggcagaggttgcagtaagccaagatcatgccactgcattccagcctgggcaacagagtaagactctgtcttaataaataaataagaaaataaaacggaactgcagtgctaacagtaatttatacatttttaaatgttctgagtatgttttgactgggctagtgtaacaatatactaccctgaaagtgcagttttgattgttgttggtgtctttgggtcaggaaagtgaactgtgccaagaagtatttttcagtgacatgaatggattcctgttaatgcaattgactgagagattgtgcttacgctttcttaactgacaaaaagaggctttgtccaacatcagaattgttgaaactggtgctgttttctgttgcactgggattctgatgatctgggattttccctccttggcacagtaaacaccatgactgtctttattgagaatgtcgtcacagtcctttagtgatagattagttagacccatggttgcaatacctttatctccccaaagaaaataatcaaaagaaagcacaaaagctaccctgtttgcagaatatttcactgacattgatttgtcattaattctaccagagctgacctcattcaggcttgatagaaacaggttcctatgtttagggcagatccctagcctctcgctcacagtgagtctgcatgtcctagattctggttattgctggagcatccattaaagtctaccaaactcaggacagaagaagatagcagtggatttgtaaaaatttttagtttataaattacagtcattggggaaacactagtaaggtcatgtgatcttttggaccaggattttctctctgtcttctctctgggtgtgtgtgtgtgtatgtacagaagggctaccaggaagtgtcaaccatgttagattttctgtagtcttccagaaacagtgcagcccatacaacaggaatcttaattttcctcacagcaaatataacaggatggaacagttagtgttttgttttcacaagtgtccaccactccatctgccctgcatggagagggctctctcactgctagatctaggctgagccatctggaaggatcaaagggtgtgggagtatcaccccctctcaggctgcagaaggtctcgagggtggcgtcacagcaggatttccgccttctgcattgcactgcacagccccatggaacatgaggcacttgaggccttgcttcttggagcctctggggagcagagtaggtcactgccctctgggagtgttttgcagtagttttgtaaatgtgttgctacatagtcaagttcctttgtggcaaagaaatattttgttttgatattaggagccagcccatgtaatgcctctcaggcttgcttgcttagaagaaaaaagtcaccctttgtggtttttaagaaaaaaattctgtgcagatctgttcctcctcctgctccttcccttttctctacatacagtgctcattggaggctcctgctaaaccttcttaaccagagaaataataggtatttgttagacctgagtgtacatttcacatgttatccttcacatatttctcattttcatctagtactttcttaatgcctttgttggagtccgcatcctcatctttaaaaaaaaaaaaaaaaaacagcttagcctaagccacattcactttttttagttcacaaaaaggatttaatagccacaatgtgatttttgccacaactgtgtgattttaatattctctaatatcaagggcggatttagaattgcaggaaatacctggagaaatcacagtggaatgaatttttgctttaagagaaatgagagttggctgtctctgtaattgataatacagcttcatcctagtcccatctgcatttcagaaaataaccctcatctttacaaaacacaggacacttgtgggacagttaactcaagcagctatggggagggaggagattattgaatggtgattaaataatgcaaatggctcttctgtttcttaaagactgtggaagaggtcagactgcccagttgaggtgggcagttcatactgctcagttgaggtggcagtcatttattctgagtcctgttggatagagcctatctcctcaaggctacagaggcttccaggatatggagctgtgcatgttaatggctcagccttgcctccatcagggcacctgcctaacttggagcaagtgggagagcaccctagagtcatcctctgtgctgtttcgtgagttttgcagcggagacttcaccatccggaggagctgtgtttctgtgtcacttgggatatcacctaaaaatgaaacatttgatattttaaggtataaaaaaaaagtaaattggggaacattggctgcagtccctaaaagatactgttgtctgtgcatcaggttagcttgaggtcaccacaggtcctgggagcccagagagtttaggcatactctcctttggaggccagcagcctttcacaaaccctgcctctaaaagggcggtttcacatttgaccatgtttttgcattagcctcagaaactcttgtctttagctgataacctttgagggatgtgagaagcctagttggagcatctgagaaaatgatacctctcaccttcaaattaatcaaatagtttgtccttctagtccccttataaattaataaatggagggctggtcatggtggctcacgcctgtaatcccagcactttgggaggccgaggcgggtggatcacaaggtcaggagttcaagaccagcctgaccaatatggtgaaaccccatctctactaaaaatacaaaaattagccaggtgtagtggcacgctcctgtagtcccagctactcgggaggctgaggcaggagaatcgcttgaacccaggaggtggatgttgcagtgagccgagatcccgccactgcactgcagcctaggcgacagagcaagactccgtctcaaaaaaaaaaaaagaaaaaaaaagaaaagggaagggaatcccattttgtgatgatttgggcacactacttgagctgaggctagcagtcacatgattttggctgtctctgacctgaagcttttgaagtaaggttatgtctcttccctgaagctttgtttatagtggtaatttggtgagtttgagctttgagcttgtcttagaaaataagactgtccacctggggaggggagcttatagggaacccgtgttaactcagaatgctgaagaaagtgcttttagccaacaaaagtaagattactatctagaaggtggaaagaagtcattgcttctgttcctccagcagtcagttgactctaggtttcctttggtttatatccccagttcttaatactaaaacttatttgacttcctatcaggaagcacacaaaaaaagcgtcatttaaaaccctggatataggctttaaaggatacaaaaacagcagcattgtcgttttgccaggttcatcaccattttgatgtgctacccatccttccaccctccctttcctgcccccaagcctcccagccaggccagatgtgaagattctattaatcactgtttcagagaacattaattcttgtatagaataattatctactaaattgcttattatctgtgactaccttgcagagaacatctcaacagtgcagtaaaatagctctcctagacttgagcttccagccaggcatttagatcactcttaagcctttgtggaattctgaggaaaaaaagcaagatgcctcaatgccaatgctgggccataagattctactcccctccctgtagggtggggcgcgtggctcagctttggaaaatcattttgccagtaatattgcctgtgaatccctttaagaagtcgtcctgatctgagcctgtctttctgagcactttggtgctgaattgaaaatggtaagctaaagcagtgacagatccacgtagcctctttaacctctttattatcttgccaaaaaaaaagtttctcaggttaaacctttgtctttaacctccctttgttgtggagaaaatgtgtcactaatcagtggtccaagggatatctagctttggttactcagttcctgcagcataacagatatgacttatgccagggaaggtagaggctgattatggagacacccaggaacaggaataagaagggataggtctgctccacgtagaacctccccagatcggaagttaagtcttggagagtttccaaagtgctgaagtaaaaaggagacttggagggcctttgcttaatgagcaagaggcttgtgtcctcccaagaacatgagggagttcagaagggagctatagctcacagacagaaacctgcccgctcaccccatccctcgtgactgggagcatgtttgctcagaattttctaagaggactctcccttcaaaaatccaatttgctcccagaatgttgtttagcctctgagaatctcactctttcatttccatctgtgaatggacatagatgtgttgctcagggatcagaaacatcagagtccagggcccagtggcatggtgttgcattagtagttagaaaagtaattggtcagctctactgtaaaagaaataagtatgtagtacagttttgtaaatgtcaggtctgttctattgttttgtgatctgaagactgtcaaactggttgataatcaaagaaaaggttggttagaataagtaaaatttcagttagaaagatatagcttaccagttttccatgtgcttaaggaagtcaagaatatttcaggttgttgagaactgttgtaaaatggaattgaagctagtgtctctcaccttcttaggtgtatcagagagaggaagtggaaggccagtagtagcatcttcatacttacttttgccagcccagcctccatttcaaagactttgtcttccatcctatccaatgacatggtcagggatgggctctgaggaggcagtgaggccccaccttggtttgctccactgtggtgtgtagtctccaaacagcttaagggtttttaagttttctcacgattacctccactccactcatctactatcagcatcagaaaggttaacatccctgggaccattctacttataaaagagatgaactagtgtgctttctccccttttccaggtgtgccatccatatacaatctcctcttggccaagttcaacaaatgtttccagggaaccccgtgggttgaggcaaagtagccaagatgtattgagttaagtttttctagaggacaaaagtatttcttgtcccttttccctcatgctcatatgttttagctgaggcgtaaatggccaagttgagtaatatctgtggaactgagacagagagccagggacccatgtacccagggaccagtcccctggggaatcacacagtggctcagactagactgctctatcccaccagaactctgctgctgttcatttccatcaggaccacccaggaaagcaaataagttagccttctcatcattaggtcacctaatctcttgggttgcaggatgagagcatatatagatctcctgtttagagagtgtgttcataattgtagaaagggatagaaaatggaataaccaagaggctgtgtcattttttaagaggatggcaaggatgacctcaaatgagctcaacaaaactgggaatccaaggaatggtgcttgtagggaaagagaggtcagttgtggtccttaaacctcttggcaccttgtgcgggttataaaacaaggagctggagtaaaattgcccttacccccaatccaaatgctgtccaggatttaggagctacccaacctgtggttatatggtgttggtttccattttttgtttgtttgcttgtttccaaaatagccttgcttggtactgcatggaaagttcaagcttttcttcttgcccgctcagggctggcctcttccccgtgtcttcacagcgtccctaaggaagatttttgcagcactctctggagctgaggggagtgaaatttggtccagagaaggcggaaggaaatagttttcctgtttccttttctcgaggtggatgtcctcaggcttccttcacacctccttctcatgggtgcggctggcagtacagtcaggctgtggaggagggctgagaagaaaggggcactggtccagccccaggtttggtctgagacaggtacacagcagataccatcccaccttcctctctaaagaacaggccagccacacatataaccctttccctactttactaatgtatcccttatgtggtaccagcaatggaggacaggcagacttaccccctgccatctagagagaatgttgttattacccgtaaaacttgaccacccccatatcccactcctttttgtaaaaacaaatgcttaaacctgtgagcctgccgttcctttctatgtgttaatcagtttccttccatttgagctgtgtgggagggaagggcattgaaattgtaggttgtaatcttgtgccaaccgttagcaggggaggcctctagagtcga

SEQ ID NO: 313689 - DNA, 2743 bp, Homo sapiens
ttcaccccgtaataatgcccagaagacaaaatgaaacacggacagatggtcattatttatcacccctttgttttgctttggttactcagttcctgcagcataacagatatgacttatgccagggaaggtagaggctgattatggagacacccaggaacaggaataagaagggataggtctgctccacgtagaacctccccagatcggaagttaagtcttggagagtttccaaagtgctgaagtaaaaaggagacttggagggcctttgcttaatgagcaagaggcttgtgtcctcccaagaacatgagggagttcagaagggagctatagctcacagacagaaacctgcccgctcaccccatccctcgtgactgggagcatgtttgctcagaattttctaagaggactctcccttcaaaaatccaatttgctcccagaatgttgtttagcctctgagaatctcactctttcatttccatctgtgaatggacatagatgtgttgctcagggatcagaaacatcagagtccagggcccagtggcatggtgttgcattagtagttagaaaagtaattggtcagctctactgtaaaagaaataagtatgtagtacagttttgtaaatgtcaggtctgttctattgttttgtgatctgaagactgtcaaactggttgataatcaaagaaaaggttggttagaataagtaaaatttcagttagaaagatatagcttaccagttttccatgtgcttaaggaagtcaagaatatttcaggttgttgagaactgttgtaaaatggaattgaagctagtgtctctcaccttcttaggtgtatcagagagaggaagtggaaggccagtagtagcatcttcatacttacttttgccagcccagcctccatttcaaagactttgtcttccatcctatccaatgacatggtcagggatgggctctgaggaggcagtgaggccccaccttggtttgctccactgtggtgtgtagtctccaaacagcttaagggtttttaagttttctcacgattacctccactccactcatctactatcagcatcagaaaggttaacatccctgggaccattctacttataaaagagatgaactagtgtgctttctccccttttccaggtgtgccatccatatacaatctcctcttggccaagttcaacaaatgtttccagggaaccccgtgggttgaggcaaagtagccaagatgtattgagttaagtttttctagaggacaaaagtatttcttgtcccttttccctcatgctcatatgttttagctgaggcgtaaatggccaagttgagtaatatctgtggaactgagacagagagccagggacccatgtacccagggaccagtcccctggggaatcacacagtggctcagactagactgctctatcccaccagaactctgctgctgttcatttccatcaggaccacccaggaaagcaaataagttagccttctcatcattaggtcacctaatctcttgggttgcaggatgagagcatatatagatctcctgtttagagagtgtgttcataattgtagaaagggatagaaaatggaataaccaagaggctgtgtcattttttaagaggatggcaaggatgacctcaaatgagctcaacaaaactgggaatccaaggaatggtgcttgtagggaaagagaggtcagttgtggtccttaaacctcttggcaccttgtgcgggttataaaacaaggagctggagtaaaattgcccttacccccaatccaaatgctgtccaggatttaggagctacccaacctgtggttatatggtgttggtttccattttttgtttgtttgcttgtttccaaaatagccttgcttggtactgcatggaaagttcaagcttttcttcttgcccgctcagggctggcctcttccccgtgtcttcacagcgtccctaaggaagatttttgcagcactctctggagctgaggggagtgaaatttggtccagagaaggcggaaggaaatagttttcctgtttccttttctcgaggtggatgtcctcaggcttccttcacacctccttctcatgggtgcggctggcagtacagtcaggctgtggaggagggctgagaagaaaggggcactggtccagccccaggtttggtctgagacaggtacacagcagataccatcccaccttcctctctaaagaacaggccagccacacatataaccctttccctactttactaatgtatcccttatgtggtaccagcaatggaggacaggcagacttaccccctgccatctagagagaatgttgttattacccgtaaaacttgaccacccccatatcccactcctttttgtaaaaacaaatgcttaaacctgtgagcctgccgttcctttctatgtgttaatcagtttccttccatttgagctgtgtgggagggaagggcattgaaattgtaggttgtaatcttgtgccaaccaataaaaaccagtatttcacacacaaaaaaaaaaaaaaaaaaaaaaaaaaaaaaaaaaaaaaacccggggggctctttttctgcgggggcgggggaaaaggaggtttgagagaaggggcaggggccaaagggggttcccgggacccgagtttttttgggcaacaggggggagaaaccggggggccccccaaggggggggggggaaaaatcggaaaaacccggggttcccggtagatgttcggtcgaac

SEQ ID NO: 313690 - DNA, 5952 bp, Homo sapiens
cttagtttacatcctctcccccaatcttcacacacagagccaaagagcagttatattcttgggataccatgatacctctgggaaaggaattatattcccaaggagaggtcccattggataagaacaataccatgggacttgagtctgaatgccaacttactattcacacatccttcttaaaaacgaacacactgtttcttttcctgacctagagcattctaaagttctgttcaaataaataaagggcaaaataaagtagatttaaccaagtgccaggtggaattcaaaaaacacattcttccagataaattctacctttatggtatggatttgaaagtactttgcaggaaaacagtcagtactctttaaaaagggactgcagggctgggtgtagtggctcacacctgtaatcccagcactttgggaggccaaggcaggtgggtcacttgaggccaggagtttgagaccagcctgaccaacatggcaaaaccccatctctactaaaatacaaaaattagctgggcatgatggtgcactcctgtaatcccagctacttggtaggctgaagcatgagaattgcttaaacctgggaggcagaggttgcagtaagccaagatcatgccactgcattccagcctgggcaacagagtaagactctgtcttaataaataaataagaaaataaaacggaactgcagtgctaacagtaatttatacatttttaaatgttctgagtatgttttgactgggctagtgtaacaatatactaccctgaaagtgcagttttgattgttgttggtgtctttgggtcaggaaagtgaactgtgccaagaagtatttttcagtgacatgaatggattcctgttaatgcaattgactgagagattgtgcttacgctttcttaactgacaaaaagaggctttgtccaacatcagaattgttgaaactggtgctgttttctgttgcactgggattctgatgatctgggattttccctccttggcacagtaaacaccatgactgtctttattgagaatgtcgtcacagtcctttagtgatagattagttagacccatggttgcaatacctttatctccccaaagaaaataatcaaaagaaagcacaaaagctaccctgtttgcagaatatttcactgacattgatttgtcattaattctaccagagctgacctcattcaggcttgatagaaacaggttcctatgtttagggcagatccctagcctctcgctcacagtgagtctgcatgtcctagattctggttattgctggagcatccattaaagtctaccaaactcaggacagaagaagatagcagtggatttgtaaaaatttttagtttataaattacagtcattggggaaacactagtaaggtcatgtgatcttttggaccaggattttctctctgtcttctctctgggtgtgtgtgtgtgtatgtacagaagggctaccaggaagtgtcaaccatgttagattttctgtagtcttccagaaacagtgcagcccatacaacaggaatcttaattttcctcacagcaaatataacaggatggaacagttagtgttttgttttcacaagtgtccaccactccatctgccctgcatggagagggctctctcactgctagatctaggctgagccatctggaaggatcaaagggtgtgggagtatcaccccctctcaggctgcagaaggtctcgagggtggcgtcacagcaggatttccgccttctgcattgcactgcacagccccatggaacatgaggcacttgaggccttgcttcttggagcctctggggagcagagtaggtcactgccctctgggagtgttttgcagtagttttgtaaatgtgttgctacatagtcaagttcctttgtggcaaagaaatattttgttttgatattaggagccagcccatgtaatgcctctcaggcttgcttgcttagaagaaaaaagtcaccctttgtggtttttaagaaaaaaattctgtgcagatctgttcctcctcctgctccttcccttttctctacatacagtgctcattggaggctcctgctaaaccttcttaaccagagaaataataggtatttgttagacctgagtgtacatttcacatgttatccttcacatatttctcattttcatctagtactttcttaatgcctttgttggagtccgcatcctcatctttaaaaaaaaaaaaaaaaaacagcttagcctaagccacattcactttttttagttcacaaaaaggatttaatagccacaatgtgatttttgccacaactgtgtgattttaatattctctaatatcaagggcggatttagaattgcaggaaatacctggagaaatcacagtggaatgaatttttgctttaagagaaatgagagttggctgtctctgtaattgataatacagcttcatcctagtcccatctgcatttcagaaaataaccctcatctttacaaaacacaggacacttgtgggacagttaactcaagcagctatggggagggaggagattattgaatggtgattaaataatgcaaatggctcttctgtttcttaaagactgtggaagaggtcagactgcccagttgaggtgggcagttcatactgctcagttgaggtggcagtcatttattctgagtcctgttggatagagcctatctcctcaaggctacagaggcttccaggatatggagctgtgcatgttaatggctcagccttgcctccatcagggcacctgcctaacttggagcaagtgggagagcaccctagagtcatcctctgtgctgtttcgtgagttttgcagcggagacttcaccatccggaggagctgtgtttctgtgtcacttgggatatcacctaaaaatgaaacatttgatattttaaggtataaaaaaaaagtaaattggggaacattggctgcagtccctaaaagatactgttgtctgtgcatcaggttagcttgaggtcaccacaggtcctgggagcccagagagtttaggcatactctcctttggaggccagcagcctttcacaaaccctgcctctaaaagggcggtttcacatttgaccatgtttttgcattagcctcagaaactcttgtctttagctgataacctttgagggatgtgagaagcctagttggagcatctgagaaaatgatacctctcaccttcaaattaatcaaatagtttgtccttctagtccccttataaattaataaatggagggctggtcatggtggctcacgcctgtaatcccagcactttgggaggccgaggcgggtggatcacaaggtcaggagttcaagaccagcctgaccaatatggtgaaaccccatctctactaaaaatacaaaaattagccaggtgtagtggcacgctcctgtagtcccagctactcgggaggctgaggcaggagaatcgcttgaacccaggaggtggatgttgcagtgagccgagatcccgccactgcactgcagcctaggcgacagagcaagactccgtctcaaaaaaaaaaaaagaaaaaaaaagaaaagggaagggaatcccattttgtgatgatttgggcacactacttgagctgaggctagcagtcacatgattttggctgtctctgacctgaagcttttgaagtaaggttatgtctcttccctgaagctttgtttatagtggtaatttggtgagtttgagctttgagcttgtcttagaaaataagactgtccacctggggaggggagcttatagggaacccgtgttaactcagaatgctgaagaaagtgcttttagccaacaaaagtaagattactatctagaaggtggaaagaagtcattgcttctgttcctccagcagtcagttgactctaggtttcctttggtttatatccccagttcttaatactaaaacttatttgacttcctatcaggaagcacacaaaaaaagcgtcatttaaaaccctggatataggctttaaaggatacaaaaacagcagcattgtcgttttgccaggttcatcaccattttgatgtgctacccatccttccaccctccctttcctgcccccaagcctcccagccaggccagatgtgaagattctattaatcactgtttcagagaacattaattcttgtatagaataattatctactaaattgcttattatctgtgactaccttgcagagaacatctcaacagtgcagtaaaatagctctcctagacttgagcttccagccaggcatttagatcactcttaagcctttgtggaattctgaggaaaaaaagcaagatgcctcaatgccaatgctgggccataagattctactcccctccctgtagggtggggcgcgtggctcagctttggaaaatcattttgccagtaatattgcctgtgaatccctttaagaagtcgtcctgatctgagcctgtctttctgagcactttggtgctgaattgaaaatggtaagctaaagcagtgacagatccacgtagcctctttaacctctttattatcttgccaaaaaaaaagtttctcaggttaaacctttgtctttaacctccctttgttgtggagaaaatgtgtcactaatcagtggtccaagggatatctagctttggttactcagttcctgcagcataacagatatgacttatgccagggaaggtagaggctgattatggagacacccaggaacaggaataagaagggataggtctgctccacgtagaacctccccagatcggaagttaagtcttggagagtttccaaagtgctgaagtaaaaaggagacttggagggcctttgcttaatgagcaagaggcttgtgtcctcccaagaacatgagggagttcagaagggagctatagctcacagacagaaacctgcccgctcaccccatccctcgtgactgggagcatgtttgctcagaattttctaagaggactctcccttcaaaaatccaatttgctcccagaatgttgtttagcctctgagaatctcactctttcatttccatctgtgaatggacatagatgtgttgctcagggatcagaaacatcagagtccagggcccagtggcatggtgttgcattagtagttagaaaagtaattggtcagctctactgtaaaagaaataagtatgtagtacagttttgtaaatgtcaggtctgttctattgttttgtgatctgaagactgtcaaactggttgataatcaaagaaaaggttggttagaataagtaaaatttcagttagaaagatatagcttaccagttttccatgtgcttaaggaagtcaagaatatttcaggttgttgagaacaaaggggcactggtccagccccaggtttggtctgagacaggtacacagcagataccatcccaccttcctctctaaagaacaggccagccacacatataaccctttccctactttactaatgtatcccttatgtggtaccagcaatggaggacaggcagacttaccccctgccatctagagagaatgttgttattacccgtaaaacttgaccacccccatatcccactcctttttgtaaaaacaaatgcttaaacctgtgagcctgccgttcctttctatgtgttaatcagtttccttccatttgagctgtgtgggagggaagggcattgaaattgtaggttgtaatcttgtgccaaccaataaaaaccagtatttcacacacaaaaaaaaaaaaaaaaaaaaaaaaaaaaaaaaaaaaaaacccggggggctctttttctgcgggggcgggggaaaaggaggtttgagagaaggggcaggggccaaagggggttcccgggacccgagtttttttgggcaacaggggggagaaaccggggggccccccaaggggggggggggaaaaatcggaaaaacccggggttcccggtagatgttcggtcgaac

SEQ ID NO: 313691 - DNA, 6491 bp, Homo sapiens
  misc_feature (6340)..(6340): n is a, c, g, or t
  misc_feature (6398)..(6398): n is a, c, g, or t
  misc_feature (6438)..(6438): n is a, c, g, or t
cttagtttacatcctctcccccaatcttcacacacagagccaaagagcagttatattcttgggataccatgatacctctgggaaaggaattatattcccaaggagaggtcccattggataagaacaataccatgggacttgagtctgaatgccaacttactattcacacatccttcttaaaaacgaacacactgtttcttttcctgacctagagcattctaaagttctgttcaaataaataaagggcaaaataaagtagatttaaccaagtgccaggtggaattcaaaaaacacattcttccagataaattctacctttatggtatggatttgaaagtactttgcaggaaaacagtcagtactctttaaaaagggactgcagggctgggtgtagtggctcacacctgtaatcccagcactttgggaggccaaggcaggtgggtcacttgaggccaggagtttgagaccagcctgaccaacatggcaaaaccccatctctactaaaatacaaaaattagctgggcatgatggtgcactcctgtaatcccagctacttggtaggctgaagcatgagaattgcttaaacctgggaggcagaggttgcagtaagccaagatcatgccactgcattccagcctgggcaacagagtaagactctgtcttaataaataaataagaaaataaaacggaactgcagtgctaacagtaatttatacatttttaaatgttctgagtatgttttgactgggctagtgtaacaatatactaccctgaaagtgcagttttgattgttgttggtgtctttgggtcaggaaagtgaactgtgccaagaagtatttttcagtgacatgaatggattcctgttaatgcaattgactgagagattgtgcttacgctttcttaactgacaaaaagaggctttgtccaacatcagaattgttgaaactggtgctgttttctgttgcactgggattctgatgatctgggattttccctccttggcacagtaaacaccatgactgtctttattgagaatgtcgtcacagtcctttagtgatagattagttagacccatggttgcaatacctttatctccccaaagaaaataatcaaaagaaagcacaaaagctaccctgtttgcagaatatttcactgacattgatttgtcattaattctaccagagctgacctcattcaggcttgatagaaacaggttcctatgtttagggcagatccctagcctctcgctcacagtgagtctgcatgtcctagattctggttattgctggagcatccattaaagtctaccaaactcaggacagaagaagatagcagtggatttgtaaaaatttttagtttataaattacagtcattggggaaacactagtaaggtcatgtgatcttttggaccaggattttctctctgtcttctctctgggtgtgtgtgtgtgtatgtacagaagggctaccaggaagtgtcaaccatgttagattttctgtagtcttccagaaacagtgcagcccatacaacaggaatcttaattttcctcacagcaaatataacaggatggaacagttagtgttttgttttcacaagtgtccaccactccatctgccctgcatggagagggctctctcactgctagatctaggctgagccatctggaaggatcaaagggtgtgggagtatcaccccctctcaggctgcagaaggtctcgagggtggcgtcacagcaggatttccgccttctgcattgcactgcacagccccatggaacatgaggcacttgaggccttgcttcttggagcctctggggagcagagtaggtcactgccctctgggagtgttttgcagtagttttgtaaatgtgttgctacatagtcaagttcctttgtggcaaagaaatattttgttttgatattaggagccagcccatgtaatgcctctcaggcttgcttgcttagaagaaaaaagtcaccctttgtggtttttaagaaaaaaattctgtgcagatctgttcctcctcctgctccttcccttttctctacatacagtgctcattggaggctcctgctaaaccttcttaaccagagaaataataggtatttgttagacctgagtgtacatttcacatgttatccttcacatatttctcattttcatctagtactttcttaatgcctttgttggagtccgcatcctcatctttaaaaaaaaaaaaaaaaaacagcttagcctaagccacattcactttttttagttcacaaaaaggatttaatagccacaatgtgatttttgccacaactgtgtgattttaatattctctaatatcaagggcggatttagaattgcaggaaatacctggagaaatcacagtggaatgaatttttgctttaagagaaatgagagttggctgtctctgtaattgataatacagcttcatcctagtcccatctgcatttcagaaaataaccctcatctttacaaaacacaggacacttgtgggacagttaactcaagcagctatggggagggaggagattattgaatggtgattaaataatgcaaatggctcttctgtttcttaaagactgtggaagaggtcagactgcccagttgaggtgggcagttcatactgctcagttgaggtggcagtcatttattctgagtcctgttggatagagcctatctcctcaaggctacagaggcttccaggatatggagctgtgcatgttaatggctcagccttgcctccatcagggcacctgcctaacttggagcaagtgggagagcaccctagagtcatcctctgtgctgtttcgtgagttttgcagcggagacttcaccatccggaggagctgtgtttctgtgtcacttgggatatcacctaaaaatgaaacatttgatattttaaggtataaaaaaaaagtaaattggggaacattggctgcagtccctaaaagatactgttgtctgtgcatcaggttagcttgaggtcaccacaggtcctgggagcccagagagtttaggcatactctcctttggaggccagcagcctttcacaaaccctgcctctaaaagggcggtttcacatttgaccatgtttttgcattagcctcagaaactcttgtctttagctgataacctttgagggatgtgagaagcctagttggagcatctgagaaaatgatacctctcaccttcaaattaatcaaatagtttgtccttctagtccccttataaattaataaatggagggctggtcatggtggctcacgcctgtaatcccagcactttgggaggccgaggcgggtggatcacaaggtcaggagttcaagaccagcctgaccaatatggtgaaaccccatctctactaaaaatacaaaaattagccaggtgtagtggcacgctcctgtagtcccagctactcgggaggctgaggcaggagaatcgcttgaacccaggaggtggatgttgcagtgagccgagatcccgccactgcactgcagcctaggcgacagagcaagactccgtctcaaaaaaaaaaaaagaaaaaaaaagaaaagggaagggaatcccattttgtgatgatttgggcacactacttgagctgaggctagcagtcacatgattttggctgtctctgacctgaagcttttgaagtaaggttatgtctcttccctgaagctttgtttatagtggtaatttggtgagtttgagctttgagcttgtcttagaaaataagactgtccacctggggaggggagcttatagggaacccgtgttaactcagaatgctgaagaaagtgcttttagccaacaaaagtaagattactatctagaaggtggaaagaagtcattgcttctgttcctccagcagtcagttgactctaggtttcctttggtttatatccccagttcttaatactaaaacttatttgacttcctatcaggaagcacacaaaaaaagcgtcatttaaaaccctggatataggctttaaaggatacaaaaacagcagcattgtcgttttgccaggttcatcaccattttgatgtgctacccatccttccaccctccctttcctgcccccaagcctcccagccaggccagatgtgaagattctattaatcactgtttcagagaacattaattcttgtatagaataattatctactaaattgcttattatctgtgactaccttgcagagaacatctcaacagtgcagtaaaatagctctcctagacttgagcttccagccaggcatttagatcactcttaagcctttgtggaattctgaggaaaaaaagcaagatgcctcaatgccaatgctgggccataagattctactcccctccctgtagggtggggcgcgtggctcagctttggaaaatcattttgccagtaatattgcctgtgaatccctttaagaagtcgtcctgatctgagcctgtctttctgagcactttggtgctgaattgaaaatggtaagctaaagcagtgacagatccacgtagcctctttaacctctttattatcttgccaaaaaaaaagtttctcaggttaaacctttgtctttaacctccctttgttgtggagaaaatgtgtcactaatcagtggtccaagggatatctagctttggttactcagttcctgcagcataacagatatgacttatgccagggaaggtagaggctgattatggagacacccaggaacaggaataagaagggataggtctgctccacgtagaacctccccagatcggaagttaagtcttggagagtttccaaagtgctgaagtaaaaaggagacttggagggcctttgcttaatgagcaagaggcttgtgtcctcccaagaacatgagggagttcagaagggagctatagctcacagacagaaacctgcccgctcaccccatccctcgtgactgggagcatgtttgctcagaattttctaagaggactctcccttcaaaaatccaatttgctcccagaatgttgtttagcctctgagaatctcactctttcatttccatctgtgaatggacatagatgtgttgctcagggatcagaaacatcagagtccagggcccagtggcatggtgttgcattagtagttagaaaagtaattggtcagctctactgtaaaagaaataagtatgtagtacagttttgtaaatgtcaggtctgttctattgttttgtgatctgaagactgtcaaactggttgataatcaaagaaaaggttggttagaataagtaaaatttcagttagaaagatatagcttaccagttttccatgtgcttaaggaagtcaagaatatttcaggttgttgagaactgttgtaaaatggaattgaagctagtgtctctcaccttcttaggtgtatcagagagaggaagtggaaggccagtagtagcatcttcatacttacttttgccagcccagcctccatttcaaagactttgtcttccatcctatccaatgacatggtcagggatgggctctgaggaggcagtgaggccccaccttggtttgctccactgtggtgtgtagtctccaaacagcttaagggtttttaagttttctcacgattacctccactccactcatctactatcagcatcagaaaggttaacatccctgggaccattctacttataaaagagatgaactagtgtgctttctccccttttccaggtgtgccatccatatacaatctcctcttggccaagttcaacaaatgtttccagggaaccccgtgggttgaggcaaagtagccaagatgtattgagttaagtttttctagaggacaaaagtatttcttgtcccttttccctcatgctcatatgttttagctgaggcgtaaatggccaagttgagtaatatctgtggaactgagacagagagccagggacccatgtacccagggaccagtcccctggggaatcacacagtggctcagactagactgctctatcccaccagaactctgctgctgttcatttccatcaggaccacccaggaaagcaaataagttagccttctcatcattaggtcacctaatctcttgggttgcaggatgagagcatatatagatctcctgtttagagagtgtgttcataattgtagaaagggatagaaaatggaataaccaagaggctgtgtcattttttaagaggatggcaaggatgacctcaaatgagctcaacaaaactgggaatccaaggaatggtgcttgtagggaaagagaggtcagttgtggtccttaaacctcttggcaccttgtgcgggttataaaacaaggagctggagtcctgtggggtatatgtgngggtttccattttttgcttgattgcttgtttccacaatagccttcattgatactggcncctctgttcaagcctttccttcctgcccgctcccagcccnccctttcgcccggttctgcacatcgcccccttaaggtggactcccgccaacat

SEQ ID NO: 313692 - DNA, 5872 bp, Homo sapiens
cttagtttacatcctctcccccaatcttcacacacagagccaaagagcagttatattcttgggataccatgatacctctgggaaaggaattatattcccaaggagaggtcccattggataagaacaataccatgggacttgagtctgaatgccaacttactattcacacatccttcttaaaaacgaacacactgtttcttttcctgacctagagcattctaaagttctgttcaaataaataaagggcaaaataaagtagatttaaccaagtgccaggtggaattcaaaaaacacattcttccagataaattctacctttatggtatggatttgaaagtactttgcaggaaaacagtcagtactctttaaaaagggactgcagggctgggtgtagtggctcacacctgtaatcccagcactttgggaggccaaggcaggtgggtcacttgaggccaggagtttgagaccagcctgaccaacatggcaaaaccccatctctactaaaatacaaaaattagctgggcatgatggtgcactcctgtaatcccagctacttggtaggctgaagcatgagaattgcttaaacctgggaggcagaggttgcagtaagccaagatcatgccactgcattccagcctgggcaacagagtaagactctgtcttaataaataaataagaaaataaaacggaactgcagtgctaacagtaatttatacatttttaaatgttctgagtatgttttgactgggctagtgtaacaatatactaccctgaaagtgcagttttgattgttgttggtgtctttgggtcaggaaagtgaactgtgccaagaagtatttttcagtgacatgaatggattcctgttaatgcaattgactgagagattgtgcttacgctttcttaactgacaaaaagaggctttgtccaacatcagaattgttgaaactggtgctgttttctgttgcactgggattctgatgatctgggattttccctccttggcacagtaaacaccatgactgtctttattgagaatgtcgtcacagtcctttagtgatagattagttagacccatggttgcaatacctttatctccccaaagaaaataatcaaaagaaagcacaaaagctaccctgtttgcagaatatttcactgacattgatttgtcattaattctaccagagctgacctcattcaggcttgatagaaacaggttcctatgtttagggcagatccctagcctctcgctcacagtgagtctgcatgtcctagattctggttattgctggagcatccattaaagtctaccaaactcaggacagaagaagatagcagtggatttgtaaaaatttttagtttataaattacagtcattggggaaacactagtaaggtcatgtgatcttttggaccaggattttctctctgtcttctctctgggtgtgtgtgtgtgtatgtacagaagggctaccaggaagtgtcaaccatgttagattttctgtagtcttccagaaacagtgcagcccatacaacaggaatcttaattttcctcacagcaaatataacaggatggaacagttagtgttttgttttcacaagtgtccaccactccatctgccctgcatggagagggctctctcactgctagatctaggctgagccatctggaaggatcaaagggtgtgggagtatcaccccctctcaggctgcagaaggtctcgagggtggcgtcacagcaggatttccgccttctgcattgcactgcacagccccatggaacatgaggcacttgaggccttgcttcttggagcctctggggagcagagtaggtcactgccctctgggagtgttttgcagtagttttgtaaatgtgttgctacatagtcaagttcctttgtggcaaagaaatattttgttttgatattaggagccagcccatgtaatgcctctcaggcttgcttgcttagaagaaaaaagtcaccctttgtggtttttaagaaaaaaattctgtgcagatctgttcctcctcctgctccttcccttttctctacatacagtgctcattggaggctcctgctaaaccttcttaaccagagaaataataggtatttgttagacctgagtgtacatttcacatgttatccttcacatatttctcattttcatctagtactttcttaatgcctttgttggagtccgcatcctcatctttaaaaaaaaaaaaaaaaaacagcttagcctaagccacattcactttttttagttcacaaaaaggatttaatagccacaatgtgatttttgccacaactgtgtgattttaatattctctaatatcaagggcggatttagaattgcaggaaatacctggagaaatcacagtggaatgaatttttgctttaagagaaatgagagttggctgtctctgtaattgataatacagcttcatcctagtcccatctgcatttcagaaaataaccctcatctttacaaaacacaggacacttgtgggacagttaactcaagcagctatggggagggaggagattattgaatggtgattaaataatgcaaatggctcttctgtttcttaaagactgtggaagaggtcagactgcccagttgaggtgggcagttcatactgctcagttgaggtggcagtcatttattctgagtcctgttggatagagcctatctcctcaaggctacagaggcttccaggatatggagctgtgcatgttaatggctcagccttgcctccatcagggcacctgcctaacttggagcaagtgggagagcaccctagagtcatcctctgtgctgtttcgtgagttttgcagcggagacttcaccatccggaggagctgtgtttctgtgtcacttgggatatcacctaaaaatgaaacatttgatattttaaggtataaaaaaaaagtaaattggggaacattggctgcagtccctaaaagatactgttgtctgtgcatcaggttagcttgaggtcaccacaggtcctgggagcccagagagtttaggcatactctcctttggaggccagcagcctttcacaaaccctgcctctaaaagggcggtttcacatttgaccatgtttttgcattagcctcagaaactcttgtctttagctgataacctttgagggatgtgagaagcctagttggagcatctgagaaaatgatacctctcaccttcaaattaatcaaatagtttgtccttctagtccccttataaattaataaatggagggctggtcatggtggctcacgcctgtaatcccagcactttgggaggccgaggcgggtggatcacaaggtcaggagttcaagaccagcctgaccaatatggtgaaaccccatctctactaaaaatacaaaaattagccaggtgtagtggcacgctcctgtagtcccagctactcgggaggctgaggcaggagaatcgcttgaacccaggaggtggatgttgcagtgagccgagatcccgccactgcactgcagcctaggcgacagagcaagactccgtctcaaaaaaaaaaaaagaaaaaaaaagaaaagggaagggaatcccattttgtgatgatttgggcacactacttgagctgaggctagcagtcacatgattttggctgtctctgacctgaagcttttgaagtaaggttatgtctcttccctgaagctttgtttatagtggtaatttggtgagtttgagctttgagcttgtcttagaaaataagactgtccacctggggaggggagcttatagggaacccgtgttaactcagaatgctgaagaaagtgcttttagccaacaaaagtaagattactatctagaaggtggaaagaagtcattgcttctgttcctccagcagtcagttgactctaggtttcctttggtttatatccccagttcttaatactaaaacttatttgacttcctatcaggaagcacacaaaaaaagcgtcatttaaaaccctggatataggctttaaaggatacaaaaacagcagcattgtcgttttgccaggttcatcaccattttgatgtgctacccatccttccaccctccctttcctgcccccaagcctcccagccaggccagatgtgaagattctattaatcactgtttcagagaacattaattcttgtatagaataattatctactaaattgcttattatctgtgactaccttgcagagaacatctcaacagtgcagtaaaatagctctcctagacttgagcttccagccaggcatttagatcactcttaagcctttgtggaattctgaggaaaaaaagcaagatgcctcaatgccaatgctgggccataagattctactcccctccctgtagggtggggcgcgtggctcagctttggaaaatcattttgccagtaatattgcctgtgaatccctttaagaagtcgtcctgatctgagcctgtctttctgagcactttggtgctgaattgaaaatggtaagctaaagcagtgacagatccacgtagcctctttaacctctttattatcttgccaaaaaaaaagtttctcaggttaaacctttgtctttaacctccctttgttgtggagaaaatgtgtcactaatcagtggtccaagggatatctagctttggttactcagttcctgcagcataacagatatgacttatgccagggaaggtagaggctgattatggagacacccaggaacaggaataagaagggataggtctgctccacgtagaacctccccagatcggaagttaagtcttggagagtttccaaagtgctgaagtaaaaaggagacttggagggcctttgcttaatgagcaagaggcttgtgtcctcccaagaacatgagggagttcagaagggagctatagctcacagacagaaacctgcccgctcaccccatccctcgtgactgggagcatgtttgctcagaattttctaagaggactctcccttcaaaaatccaatttgctcccagaatgttgtttagcctctgagaatctcactctttcatttccatctgtgaatggacatagatgtgttgctcagggatcagaaacatcagagtccagggcccagtggcatggtgttgcattagtagttagaaaagtaattggtcagctctactgtaaaagaaataagtatgtagtacagttttgtaaatgtcaggtctgttctattgttttgtgatctgaagactgtcaaactggttgataatcaaagaaaaggttggttagaataagtaaaatttcagttagaaagatatagcttaccagttttccatgtgcttaaggaagtcaagaatatttcaggttgttgagaacaggccagccacacatataaccctttccctactttactaatgtatcccttatgtggtaccagcaatggaggacaggcagacttaccccctgccatctagagagaatgttgttattacccgtaaaacttgaccacccccatatcccactcctttttgtaaaaacaaatgcttaaacctgtgagcctgccgttcctttctatgtgttaatcagtttccttccatttgagctgtgtgggagggaagggcattgaaattgtaggttgtaatcttgtgccaaccaataaaaaccagtatttcacacacaaaaaaaaaaaaaaaaaaaaaaaaaaaaaaaaaaaaaaacccggggggctctttttctgcgggggcgggggaaaaggaggtttgagagaaggggcaggggccaaagggggttcccgggacccgagtttttttgggcaacaggggggagaaaccggggggccccccaaggggggggggggaaaaatcggaaaaacccggggttcccggtagatgttcggtcgaac

SEQ ID NO: 313693 - DNA, 4178 bp, Homo sapiens
  misc_feature (3866)..(3866): n is a, c, g, or t
  misc_feature (3876)..(3876): n is a, c, g, or t
  misc_feature (3879)..(3879): n is a, c, g, or t
  misc_feature (3906)..(3906): n is a, c, g, or t
cttagtttacatcctctcccccaatcttcacacacagagccaaagagcagttatattcttgggataccatgatacctctgggaaaggaattatattcccaaggagaggtcccattggataagaacaataccatgggacttgagtctgaatgccaacttactattcacacatccttcttaaaaacgaacacactgtttcttttcctgacctagagcattctaaagttctgttcaaataaataaagggcaaaataaagtagatttaaccaagtgccaggtggaattcaaaaaacacattcttccagataaattctacctttatggtatggatttgaaagtactttgcaggaaaacagtcagtactctttaaaaagggactgcagggctgggtgtagtggctcacacctgtaatcccagcactttgggaggccaaggcaggtgggtcacttgaggccaggagtttgagaccagcctgaccaacatggcaaaaccccatctctactaaaatacaaaaattagctgggcatgatggtgcactcctgtaatcccagctacttggtaggctgaagcatgagaattgcttaaacctgggaggcagaggttgcagtaagccaagatcatgccactgcattccagcctgggcaacagagtaagactctgtcttaataaataaataagaaaataaaacggaactgcagtgctaacagtaatttatacatttttaaatgttctgagtatgttttgactgggctagtgtaacaatatactaccctgaaagtgcagttttgattgttgttggtgtctttgggtcaggaaagtgaactgtgccaagaagtatttttcagtgacatgaatggattcctgttaatgcaattgactgagagattgtgcttacgctttcttaactgacaaaaagaggctttgtccaacatcagaattgttgaaactggtgctgttttctgttgcactgggattctgatgatctgggattttccctccttggcacagtaaacaccatgactgtctttattgagaatgtcgtcacagtcctttagtgatagattagttagacccatggttgcaatacctttatctccccaaagaaaataatcaaaagaaagcacaaaagctaccctgtttgcagaatatttcactgacattgatttgtcattaattctaccagagctgacctcattcaggcttgatagaaacaggttcctatgtttagggcagatccctagcctctcgctcacagtgagtctgcatgtcctagattctggttattgctggagcatccattaaagtctaccaaactcaggacagaagaagatagcagtggatttgtaaaaatttttagtttataaattacagtcattggggaaacactagtaaggtcatgtgatcttttggaccaggattttctctctgtcttctctctgggtgtgtgtgtgtgtatgtacagaagggctaccaggaagtgtcaaccatgttagattttctgtagtcttccagaaacagtgcagcccatacaacaggaatcttaattttcctcacagcaaatataacaggatggaacagttagtgttttgttttcacaagtgtccaccactccatctgccctgcatggagagggctctctcactgctagatctaggctgagccatctggaaggatcaaagggtgtgggagtatcaccccctctcaggctgcagaaggtctcgagggtggcgtcacagcaggatttccgccttctgcattgcactgcacagccccatggaacatgaggcacttgaggccttgcttcttggagcctctggggagcagagtaggtcactgccctctgggagtgttttgcagtagttttgtaaatgtgttgctacatagtcaagttcctttgtggcaaagaaatattttgttttgatattaggagccagcccatgtaatgcctctcaggcttgcttgcttagaagaaaaaagtcaccctttgtggtttttaagaaaaaaattctgtgcagatctgttcctcctcctgctccttcccttttctctacatacagtgctcattggaggctcctgctaaaccttcttaaccagagaaataataggtatttgttagacctgagtgtacatttcacatgttatccttcacatatttctcattttcatctagtactttcttaatgcctttgttggagtccgcatcctcatctttaaaaaaaaaaaaaaaaaacagcttagcctaagccacattcactttttttagttcacaaaaaggatttaatagccacaatgtgatttttgccacaactgtgtgattttaatattctctaatatcaagggcggatttagaattgcaggaaatacctggagaaatcacagtggaatgaatttttgctttaagagaaatgagagttggctgtctctgtaattgataatacagcttcatcctagtcccatctgcatttcagaaaataaccctcatctttacaaaacacaggacacttgtgggacagttaactcaagcagctatggggagggaggagattattgaatggtgattaaataatgcaaatggctcttctgtttcttaaagactgtggaagaggtcagactgcccagttgaggtgggcagttcatactgctcagttgaggtggcagtcatttattctgagtcctgttggatagagcctatctcctcaaggctacagaggcttccaggatatggagctgtgcatgttaatggctcagccttgcctccatcagggcacctgcctaacttggagcaagtgggagagcaccctagagtcatcctctgtgctgtttcgtgagttttgcagcggagacttcaccatccggaggagctgtgtttctgtgtcacttgggatatcacctaaaaatgaaacatttgatattttaaggtataaaaaaaaagtaaattggggaacattggctgcagtccctaaaagatactgttgtctgtgcatcaggttagcttgaggtcaccacaggtcctgggagcccagagagtttaggcatactctcctttggaggccagcagcctttcacaaaccctgcctctaaaagggcggtttcacatttgaccatgtttttgcattagcctcagaaactcttgtctttagctgataacctttgagggatgtgagaagcctagttggagcatctgagaaaatgatacctctcaccttcaaattaatcaaatagtttgtccttctagtccccttataaattaataaatggagggctggtcatggtggctcacgcctgtaatcccagcactttgggaggccgaggcgggtggatcacaaggtcaggagttcaagaccagcctgaccaatatggtgaaaccccatctctactaaaaatacaaaaattagccaggtgtagtggcacgctcctgtagtcccagctactcgggaggctgaggcaggagaatcgcttgaacccaggaggtggatgttgcagtgagccgagatcccgccactgcactgcagcctaggcgacagagcaagactccgtctcaaaaaaaaaaaaagaaaaaaaaacggaactgcagtgctaacagtaatttatacatttttaaatgttctgagtatgttttgactgggctagtgtaacaatatactaccctgaaagtgcagttttgattgttgttggtgtctttgggtcaggaaagtgaactgtgccaagaagtatttttcagtgacatgaatggattcctgttaatgcaattgactgagagattgtgcttacgctttcttaactgacaaaaagaggctttgtccaacatcagaattgttgaaactggtgctgttttctgttgcactgggattctgatgatctgggatnttccctcctnggncacagtaaacaccatgactgtctttantgagaatgtcgtcacagtcctttagtgatagattagttagacccatggttgcaatacctttatctccccaaagaaaataatcaaaagaaagcacaaaagctaccctgtttgcagaatatttcactgacattgacctgtcattaattctaccagagctgacctcattcaggcttgatagatacaggttcctatgtttagggcagatccctagcctctcgctcacagtgagtctgcatgtcctagattctggttattggtgggagcatctggtg

SEQ ID NO: 313694 - DNA, 2945 bp, Homo sapiens
cttagtttacatcctctcccccaatcttcacacacagagccaaagagcagttatattcttgggataccatgatacctctgggaaaggaattatattcccaaggagaggtcccattggataagaacaataccatgggacttgagtctgaatgccaacttactattcacacatccttcttaaaaacgaacacactgtttcttttcctgacctagagcattctaaagttctgttcaaataaataaagggcaaaataaagtagatttaaccaagtgccaggtggaattcaaaaaacacattcttccagataaattctacctttatggtatggatttgaaagtactttgcaggaaaacagtcagtactctttaaaaagggactgcagggctgggtgtagtggctcacacctgtaatcccagcactttgggaggccaaggcaggtgggtcacttgaggccaggagtttgagaccagcctgaccaacatggcaaaaccccatctctactaaaatacaaaaattagctgggcatgatggtgcactcctgtaatcccagctacttggtaggctgaagcatgagaattgcttaaacctgggaggcagaggttgcagtaagccaagatcatgccactgcattccagcctgggcaacagagtaagactctgtcttaataaataaataagaaaataaaacggaactgcagtgctaacagtaatttatacatttttaaatgttctgagtatgttttgactgggctagtgtaacaatatactaccctgaaagtgcagttttgattgttgttggtgtctttgggtcaggaaagtgaactgtgccaagaagtatttttcagtgacatgaatggattcctgttaatgcaattgactgagagattgtgcttacgctttcttaactgacaaaaagaggctttgtccaacatcagaattgttgaaactggtgctgttttctgttgcactgggattctgatgatctgggattttccctccttggcacagtaaacaccatgactgtctttattgagaatgtcgtcacagtcctttagtgatagattagttagacccatggttgcaatacctttatctccccaaagaaaataatcaaaagaaagcacaaaagctaccctgtttgcagaatatttcactgacattgatttgtcattaattctaccagagctgacctcattcaggcttgatagaaacaggttcctatgtttagggcagatccctagcctctcgctcacagtgagtctgcatgtcctagattctggttattgctggagcatccattaaagtctaccaaactcaggacagaagaagatagcagtggatttgtaaaaatttttagtttataaattacagtcattggggaaacactagtaaggtcatgtgatcttttggaccaggattttctctctgtcttctctctgggtgtgtgtgtgtgtatgtacagaagggctaccaggaagtgtcaaccatgttagattttctgtagtcttccagaaacagtgcagcccatacaacaggaatcttaattttcctcacagcaaatataacaggatggaacagttagtgttttgttttcacaagtgtccaccactccatctgccctgcatggagagggctctctcactgctagatctaggctgagccatctggaaggatcaaagggtgtgggagtatcaccccctctcaggctgcagaaggtctcgagggtggcgtcacagcaggatttccgccttctgcattgcactgcacagccccatggaacatgaggcacttgaggccttgcttcttggagcctctggggagcagagtaggtcactgccctctgggagtgttttgcagtagttttgtaaatgtgttgctacatagtcaagttcctttgtggcaaagaaatattttgttttgatattaggagccagcccatgtaatgcctctcaggcttgcttgcttagaagaaaaaagtcaccctttgtggtttttaagaaaaaaattctgtgcagatctgttcctcctcctgctccttcccttttctctacatacagtgctcattggaggctcctgctaaaccttcttaaccagagaaataataggtatttgttagacctgagtgtacatttcacatgttatccttcacatatttctcattttcatctagtactttcttaatgcctttgttggagtccgcatcctcatctttaaaaaaaaaaaaaaaaaacagcttagcctaagccacattcactttttttagttcacaaaaaggatttaatagccacaatgtgatttttgccacaactgtgtgattttaatattctctaatatcaagggcggatttagaattgcaggaaatacctggagaaatcacagtggaatgaatttttgctttaagagaaatgagagttggctgtctctgtaattgataatacagcttcatcctagtcccatctgcatttcagaaaataaccctcatctttacaaaacacaggacacttgtgggacagttaactcaagcagctatggggagggaggagattattgaatggtgattaaataatgcaaatggctcttctgtttcttaaagactgtggaagaggtcagactgcccagttgaggtgggcagttcatactgctcagttgaggtggcagtcatttattctgagtcctgttggatagagcctatctcctcaaggctacagaggcttccaggatatggagctgtgcatgttaatggctcagccttgcctccatcagggcacctgcctaacttggagcaagtgggagagcaccctagagtcatcctctgtgctgtttcgtgagttttgcagcggagacttcaccatccggaggagctgtgtttctgtgtcacttgggatatcacctaagttcactgaaagggtggcgggttgtgttgtggtgttttatctgggaactcaa

SEQ ID NO: 313695 - DNA, 2944 bp, Homo sapiens
cttagtttacatcctctcccccaatcttcacacacagagccaaagagcagttatattcttgggataccatgatacctctgggaaaggaattatattcccaaggagaggtcccattggataagaacaataccatgggacttgagtctgaatgccaacttactattcacacatccttcttaaaaacgaacacactgtttcttttcctgacctagagcattctaaagttctgttcaaataaataaagggcaaaataaagtagatttaaccaagtgccaggtggaattcaaaaaacacattcttccagataaattctacctttatggtatggatttgaaagtactttgcaggaaaacagtcagtactctttaaaaagggactgcagggctgggtgtagtggctcacacctgtaatcccagcactttgggaggccaaggcaggtgggtcacttgaggccaggagtttgagaccagcctgaccaacatggcaaaaccccatctctactaaaatacaaaaattagctgggcatgatggtgcactcctgtaatcccagctacttggtaggctgaagcatgagaattgcttaaacctgggaggcagaggttgcagtaagccaagatcatgccactgcattccagcctgggcaacagagtaagactctgtcttaataaataaataagaaaataaaacggaactgcagtgctaacagtaatttatacatttttaaatgttctgagtatgttttgactgggctagtgtaacaatatactaccctgaaagtgcagttttgattgttgttggtgtctttgggtcaggaaagtgaactgtgccaagaagtatttttcagtgacatgaatggattcctgttaatgcaattgactgagagattgtgcttacgctttcttaactgacaaaaagaggctttgtccaacatcagaattgttgaaactggtgctgttttctgttgcactgggattctgatgatctgggattttccctccttggcacagtaaacaccatgactgtctttattgagaatgtcgtcacagtcctttagtgatagattagttagacccatggttgcaatacctttatctccccaaagaaaataatcaaaagaaagcacaaaagctaccctgtttgcagaatatttcactgacattgatttgtcattaattctaccagagctgacctcattcaggcttgatagaaacaggttcctatgtttagggcagatccctagcctctcgctcacagtgagtctgcatgtcctagattctggttattgctggagcatccattaaagtctaccaaactcaggacagaagaagatagcagtggatttgtaaaaatttttagtttataaattacagtcattggggaaacactagtaaggtcatgtgatcttttggaccaggattttctctctgtcttctctctgggtgtgtgtgtgtgtatgtacagaagggctaccaggaagtgtcaaccatgttagattttctgtagtcttccagaaacagtgcagcccatacaacaggaatcttaattttcctcacagcaaatataacaggatggaacagttagtgttttgttttcacaagtgtccaccactccatctgccctgcatggagagggctctctcactgctagatctaggctgagccatctggaaggatcaaagggtgtgggagtatcaccccctctcaggctgcagaaggtctcgagggtggcgtcacagcaggatttccgccttctgcattgcactgcacagccccatggaacatgaggcacttgaggccttgcttcttggagcctctggggagcagagtaggtcactgccctctgggagtgttttgcagtagttttgtaaatgtgttgctacatagtcaagttcctttgtggcaaagaaatattttgttttgatattaggagccagcccatgtaatgcctctcaggcttgcttgcttagaagaaaaaagtcaccctttgtggtttttaagaaaaaaattctgtgcagatctgttcctcctcctgctccttcccttttctctacatacagtgctcattggaggctcctgctaaaccttcttaaccagagaaataataggtatttgttagacctgagtgtacatttcacatgttatccttcacatatttctcattttcatctagtactttcttaatgcctttgttggagtccgcatcctcatctttaaaaaaaaaaaaaaaaaacagcttagcctaagccacattcactttttttagttcacaaaaaggatttaatagccacaatgtgatttttgccacaactgtgtgattttaatattctctaatatcaagggcggatttagaattgcaggaaatacctggagaaatcacagtggaatgaatttttgctttaagagaaatgagagttggctgtctctgtaattgataatacagcttcatcctagtcccatctgcatttcagaaaataaccctcatctttacaaaacacaggacacttgtgggacagttaactcaagcagctatggggagggaggagattattgaatggtgattaaataatgcaaatggctcttctgtttcttaaagactgtggaagaggtcagactgcccagttgaggtgggcagttcatactgctcagttgaggtggcagtcatttattctgagtcctgttggatagagcctatctcctcaaggctacagaggcttccaggatatggagctgtgcatgttaatggctcagccttgcctccatcagggcacctgcctaacttggagcaagtgggagagcaccctagagtcatcctctgtgctgtttcgtgagttttgcagcggagacttcaccatccggaggagctgtgtttctgtgtcacttgggatatcacctaagactgtggcacatttttttgttgggtgtacctgtatgagtgtgaaacacaa

SEQ ID NO: 313696 - DNA, 1694 bp, Homo sapiens
ctggaacccggaagcggcagcgcggcgcgacccggcgggcgggctctgggcgcgggaatcccggcggatcccgggcgggcggatgacccccagccctacccttggtgccgcctcctcctctctcctttctcctccggcagccagcgcgcctgtgtcctctctaggaaggggtaggggaggggcgtctggagaggaccccccgcgaatgcccacgtgacgtgcagtccccctggggctgttccggcctgcggggaacatgggcgtgctcagggtcggactgtgccctggccttaccgaggagatgatccagcttctcaggagccacaggatcaagacagtggtggacctggtttctgcagacctggaagaggtagctcagaaatgtggcttgtcttacaagtcttgataaactgcttgatgctggtctctatactggagaagtgactgaaattgtaggaggcccaggtagcggcaaaactcaggtatgtctctgtatggcagcaaatgtggcccatggcctgcagcaaaacgtcctatatgtagattccaatggagggctgacagcttcccgcctcctccagctgcttcaggctaaaacccaggatgaggaggaacaggcagaagctctccggaggatccaggtggtgcatgcatttgacatcttccagatgctggatgtgctgcaggagctccgaggcactgtggcccagcaggtgactggttcttcaggaactgtgaaggtggtggttgtggactcggtcactgcggtggtttccccacttctgggaggtcagcagagggaaggcttggccttgatgatgcagctggcccgagagctgaagaccctggcccgggaccttggcatggcagtggtggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacagccaacaggtttccaggagatggtagacattgggacctgggggacctcagagcagagtgccacattacagggtgatcagacatgacctgtgctgttgtttgggaaacagggaagcattggggacccctcccaacttttcttcccagtaacgcctgctgtttactgccacctggcactggtgactacagacgttctcaggctggccagaagagacatcttgggttccttggcctcactctctgtaagcatataaaccacaggcgaaagaggatgctgcattgcgaggacccagaaattcatactggtgccacgtttccttcccttatttctaacgtgtatgtttctggtggaaaccaagttcaccctggctgggagcatctctgatgaggcatgctggcgactggatggataatcctgtgcatcaccattgtgtcctgtgctccctcctagcgcagtggccaagccgggaaagcctctaacttgcctttgctgctgctgccttttttttcttttgtctctgcctttccatttgttagatgggggcccactcttccttagctctgtctctgagttactgggtggaaataagcttataaatgaaatactcttcttcatctctgttttgctcttaaaaatataaaaaggcaattccccg

SEQ ID NO: 313697 - DNA, 446 bp, Homo sapiens
  misc_feature (11)..(11): n is a, c, g, or t
tcgagctcggnccagttgacggagactctcataccaactttgtctattgaaatgtatttttgttgtttctctgcttgacaaagttggtatgagagagcaggcttttgtaatgatgctgtaagaggctccggatttctgggcatgatgggagtacattctggacattgtgtgagttgaaaagaggcccatgctatgcagatctctgggacatctctagatgtgatgttacttttctcttcccacaggccaatggccatgtgtctcaggatcaagaggaacccgtctacctggagagcgtggccagagtacctgctgaggatgagacccaggtggggcctctgcttgggtctgtgtcttcacctttcctctttcactggtgttcttcggaacctcttagcagagtcgagtggagagtctccgtcgaactggtaccgagctcgatcaac

SEQ ID NO: 313698 - DNA, 839 bp, Homo sapiens
ctgcttacttacaaatgcaacagttgtcctattttatgctcattgtgttgtcaccagcattttaaatctttacaagtcagggtgggtacctcaggcaggtttgctggaaaattccagtaaacagtttcaaaggagttcaagttgcttgccagactaacttacttttaaaagtaagcagccttccaagttaagagatgattttaaatttcaggtgagttctcaggacattgtgattttttaattatgctgttggtataaatcagctgtgtcagggcctgtcccaccaagagcgttgggtggtaagaaacccaagctttgggtgaccagagagaggagagagaccttgggctttccagccagtaatgcctatgaaacatgtaggtcattggcattttattttatttatttttttgagatggagtctcgctctgtggcccaggctggagtgcagtggtgtgatcttggctcactgcaacctctgcctcccgggttcaagcgatacttctcccttagcctcctgagtagctgggactacaggcatgtgccaccacaccactaatttttgtgtttttagtagagacggggtttcaccatgttgtctaggctggtcttgaactcctgacctcaactgatccgcctgccttggcctcccagagtgctgggattgtaggagtgagccaccatgcccagccatcattttagaattataatttttagctggatgcggtaaaaaaaatcctttctcagccttcaggtctcatctcaagtatcaccgacatgaggagtcctcccccatttacacacaccagctcggtgtgaagaaccgaaaggtcacacta

SEQ ID NO: 313699 - DNA, 686 bp, Homo sapiens
ggccagaccaagggccagtgtgactgtgaagcagcatcatgagaggggtaaaaccaaggaacagactgcatgagcccttgggccccttccagctctaatactccatggtgatggcagccctgcccttctctgaagatctcaaaatgcctgacacctgtgtccttccgcactgccctgggaaggagaataaggatgtcttgataaactgcttgatgctggtctctatactggagaagtgactgaaattgtaggaggcccaggtagcggcaaaactcaggcagaagctctccggaggatccaggtggtgcatgcatttgacatcttccagatgctggatgtgctgcaggagctccgaggcactgtggcccagcaggtgagcctgctgttctgcccctccttgcttaattcagctttctaggtgctatctctgtgggcaggtgtcctactacagactgtttggaaatgcagatgtgcaatctggtgactccaactatgcttgctactcccaggatggaattcccgagcacctaaatcacatacctcattgtttacatgttcatcttccctgctgaacagtaaagccccctgagtggaaggatcatgtcatatttatgtctgcattccccactagtttctaggggttaagaatctgagactaggagcggtggctcacgcctaaaatccca

SEQ ID NO: 313700 - DNA, 330 bp, Homo sapiens
aactaaagaagctacccacttgggttgcttaactccactgactccttacttcttcttccagccaacaggtttccaggagatggtagacattgggacctgggggacctcagagcagagtgccacattacagggtgatcagacatgacctgtgctgttgtttgggaaacagggaagcattggggacccctcccaacttttcttcccagtaacgcctgctgtttactgccacctggcactggtgactacagacgttctcaggctggccagaagagacatcttgggttccttggcctcactctctgtaagcatataaaccacaggcgaaagagg

SEQ ID NO: 313701 - DNA, 2293 bp, Homo sapiens
cggtgtgtgtgttgcggcagaagccagcgcgcctgtgtcctctctaggaaggggtaggggaggggcgtctggagaggaccccccgcgaatgcccacgtgacgtgcagtccccctggggctgttccggcctgcggggaacatgggcgtgctcagggtcggactgtgccctggccttaccgaggagatgatccagcttctcaggagccacaggatcaagacagtggtggacctggtttctgcagacctggaagaggtagctcagaaatgtggcttgtcttacaaggccctggttgccctgaggcgggtgctgctggctcagttctcggctttccccgtgaatggcgctgatctctacgaggaactgaagacctccactgccatcctgtccactggcattggcagtcttgataaactgcttgatgctggtctctatactggagaagtgactgaaattgtaggaggcccaggtagcggcaaaactcaggtatgtctctgtatggcagcaaatgtggcccatggcctgcagcaaaacgtcctatatgtagattccaatggagggctgacagcttcccgcctcctccagctgcttcaggctaaaacccaggatgaggaggaacaggcagaagctctccggaggatccaggtggtgcatgcatttgacatcttccagatgctggatgtgctgcaggagctccgaggcactgtggcccagcaggtgactggttcttcaggaactgtgaaggtggtggttgtggactcggtcactgcggtggtttccccacttctgggaggtcagcagagggaaggcttggccttgatgatgcagctggcccgagagctgaagaccctggcccgggaccttggcatggcagtggtggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacagccaacaggtttccaggagatggtagacattgggacctgggggacctcagagcagagtgccacattacagggtgatcagacatgacctgtgctgttgtttgggaaacagggaagcattggggacccctcccaacttttcttcccagtaacgcctgctgtttactgccacctggcactggtgactacagacgttctcaggctggccagaagagacatcttgggttccttggcctcactctctgtaagcatataaaccacaggcgaaagaggatgctgcattgcgaggacccagaaattcatactggtgccacgtttccttcccttatttctaacgtgtatgtttctggtggaaaccaagttcaccctggctgggagcatctctgatgaggcatgctggcgactggatggataatcctgtgcatcaccattgtgtcctgtgctccctcctagcgcagtggccaagccgggaaagcctctaacttgcctttgctgctgctgccttttttttcttttgtctctgcctttccatttgttagatgggggcccactcttccttagctctgtctctgagttactgggtggaaataagcttataaatgaaatactcttcttcatctctgttttgctcttaaaaatataaaaaggcaattccccgagccctagagccacctgatttccccttagaaggctgtttttcagtttcccccagtgaggcccaaagaacagtttattcctcctttcctcttgctgatttggtttcagacctgcctgcatcaccatgactaggtgagaacgtgtgggctcgctgcagttccagggatataatttaacagaaagggagggtatgacctgctcctggtgaatccagccactcatttaatatgcatggtgccctgtggggcccctccacagtacagcataaccagaggtgctgaaccatggccttgcccataaacagacagaggagaatttgcacagtaaatagagccagctgggaaaattgatgctgacgtaaataatacatggcaaatctagtcctttatgcagaaattcattgctggtggctccaagatgcaatataattacacctctcttcctgccagctgtaccacagctagtgccctagtgtatgaaataatccctctgtctttcaccagcactgtggccatccgtctgagagccatgaccctggctgggaggggacgaagacaccagggaatggaaaataaaaggaaaagtacagaaatgatca

SEQ ID NO: 313702 - DNA, 2589 bp, Homo sapiens
ctggaacccggaagcggcagcgcggcgcgacccggcgggcgggctctgggcgcgggaatcccggcggatcccgggcgggcggatgacccccagccctacccttggtgccgcctcctcctctctcctttctcctccggcagccagcgcgcctgtgtcctctctaggaaggggtaggggaggggcgtctggagaggaccccccgcgaatgcccacgtgacgtgcagtccccctggggctgttccggcctgcggggaacatgggcgtgctcagggtcggactgtgccctggccttaccgaggagatgatccagcttctcaggagccacaggatcaagacagtggtggacctggtttctgcagacctggaagaggtagctcagaaatgtggcttgtcttacaaggccctggttgccctgaggcgggtgctgctggctcagttctcggctttccccgtgaatggcgctgatctctacgaggaactgaagacctccactgccatcctgtccactggcattggcagacatggagggcgcactcaagtgggaacctgggaggactgcagctgcctcaggtccccgcagggagatcgtggagtggggtcaggaatgctctgaagaaggcaggacttgggcatggaggaacagatggactttcgctgaatgctttcgatgaacgaggcactgcggtcagcacttcacgtcttgataaactgcttgatgctggtctctatactggagaagtgactgaaattgtaggaggcccaggtagcggcaaaactcaggtatgtctctgtatggcagcaaatgtggcccatggcctgcagcaaaacgtcctatatgtagattccaatggagggctgacagcttcccgcctcctccagctgcttcaggctaaaacccaggatgaggaggaacaggcagaagctctccggaggatccaggtggtgcatgcatttgacatcttccagatgctggatgtgctgcaggagctccgaggcactgtggcccagcaggtgactggttcttcaggaactgtgaaggtggtggttgtggactcggtcactgcggtggtttccccacttctgggaggtcagcagagggaaggcttggccttgatgatgcagctggcccgagagctgaagaccctggcccgggaccttggcatggcagtggtggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacagccaacaggtttccaggagatggtagacattgggacctgggggacctcagagcagagtgccacattacagggtgatcagacatgacctgtgctgttgtttgggaaacagggaagcattggggacccctcccaacttttcttcccagtaacgcctgctgtttactgccacctggcactggtgactacagacgttctcaggctggccagaagagacatcttgggttccttggcctcactctctgtaagcatataaaccacaggcgaaagaggatgctgcattgcgaggacccagaaattcatactggtgccacgtttccttcccttatttctaacgtgtatgtttctggtggaaaccaagttcaccctggctgggagcatctctgatgaggcatgctggcgactggatggataatcctgtgcatcaccattgtgtcctgtgctccctcctagcgcagtggccaagccgggaaagcctctaacttgcctttgctgctgctgccttttttttcttttgtctctgcctttccatttgttagatgggggcccactcttccttagctctgtctctgagttactgggtggaaataagcttataaatgaaatactcttcttcatctctgttttgctcttaaaaatataaaaaggcaattccccgagccctagagccacctgatttccccttagaaggctgtttttcagtttcccccagtgaggcccaaagaacagtttattcctcctttcctcttgctgatttggtttcagacctgcctgcatcaccatgactaggtgagaacgtgtgggctcgctgcagttccagggatataatttaacagaaagggagggtatgacctgctcctggtgaatccagccactcatttaatatgcatggtgccctgtggggcccctccacagtacagcataaccagaggtgctgaaccatggccttgcccataaacagacagaggagaatttgcacagtaaatagagccagctgggaaaattgatgctgacgtaaataatacatggcaaatctagtcctttatgcagaaattcattgctggtggctccaagatgcaatataattacacctctcttcctgccagctgtaccacagctagtgccctagtgtatgaaataatccctctgtctttcaccagcactgtggccatccgtctgagagccatgaccctggctgggaggggacgaagacaccagggaatggaaaataaaaggaaaagtacagaaatgatca

SEQ ID NO: 313703 - DNA, 1655 bp, Homo sapiens
cggtgtgtgtgttgcggcagaagccagcgcgcctgtgtcctctctaggaaggggtaggggaggggcgtctggagaggaccccccgcgaatgcccacgtgacgtgcagtccccctggggctgttccggcctgcggggaacatgggcgtgctcagggtcggactgtgccctggccttaccgaggagatgatccagcttctcaggagccacaggatcaagacagtggtggacctggtttctgcagacctggaagaggtagctcagaaatgtggcttgtcttacaaggccctggttgccctgaggcgggtgctgctggctcagttctcggctttccccgtgaatggcgctgatctctacgaggaactgaagacctccactgccatcctgtccactggcattggcagtcttgataaactgcttgatgctggtctctatactggagaagtgactgaaattgtaggaggcccaggtagcggcaaaactcaggtatgtctctgtatggcagcaaatgtggcccatggcctgcagcaaaacgtcctatatgtagattccaatggagggctgacagcttcccgcctcctccagctgcttcaggctaaaacccaggatgaggaggaacaggcagaagctctccggaggatccaggtggtgcatgcatttgacatcttccagatgctggatgtgctgcaggagctccgaggcactgtggcccagcaggtgactggttcttcaggaactgtgaaggtggtggttgtggactcggtcactgcggtggtttccccacttctgggaggtcagcagagggaaggcttggccttgatgatgcagctggcccgagagctgaagaccctggcccgggaccttggcatggcagtggtggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacagccaacaggtttccaggagatggtagacattgggacctgggggacctcagagcagagtgccacattacagggtgatcagacatgacctgtgctgttgtttgggaaacagggaagcattggggacccctcccaacttttcttcccagtaacgcctgctgtttactgccacctggcactggtgactacagacgttctcaggctggccagaagagacatcttgggttccttggcctcactctctgtaagcatataaaccacaggcgaaagaggatgctgcattgcgaggacccagaaattcatactggtgccacgtttccttcccttatttctaacgtgtatgtttctggtggaaaccaagttcaccctggctgggagcatctctgatgaggcatgctggcgactggatggataatcctgtgcatcaccattgtgtcctgtgctccctcctagcgcagtggccaagccgggaaagcctctaacttgcctttgctgctgctgccttttttttcttttgtctctgcctttccatttgttagatgggggcccactcttccttagctctgtctctgagttactgggtggaaataagcttataaatgaaatactcttcttca

SEQ ID NO: 313704 - DNA, 2431 bp, Homo sapiens
cggtgtgtgtgttgcggcagaagccagcgcgcctgtgtcctctctaggaaggggtaggggaggggcgtctggagaggaccccccgcgaatgcccacgtgacgtgcagtccccctggggctgttccggcctgcggggcgaggagatgatccagcttctcaggagccacaggatcaagacagtggtggacctggtttctgcagacctggaagaggtagctcagaaatgtggcttgtcttacaaggccctggttgccctgaggcgggtgctgctggctcagttctcggctttccccgtgaatggcgctgatctctacgaggaactgaagacctccactgccatcctgtccactggcattggcagacatggagggcgcactcaagtgggaacctgggaggactgcagctgcctcaggtccccgcagggagatcgtggagtggggtcaggaatgctctgaagaaggcaggacttgggcatggaggaacagatggactttcgctgaatgctttcgatgaacgaggcactgcggtcagcacttcacgtcttgataaactgcttgatgctggtctctatactggagaagtgactgaaattgtaggaggcccaggtagcggcaaaactcaggtatgtctctgtatggcagcaaatgtggcccatggcctgcagcaaaacgtcctatatgtagattccaatggagggctgacagcttcccgcctcctccagctgcttcaggctaaaacccaggatgaggaggaacaggcagaagctctccggaggatccaggtggtgcatgcatttgacatcttccagatgctggatgtgctgcaggagctccgaggcactgtggcccagcaggtgactggttcttcaggaactgtgaaggtggtggttgtggactcggtcactgcggtggtttccccacttctgggaggtcagcagagggaaggcttggccttgatgatgcagctggcccgagagctgaagaccctggcccgggaccttggcatggcagtggtggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacagccaacaggtttccaggagatggtagacattgggacctgggggacctcagagcagagtgccacattacagggtgatcagacatgacctgtgctgttgtttgggaaacagggaagcattggggacccctcccaacttttcttcccagtaacgcctgctgtttactgccacctggcactggtgactacagacgttctcaggctggccagaagagacatcttgggttccttggcctcactctctgtaagcatataaaccacaggcgaaagaggatgctgcattgcgaggacccagaaattcatactggtgccacgtttccttcccttatttctaacgtgtatgtttctggtggaaaccaagttcaccctggctgggagcatctctgatgaggcatgctggcgactggatggataatcctgtgcatcaccattgtgtcctgtgctccctcctagcgcagtggccaagccgggaaagcctctaacttgcctttgctgctgctgccttttttttcttttgtctctgcctttccatttgttagatgggggcccactcttccttagctctgtctctgagttactgggtggaaataagcttataaatgaaatactcttcttcatctctgttttgctcttaaaaatataaaaaggcaattccccgagccctagagccacctgatttccccttagaaggctgtttttcagtttcccccagtgaggcccaaagaacagtttattcctcctttcctcttgctgatttggtttcagacctgcctgcatcaccatgactaggtgagaacgtgtgggctcgctgcagttccagggatataatttaacagaaagggagggtatgacctgctcctggtgaatccagccactcatttaatatgcatggtgccctgtggggcccctccacagtacagcataaccagaggtgctgaaccatggccttgcccataaacagacagaggagaatttgcacagtaaatagagccagctgggaaaattgatgctgacgtaaataatacatggcaaatctagtcctttatgcagaaattcattgctggtggctccaagatgcaatataattacacctctcttcctgccagctgtaccacagctagtgccctagtgtatgaaataatccctctgtctttcaccagcactgtggccatccgtctgagagccatgaccctggctgggaggggacgaagacaccagggaatggaaaataaaaggaaaagtacagaaatgatca

SEQ ID NO: 313705 - DNA, 2719 bp, Homo sapiens
ctggaacccggaagcggcagcgcggcgcgacccggcgggcgggctctgggcgcgggaatcccggcggatcccgggcgggcggatgacccccagccctacccttggtgccgcctcctcctctctcctttctcctccggcagccagcgcgcctgtgtcctctctaggaaggggtaggggaggggcgtctggagaggaccccccgcgaatgcccacgtgacgtgcagtccccctggggctgttccggcctgcggggaacatgggcgtgctcagggtcggactgtgccctggccttaccgaggagatgatccagcttctcaggagccacaggatcaagacagtggtggacctggtttctgcagacctggaagaggtagctcagaaatgtggcttgtcttacaaggccctggttgccctgaggcgggtgctgctggctcagttctcggctttccccgtgaatggcgctgatctctacgaggaactgaagacctccactgccatcctgtccactggcattggcagtcttgataaactgcttgatgctggtctctatactggagaagtgactgaaattgtaggaggcccaggtagcggcaaaactcaggcagaagctctccggaggatccaggtggtgcatgcatttgacatcttccagatgctggatgtgctgcaggagctccgaggcactgtggcccagcaggtgagcctgctgttctgcccctccttgcttaattcagctttctaggtgctatctctgtgggcaggtgtcctactacagactgtttggaaatgcagatgtgcaatctggtgactccaactatgcttgctactcccaggatggaattcccgagcacctaaatcacatacctcattgtttacatgttcatcttccctgctgaacagtaaagccccctgagtggaaggatcatgtcatatttatgtctgcattccccactaggtgactggttcttcaggaactgtgaaggtggtggttgtggactcggtcactgcggtggtttccccacttctgggaggtcagcagagggaaggcttggccttgatgatgcagctggcccgagagctgaagaccctggcccgggaccttggcatggcagtggtggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacagattttatcatgtgggcaacctgctgcaactggttctgcctggatggacagcctgaggaggtcccaccaccccagggagccaggatgcaggcctattccaaccctgggtacagctccttcccttccccaacaggcttggaaccaagctgcaagtcctgtggggctcactttgcaaacacggccaggaagcagacctgcttggactgtaagaaaaatttttgcatgacctgttcgagccaagtagggaatgggccccgcctctgccttctctgccaacggtttcgagctacagcctttcagcgagaggagctcatgaagatgaaggtgaaggacttgagggactatctcagcctccatgacatctctaccgaaatgtgccgggagaaagaagagctggtgctcttggtccttggccagcagcctgtaatctcccaggaggacaggactcgtgcctccaccttgtccccagactttcctgagcagcaggccttcctgacccagcctcactccagcatggttccacctacctcacccaacctcccctcttcatctgcacaagccacctctgttcccccagcccaggttcaggagaatcagcagggccaatggccatgtgtctcaggatcaagaggaacccgtctacctggagagcgtggccagagtacctgctgaggatgagacccagtctattgactcagaggacagctttgtcccaggccgaagggcctctctgtctgacctgactgacctggaggacattgaaggcctgacagtgcggcagctgaaagagatcttggctcgcaactttgtcaactacaagggctgctgtgagaagtgggagctgatggagagagtgacccggctatacaaggatcagaaaggactccagcacctggtcagtggtgccgaagaccaaaacgggggagcagtaccatcaggcttggaggagaacctgtgtaagatctgcatggactcacccattgactgtgttcttctggagtgtggccacatggtaacctgtaccaagtgtggcaagcgcatgaatgaatgtcccatctgccggcagtatgtaatccgagctgtgcatgtcttccggtcctgagagcttgcatcggtttcttcagtgccttacagggaaatagcctggggtgtctgggctcagggttggccagcttgcagaggagcaagctagtagaaatattgcagggttcccaaaaccaggtcaagcaagatgccatgtcacccctgagcatgcctgtcttcccaggggtgtacctcttggctggcaaagcccaaggccagtgggaacttgtataaatcacatgggtatgttcttggttcagtgatcttggagtgatgatggtaactgatgaacagagaactttccagaacttgggtcctgtcttcctccctgaacctagacagtttcacccctcct

SEQ ID NO: 313706 - DNA, 2073 bp, Homo sapiens
ctggaacccggaagcggcagcgcggcgcgacccggcgggcgggctctgggcgcgggaatcccggcggatcccgggcgggcggatgacccccagccctacccttggtgccgcctcctcctctctcctttctcctccggcagccagcgcgcctgtgtcctctctaggaaggggtaggggaggggcgtctggagaggaccccccgcgaatgcccacgtgacgtgcagtccccctggggctgttccggcctgcggggaacatgggcgtgctcagggtcggactgtgccctggccttaccgaggagatgatccagcttctcaggagccacaggatcaagacagtggtggacctggtttctgcagacctggaagaggtagctcagaaatgtggcttgtcttacaaggccctggttgccctgaggcgggtgctgctggctcagttctcggctttccccgtgaatggcgctgatctctacgaggaactgaagacctccactgccatcctgtccactggcattggcagacatggagggcgcactcaagtgggaacctgggaggactgcagctgcctcaggtccccgcagggagatcgtggagtggggtcaggaatgctctgaagaaggcaggacttgggcatggaggaacagatggactttcgctgaatgctttcgatgaacgaggcactgcggtcagcacttcacgtcttgataaactgcttgatgctggtctctatactggagaagtgactgaaattgtaggaggcccaggtagcggcaaaactcaggtatgtctctgtatggcagcaaatgtggcccatggcctgcagcaaaacgtcctatatgtagattccaatggagggctgacagcttcccgcctcctccagctgcttcaggctaaaacccaggatgaggaggaacaggcagaagctctccggaggatccaggtggtgcatgcatttgacatcttccagatgctggatgtgctgcaggagctccgaggcactgtggcccagcaggatggaattcccgagcacctaaatcacatacctcattgtttacatgttcatcttccctgctgaacagtaaagccccctgagtggaaggatcatgtcatatttatgtctgcattccccactaggtgactggttcttcaggaactgtgaaggtggtggttgtggactcggtcactgcggtggtttccccacttctgggaggtcagcagagggaaggcttggccttgatgatgcagctggcccgagagctgaagaccctggcccgggaccttggcatggcagtggtggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacagccaacaggtttccaggagatggtagacattgggacctgggggacctcagagcagagtgccacattacagggtgatcagacatgacctgtgctgttgtttgggaaacagggaagcattggggacccctcccaacttttcttcccagtaacgcctgctgtttactgccacctggcactggtgactacagacgttctcaggctggccagaagagacatcttgggttccttggcctcactctctgtaagcatataaaccacaggcgaaagaggatgctgcattgcgaggacccagaaattcatactggtgccacgtttccttcccttatttctaacgtgtatgtttctggtggaaaccaagttcaccctggctgggagcatctctgatgaggcatgctggcgactggatggataatcctgtgcatcaccattgtgtcctgtgctccctcctagcgcagtggccaagccgggaaagcctctaacttgcctttgctgctgctgccttttttttcttttgtctctgcctttccatttgttagatgggggcccactcttccttagctctgtctctgagttactgggtggaaataagcttataaatgaaatactcttcttca

SEQ ID NO: 313707 - DNA, 1717 bp, Homo sapiens
cctaggttgcagttgactgcggttggttcaggctgagttgtttgggaagtacaaattttgcccagcgtgagtcagcactgccctgggtaaactccctgctgtgttgcaatcttgcttaccaaagatacatccccaggcggcaccattcacttcacatgaaagccgctgctcttggttcctgagatgatctcatctgaacatggctccagcgacctcagccacaggaactagagacagcttgctttctgtcgtggcaatgttttgaaactggcaaaatcagattttatcatgtgggcaacctgctgcaactggttctgcctggatggacagcctgaggaggtcccaccaccccagggagccaggatgcaggcctattccaaccctgggtacagctccttcccttccccaacaggcttggaaccaagctgcaagtcctgtggggctcactttgcaaacacggccaggaagcagacctgcttggactgtaagaaaaatttttgcatgacctgttcgagccaagtagggaatgggccccgcctctgccttctctgccaacggtttcgagctacagcctttcagcgagaggagctcatgaagatgaaggtgaaggacttgagggactatctcagcctccatgacatctctaccgaaatgtgccgggagaaagaagagctggtgctcttggtccttggccagcagcctgtaatctcccaggaggacaggactcgtgcctccaccttgtccccagactttcctgagcagcaggccttcctgacccagcctcactccagcatggttccacctacctcacccaacctcccctcttcatctgcacaagccacctctgttcccccagcccaggttcaggagaatcagcagggccaatggccatgtgtctcaggatcaagaggaacccgtctacctggagagcgtggccagagtacctgctgaggatgagacccagtctattgactcagaggacagctttgtcccaggccgaagggcctctctgtctgacctgactgacctggaggacattgaaggcctgacagtgcggcagctgaaagagatcttggctcgcaactttgtcaactacaagggctgctgtgagaagtgggagctgatggagagagtgacccggctatacaaggatcagaaaggactccagcacctggtcagtggtgccgaagaccaaaacgggggagcagtaccatcaggcttggaggagaacctgtgtaagatctgcatggactcacccattgactgtgttcttctggagtgtggccacatggtaacctgtaccaagtgtggcaagcgcatgaatgaatgtcccatctgccggcagtatgtaatccgagctgtgcatgtcttccggtcctgagagcttgcatcggtttcttcagtgccttacagggaaatagcctggggtgtctgggctcagggttggccagcttgcagaggagcaagctagtagaaatattgcagggttcccaaaaccaggtcaagcaagatgccatgtcacccctgagcatgcctgtcttcccaggggtgtacctcttggctggcaaagcccaaggccagtgggaacttgtataaatcacatgggtatgttcttggttcagtgatcttggagtgatgatggtaactgatgaacagagaactttccagaacttgggtcctgtcttcctccctgaacctagacagtttcacccctcct

SEQ ID NO: 313708 - DNA, 2328 bp, Homo sapiens
ctggaacccggaagcggcagcgcggcgcgacccggcgggcgggctctgggcgcgggaatcccggcggatcccgggcgggcggatgacccccagccctacccttggtgccgcctcctcctctctcctttctcctccggcagccagcgcgcctgtgtcctctctaggaaggggtaggggaggggcgtctggagaggaccccccgcgaatgcccacgtgacgtgcagtccccctggggctgttccggcctgcggggaacatgggcgtgctcagggtcggactgtgccctggccttaccgaggagatgatccagcttctcaggagccacaggatcaagacagtggtggacctggtttctgcagacctggaagaggtagctcagaaatgtggcttgtcttacaaggccctggttgccctgaggcgggtgctgctggctcagttctcggctttccccgtgaatggcgctgatctctacgaggaactgaagacctccactgccatcctgtccactggcattggcaggtatgtctctgtatggcagcaaatgtggcccatggcctgcagcaaaacgtcctatatgtagattccaatggagggctgacagcttcccgcctcctccagctgcttcaggctaaaacccaggatgaggaggaacaggcagaagctctccggaggatccaggtggtgcatgcatttgacatcttccagatgctggatgtgctgcaggagctccgaggcactgtggcccagcaggtgactggttcttcaggaactgtgaaggtggtggttgtggactcggtcactgcggtggtttccccacttctgggaggtcagcagagggaaggcttggccttgatgatgcagctggcccgagagctgaagaccctggcccgggaccttggcatggcagtggtggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacagccaacaggtttccaggagatggtagacattgggacctgggggacctcagagcagagtgccacattacagggtgatcagacatgacctgtgctgttgtttgggaaacagggaagcattggggacccctcccaacttttcttcccagtaacgcctgctgtttactgccacctggcactggtgactacagacgttctcaggctggccagaagagacatcttgggttccttggcctcactctctgtaagcatataaaccacaggcgaaagaggatgctgcattgcgaggacccagaaattcatactggtgccacgtttccttcccttatttctaacgtgtatgtttctggtggaaaccaagttcaccctggctgggagcatctctgatgaggcatgctggcgactggatggataatcctgtgcatcaccattgtgtcctgtgctccctcctagcgcagtggccaagccgggaaagcctctaacttgcctttgctgctgctgccttttttttcttttgtctctgcctttccatttgttagatgggggcccactcttccttagctctgtctctgagttactgggtggaaataagcttataaatgaaatactcttcttcatctctgttttgctcttaaaaatataaaaaggcaattccccgagccctagagccacctgatttccccttagaaggctgtttttcagtttcccccagtgaggcccaaagaacagtttattcctcctttcctcttgctgatttggtttcagacctgcctgcatcaccatgactaggtgagaacgtgtgggctcgctgcagttccagggatataatttaacagaaagggagggtatgacctgctcctggtgaatccagccactcatttaatatgcatggtgccctgtggggcccctccacagtacagcataaccagaggtgctgaaccatggccttgcccataaacagacagaggagaatttgcacagtaaatagagccagctgggaaaattgatgctgacgtaaataatacatggcaaatctagtcctttatgcagaaattcattgctggtggctccaagatgcaatataattacacctctcttcctgccagctgtaccacagctagtgccctagtgtatgaaataatccctctgtctttcaccagcactgtggccatccgtctgagagccatgaccctggctgggaggggacgaagacaccagggaatggaaaataaaaggaaaagtacagaaatgatca

SEQ ID NO: 313709 - DNA, 1829 bp, Homo sapiens
ctgcttacttacaaatgcaacagttgtcctattttatgctcattgtgttgtcaccagcattttaaatctttacaagtcagggtgggtacctcaggcaggtttgctggaaaattccagtaaacagtttcaaaggagttcaagttgcttgccagactaacttacttttaaaagtaagcagccttccaagttaagagatgattttaaatttcagggaaagtggaagaggagaccctagcaggcttcaagcaagctctgtaggacagcagttagacactgtttttgaggactaaattgccaagtctgtcttttaagaagagggtgaggggagtttgggaaggaatgttcaagccctgagtgaagatccaataattttctttcaagatcagaaggagattttatcatgtgggcaacctgctgcaactggttctgcctggatggacagcctgaggaggtcccaccaccccagggagccaggatgcaggcctattccaaccctgggtacagctccttcccttccccaacaggcttggaaccaagctgcaagtcctgtggggctcactttgcaaacacggccaggaagcagacctgcttggactgtaagaaaaatttttgcatgacctgttcgagccaagtagggaatgggccccgcctctgccttctctgccaacggtttcgagctacagcctttcagcgagaggagctcatgaagatgaaggtgaaggacttgagggactatctcagcctccatgacatctctaccgaaatgtgccgggagaaagaagagctggtgctcttggtccttggccagcagcctgtaatctcccaggaggacaggactcgtgcctccaccttgtccccagactttcctgagcagcaggccttcctgacccagcctcactccagcatggttccacctacctcacccaacctcccctcttcatctgcacaagccacctctgttcccccagcccaggttcaggagaatcagcagggccaatggccatgtgtctcaggatcaagaggaacccgtctacctggagagcgtggccagagtacctgctgaggatgagacccagtctattgactcagaggacagctttgtcccaggccgaagggcctctctgtctgacctgactgacctggaggacattgaaggcctgacagtgcggcagctgaaagagatcttggctcgcaactttgtcaactacaagggctgctgtgagaagtgggagctgatggagagagtgacccggctatacaaggatcagaaaggactccagcacctggtcagtggtgccgaagaccaaaacgggggagcagtaccatcaggcttggaggagaacctgtgtaagatctgcatggactcacccattgactgtgttcttctggagtgtggccacatggtaacctgtaccaagtgtggcaagcgcatgaatgaatgtcccatctgccggcagtatgtaatccgagctgtgcatgtcttccggtcctgagagcttgcatcggtttcttcagtgccttacagggaaatagcctggggtgtctgggctcagggttggccagcttgcagaggagcaagctagtagaaatattgcagggttcccaaaaccaggtcaagcaagatgccatgtcacccctgagcatgcctgtcttcccaggggtgtacctcttggctggcaaagcccaaggccagtgggaacttgtataaatcacatgggtatgttcttggttcagtgatcttggagtgatgatggtaactgatgaacagagaactttccagaacttgggtcctgtcttcctccctgaacctagacagtttcacccctcct

SEQ ID NO: 313710 - DNA, 1652 bp, Homo sapiens
ggccgggccgggccggctggggatgggtgggagggggggccgacttcctggggccgcccgtgaggatgtcgcgaccgcccccgggtgcccctcagccccagagacgccgccgcggcggagtccgcagcctccctgcctgaggcgtccgcggccgggatccggcccctcccctcgcctcctctcctaggtgccggccgggagggcggccgcagcagattttatcatgtgggcaacctgctgcaactggttctgcctggatggacagcctgaggaggtcccaccaccccagggagccaggatgcaggcctattccaaccctgggtacagctccttcccttccccaacaggcttggaaccaagctgcaagtcctgtggggctcactttgcaaacacggccaggaagcagacctgcttggactgtaagaaaaatttttgcatgacctgttcgagccaagtagggaatgggccccgcctctgccttctctgccaacggtttcgagctacagcctttcagcgagaggagctcatgaagatgaaggtgaaggacttgagggactatctcagcctccatgacatctctaccgaaatgtgccgggagaaagaagagctggtgctcttggtccttggccagcagcctgtaatctcccaggaggacaggactcgtgcctccaccttgtccccagactttcctgagcagcaggccttcctgacccagcctcactccagcatggttccacctacctcacccaacctcccctcttcatctgcacaagccacctctgttcccccagcccaggttcaggagaatcagcagggccaatggccatgtgtctcaggatcaagaggaacccgtctacctggagagcgtggccagagtacctgctgaggatgagacccagtctattgactcagaggacagctttgtcccaggccgaagggcctctctgtctgacctgactgacctggaggacattgaaggcctgacagtgcggcagctgaaagagatcttggctcgcaactttgtcaactacaagggctgctgtgagaagtgggagctgatggagagagtgacccggctatacaaggatcagaaaggactccagcacctggtcagtggtgccgaagaccaaaacgggggagcagtaccatcaggcttggaggagaacctgtgtaagatctgcatggactcacccattgactgtgttcttctggagtgtggccacatggtaacctgtaccaagtgtggcaagcgcatgaatgaatgtcccatctgccggcagtatgtaatccgagctgtgcatgtcttccggtcctgagagcttgcatcggtttcttcagtgccttacagggaaatagcctggggtgtctgggctcagggttggccagcttgcagaggagcaagctagtagaaatattgcagggttcccaaaaccaggtcaagcaagatgccatgtcacccctgagcatgcctgtcttcccaggggtgtacctcttggctggcaaagcccaaggccagtgggaacttgtataaatcacatgggtatgttcttggttcagtgatcttggagtgatgatggtaactgatgaacagagaactttccagaacttgggtcctgtcttcctccctgaacctagacagtttcacccctcct

SEQ ID NO: 313711 - DNA, 2017 bp, Homo sapiens
ggccgggccgggccggctggggatgggtgggagggggggccgacttcctggggccgcccgtgaggatgtcgcgaccgcccccgggtgcccctcagccccagagacgccgccgcggcggagtccgcagcctccctgcctgaggcgtccgcggccgggatccggcccctcccctcgcctcctctcctaggtgccggccgggagggcggccgcagcagaactttgggggaagtgagaactgtgagcacaataatcttcagagaatgcacagtcctttgggtatttgtctactcatcagctgcttagtcagatggagtgttttcctaagtactactgaagtacacagttcagtctttattttgaaatctctccttctgccttctctccctcttccattactttgattaccttgatgggacattcaagctgtgcagtcgtatccttttatttctatagcctgcagaaaccaggttgaagattaactgtaggtgaacaggtaatcttatctacttggctagaaatcacccttcaagatgaaacacgtgttgacaaaggccccctagacttggggacatgaacaaagattttatcatgtgggcaacctgctgcaactggttctgcctggatggacagcctgaggaggtcccaccaccccagggagccaggatgcaggcctattccaaccctgggtacagctccttcccttccccaacaggcttggaaccaagctgcaagtcctgtggggctcactttgcaaacacggccaggaagcagacctgcttggactgtaagaaaaatttttgcatgacctgttcgagccaagtagggaatgggccccgcctctgccttctctgccaacggtttcgagctacagcctttcagcgagaggagctcatgaagatgaaggtgaaggacttgagggactatctcagcctccatgacatctctaccgaaatgtgccgggagaaagaagagctggtgctcttggtccttggccagcagcctgtaatctcccaggaggacaggactcgtgcctccaccttgtccccagactttcctgagcagcaggccttcctgacccagcctcactccagcatggttccacctacctcacccaacctcccctcttcatctgcacaagccacctctgttcccccagcccaggttcaggagaatcagcagggccaatggccatgtgtctcaggatcaagaggaacccgtctacctggagagcgtggccagagtacctgctgaggatgagacccagtctattgactcagaggacagctttgtcccaggccgaagggcctctctgtctgacctgactgacctggaggacattgaaggcctgacagtgcggcagctgaaagagatcttggctcgcaactttgtcaactacaagggctgctgtgagaagtgggagctgatggagagagtgacccggctatacaaggatcagaaaggactccagcacctggtcagtggtgccgaagaccaaaacgggggagcagtaccatcaggcttggaggagaacctgtgtaagatctgcatggactcacccattgactgtgttcttctggagtgtggccacatggtaacctgtaccaagtgtggcaagcgcatgaatgaatgtcccatctgccggcagtatgtaatccgagctgtgcatgtcttccggtcctgagagcttgcatcggtttcttcagtgccttacagggaaatagcctggggtgtctgggctcagggttggccagcttgcagaggagcaagctagtagaaatattgcagggttcccaaaaccaggtcaagcaagatgccatgtcacccctgagcatgcctgtcttcccaggggtgtacctcttggctggcaaagcccaaggccagtgggaacttgtataaatcacatgggtatgttcttggttcagtgatcttggagtgatgatggtaactgatgaacagagaactttccagaacttgggtcctgtcttcctccctgaacctagacagtttcacccctcct

SEQ ID NO: 313712 - DNA, 3077 bp, Homo sapiens
ctggaacccggaagcggcagcgcggcgcgacccggcgggcgggctctgggcgcgggaatcccggcggatcccgggcgggcggatgacccccagccctacccttggtgccgcctcctcctctctcctttctcctccggcagccagcgcgcctgtgtcctctctaggaaggggtaggggaggggcgtctggagaggaccccccgcgaatgcccacgtgacgtgcagtccccctggggctgttccggcctgcggggaacatgggcgtgctcagggtcggactgtgccctggccttaccgaggagatgatccagcttctcaggagccacaggatcaagacagtggtggacctggtttctgcagacctggaagaggtagctcagaaatgtggcttgtcttacaaggccctggttgccctgaggcgggtgctgctggctcagttctcggctttccccgtgaatggcgctgatctctacgaggaactgaagacctccactgccatcctgtccactggcattggcagacatggagggcgcactcaagtgggaacctgggaggactgcagctgcctcaggtccccgcagggagatcgtggagtggggtcaggaatgctctgaagaaggcaggacttgggcatggaggaacagatggactttcgctgaatgctttcgatgaacgaggcactgcggtcagcacttcacgtcttgataaactgcttgatgctggtctctatactggagaagtgactgaaattgtaggaggcccaggtagcggcaaaactcaggtatgtctctgtatggcagcaaatgtggcccatggcctgcagcaaaacgtcctatatgtagattccaatggagggctgacagcttcccgcctcctccagctgcttcaggctaaaacccaggatgaggaggaacaggcagaagctctccggaggatccaggtggtgcatgcatttgacatcttccagatgctggatgtgctgcaggagctccgaggcactgtggcccagcaggtgagcctgctgttctgcccctccttgcttaattcagctttctaggtgctatctctgtgggcaggtgtcctactacagactgtttggaaatgcagatgtgcaatctggtgactccaactatgcttgctactcccaggatggaattcccgagcacctaaatcacatacctcattgtttacatgttcatcttccctgctgaacagtaaagccccctgagtggaaggatcatgtcatatttatgtctgcattccccactaggtgactggttcttcaggaactgtgaaggtggtggttgtggactcggtcactgcggtggtttccccacttctgggaggtcagcagagggaaggcttggccttgatgatgcagctggcccgagagctgaagaccctggcccgggaccttggcatggcagtggtggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacagattttatcatgtgggcaacctgctgcaactggttctgcctggatggacagcctgaggaggtcccaccaccccagggagccaggatgcaggcctattccaaccctgggtacagctccttcccttccccaacaggcttggaaccaagctgcaagtcctgtggggctcactttgcaaacacggccaggaagcagacctgcttggactgtaagaaaaatttttgcatgacctgttcgagccaagtagggaatgggccccgcctctgccttctctgccaacggtttcgagctacagcctttcagcgagaggagctcatgaagatgaaggtgaaggacttgagggactatctcagcctccatgacatctctaccgaaatgtgccgggagaaagaagagctggtgctcttggtccttggccagcagcctgtaatctcccaggaggacaggactcgtgcctccaccttgtccccagactttcctgagcagcaggccttcctgacccagcctcactccagcatggttccacctacctcacccaacctcccctcttcatctgcacaagccacctctgttcccccagcccaggttcaggagaatcagcagggccaatggccatgtgtctcaggatcaagaggaacccgtctacctggagagcgtggccagagtacctgctgaggatgagacccagtctattgactcagaggacagctttgtcccaggccgaagggcctctctgtctgacctgactgacctggaggacattgaaggcctgacagtgcggcagctgaaagagatcttggctcgcaactttgtcaactacaagggctgctgtgagaagtgggagctgatggagagagtgacccggctatacaaggatcagaaaggactccagcacctggtcagtggtgccgaagaccaaaacgggggagcagtaccatcaggcttggaggagaacctgtgtaagatctgcatggactcacccattgactgtgttcttctggagtgtggccacatggtaacctgtaccaagtgtggcaagcgcatgaatgaatgtcccatctgccggcagtatgtaatccgagctgtgcatgtcttccggtcctgagagcttgcatcggtttcttcagtgccttacagggaaatagcctggggtgtctgggctcagggttggccagcttgcagaggagcaagctagtagaaatattgcagggttcccaaaaccaggtcaagcaagatgccatgtcacccctgagcatgcctgtcttcccaggggtgtacctcttggctggcaaagcccaaggccagtgggaacttgtagtgttcttcaagagtggagacaatgctgtggaacaaagcaggctttcacaaaatgttttcaaacaaaccgtttgtctacagcactggacagcagtgaatgtatacacagggaaaataaaggggatgaggcccttttgtttctgaaacatttccccctccgggtaccga

SEQ ID NO: 313713 - DNA, 3053 bp, Homo sapiens
ctggaacccggaagcggcagcgcggcgcgacccggcgggcgggctctgggcgcgggaatcccggcggatcccgggcgggcggatgacccccagccctacccttggtgccgcctcctcctctctcctttctcctccggcagccagcgcgcctgtgtcctctctaggaaggggtaggggaggggcgtctggagaggaccccccgcgaatgcccacgtgacgtgcagtccccctggggctgttccggcctgcggggaacatgggcgtgctcagggtcggactgtgccctggccttaccgaggagatgatccagcttctcaggagccacaggatcaagacagtggtggacctggtttctgcagacctggaagaggtagctcagaaatgtggcttgtcttacaaggccctggttgccctgaggcgggtgctgctggctcagttctcggctttccccgtgaatggcgctgatctctacgaggaactgaagacctccactgccatcctgtccactggcattggcagacatggagggcgcactcaagtgggaacctgggaggactgcagctgcctcaggtccccgcagggagatcgtggagtggggtcaggaatgctctgaagaaggcaggacttgggcatggaggaacagatggactttcgctgaatgctttcgatgaacgaggcactgcggtcagcacttcacgtcttgataaactgcttgatgctggtctctatactggagaagtgactgaaattgtaggaggcccaggtagcggcaaaactcaggtatgtctctgtatggcagcaaatgtggcccatggcctgcagcaaaacgtcctatatgtagattccaatggagggctgacagcttcccgcctcctccagctgcttcaggctaaaacccaggatgaggaggaacaggcagaagctctccggaggatccaggtggtgcatgcatttgacatcttccagatgctggatgtgctgcaggagctccgaggcactgtggcccagcaggtgagcctgctgttctgcccctccttgcttaattcagctttctaggtgctatctctgtgggcaggtgtcctactacagactgtttggaaatgcagatgtgcaatctggtgactccaactatgcttgctactcccaggatggaattcccgagcacctaaatcacatacctcattgtttacatgttcatcttccctgctgaacagtaaagccccctgagtggaaggatcatgtcatatttatgtctgcattccccactaggtgactggttcttcaggaactgtgaaggtggtggttgtggactcggtcactgcggtggtttccccacttctgggaggtcagcagagggaaggcttggccttgatgatgcagctggcccgagagctgaagaccctggcccgggaccttggcatggcagtggtggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacagattttatcatgtgggcaacctgctgcaactggttctgcctggatggacagcctgaggaggtcccaccaccccagggagccaggatgcaggcctattccaaccctgggtacagctccttcccttccccaacaggcttggaaccaagctgcaagtcctgtggggctcactttgcaaacacggccaggaagcagacctgcttggactgtaagaaaaatttttgcatgacctgttcgagccaagtagggaatgggccccgcctctgccttctctgccaacggtttcgagctacagcctttcagcgagaggagctcatgaagatgaaggtgaaggacttgagggactatctcagcctccatgacatctctaccgaaatgtgccgggagaaagaagagctggtgctcttggtccttggccagcagcctgtaatctcccaggaggacaggactcgtgcctccaccttgtccccagactttcctgagcagcaggccttcctgacccagcctcactccagcatggttccacctacctcacccaacctcccctcttcatctgcacaagccacctctgttcccccagcccaggttcaggagaatcagcagggccaatggccatgtgtctcaggatcaagaggaacccgtctacctggagagcgtggccagagtacctgctgaggatgagacccagtctattgactcagaggacagctttgtcccaggccgaagggcctctctgtctgacctgactgacctggaggacattgaaggcctgacagtgcggcagctgaaagagatcttggctcgcaactttgtcaactacaagggctgctgtgagaagtgggagctgatggagagagtgacccggctatacaaggatcagaaaggactccagcacctggggggagcagtaccatcaggcttggaggagaacctgtgtaagatctgcatggactcacccattgactgtgttcttctggagtgtggccacatggtaacctgtaccaagtgtggcaagcgcatgaatgaatgtcccatctgccggcagtatgtaatccgagctgtgcatgtcttccggtcctgagagcttgcatcggtttcttcagtgccttacagggaaatagcctggggtgtctgggctcagggttggccagcttgcagaggagcaagctagtagaaatattgcagggttcccaaaaccaggtcaagcaagatgccatgtcacccctgagcatgcctgtcttcccaggggtgtacctcttggctggcaaagcccaaggccagtgggaacttgtagtgttcttcaagagtggagacaatgctgtggaacaaagcaggctttcacaaaatgttttcaaacaaaccgtttgtctacagcactggacagcagtgaatgtatacacagggaaaataaaggggatgaggcccttttgtttctgaaacatttccccctccgggtaccga

SEQ ID NO: 313714 - DNA, 1346 bp, Homo sapiens
ctggaacccggaagcggcagcgcggcgcgacccggcgggcgggctctgggcgcgggaatcccggcggatcccgggcgggcggatgacccccagccctacccttggtgccgcctcctcctctctcctttctcctccggcagccagcgcgcctgtgtcctctctaggaaggggtaggggaggggcgtctggagaggaccccccgcgaatgcccacgtgacgtgcagtccccctggggctgttccggcctgcggggaacatgggcgtgctcagggtcggactgtgccctggccttaccgaggagatgatccagcttctcaggagccacaggatcaagacagtggtggacctggtttctgcagacctggaagaggtagctcagaaatgtggcttgtcttacaaggccctggttgccctgaggcgggtgctgctggctcagttctcggctttccccgtgaatggcgctgatctctacgaggaactgaagacctccactgccatcctgtccactggcattggcaggtatgtctctgtatggcagcaaatgtggcccatggcctgcagcaaaacgtcctatatgtagattccaatggagggctgacagcttcccgcctcctccagctgcttcaggctaaaacccaggatgaggaggaacaggcagaagctctccggaggatccaggtggtgcatgcatttgacatcttccagatgctggatgtgctgcaggagctccgaggcactgtggcccagcaggtgactggttcttcaggaactgtgaaggtggtggttgtggactcggtcactgcggtggtttccccacttctgggaggtcagcagagggaaggcttggccttgatgatgcagctggcccgagagctgaagaccctggcccgggaccttggcatggcagtggtggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacagccaacaggtttccaggagatggtagacattgggacctgggggacctcagagcagagtgccacattacagggtgatcagacatgacctgtgctgttgtttgggaaacagggaagcattggggacccctcccaacttttcttcccagtaacgcctgctgtttactgccacctggcactggtgactacagacgttctcaggctggccagaagagacatcttgggttccttggcctcactctctgtaagcatataaaccacaggcgaaagagg

SEQ ID NO: 313715 - DNA, 636 bp, Homo sapiens
cttggcctcactctctgtaagcatataaaccacaggcgaaagaggatgctgcattgcgaggacccagaaattcatactggtgccacgtttccttcccttatttctaacgtgtatgtttctggtggaaacagggaagcattggggacccctcccaacttttcttcccagtaacgcctgctgtttactgccacctggcactggtgactacagacgttctcaggctggccagaagagacatcttgggttccttggcctcactctctgtaagcatataaaccacaggcgaaagaggatgctgcattgcgaggacccagaaattcatactggtgccacgtttccttcccttatttctaacgtgtatgtttctggtggaaaccaagttcaccctggctgggagcatctctgatgaggcatgctggcgactggatggataatcctgtgcatcaccattgtgtcctgtgctccctcctagcgcagtggccaagccgggaaagcctctaacttgcctttgctgctgctgccttttttttcttttgtctctgcctttccatttgttagatgggggcccactcttccttagctctgtctctgagttactgggtggaaataagcttataaatgaaatactcttcttca

SEQ ID NO: 313716 - DNA, 674 bp, Homo sapiens
aactaaagaagctacccacttgggttgcttaactccactgactccttacttcttcttccagccaacaggtttccaggagatggtagacattgggacctgggggacctcagagcagagtgccacattacagggtgatcagacatgacctgtgctgttgtttgggaaacagggaagcattggggacccctcccaacttttcttcccagtaacgcctgctgtttactgccacctggcactggtgactacagacgttctcaggctggccagaagagacatcttgggttccttggcctcactctctgtaagcatataaaccacaggcgaaagaggatgctgcattgcgaggacccagaaattcatactggtgccacgtttccttcccttatttctaacgtgtatgtttctggtggaaaccaagttcaccctggctgggagcatctctgatgaggcatgctggcgactggatggataatcctgtgcatcaccattgtgtcctgtgctccctcctagcgcagtggccaagccgggaaagcctctaacttgcctttgctgctgctgccttttttttcttttgtctctgcctttccatttgttagatgggggcccactcttccttagctctgtctctgagttactgggtggaaataagcttataaatgaaatactcttcttca

SEQ ID NO: 313717 - DNA, 743 bp, Homo sapiens
ccccccccccccccccttttggggttgggggggggaaaaaaacaacaaccccccccaatttaccccggcggaaggagcaggagcatcaggcggccggcgcatggcgtgtctggccaaatcttcccgacagccaacaggtttccaggagatggtagacattgggacctgggggacctcagagcagagtgccacattacagggtgatcagacatgacctgtgctgttgtttgggaaacagggaagcattggggacccctcccaacttttcttcccagtaacgcctgctgtttactgccacctggcactggtgactacagacgttctcaggctggccagaagagacatcttgggttccttggcctcactctctgtaagcatataaaccacaggcgaaagaggatgctgcattgcgaggacccagaaattcatactggtgccacgtttccttcccttatttctaacgtgtatgtttctggtggaaaccaagttcaccctggctgggagcatctctgatgaggcatgctggcgactggatggataatcctgtgcatcaccattgtgtcctgtgctccctcctagcgcagtggccaagccgggaaagcctctaacttgcctttgctgctgctgccttttttttcttttgtctctgcctttccatttgttagatgggggcccactcttccttagctctgtctctgagttactgggtggaaataagcttataaatgaaatactcttcttca

SEQ ID NO: 313718 - DNA, 738 bp, Homo sapiens
aaaaaaaaaaaccccccccaaaaaaaccccccccccctaaattttccccggggaaggggggggggaaaagagcaggagcatcaggcggccggcgcatggcgtgtctggccaaatcttcccgacagccaacaggtttccaggagatggtagacattgggacctgggggacctcagagcagagtgccacattacagggtgatcagacatgacctgtgctgttgtttgggaaacagggaagcattggggacccctcccaacttttcttcccagtaacgcctgctgtttactgccacctggcactggtgactacagacgttctcaggctggccagaagagacatcttgggttccttggcctcactctctgtaagcatataaaccacaggcgaaagaggatgctgcattgcgaggacccagaaattcatactggtgccacgtttccttcccttatttctaacgtgtatgtttctggtggaaaccaagttcaccctggctgggagcatctctgatgaggcatgctggcgactggatggataatcctgtgcatcaccattgtgtcctgtgctccctcctagcgcagtggccaagccgggaaagcctctaacttgcctttgctgctgctgccttttttttcttttgtctctgcctttccatttgttagatgggggcccactcttccttagctctgtctctgagttactgggtggaaataagcttataaatgaaatactcttcttca

SEQ ID NO: 313719 - DNA, 2622 bp, Homo sapiens
ctggaacccggaagcggcagcgcggcgcgacccggcgggcgggctctgggcgcgggaatcccggcggatcccgggcgggcggatgacccccagccctacccttggtgccgcctcctcctctctcctttctcctccggcagccagcgcgcctgtgtcctctctaggaaggggtaggggaggggcgtctggagaggaccccccgcgaatgcccacgtgacgtgcagtccccctggggctgttccggcctgcggggaacatgggcgtgctcagggtcggactgtgccctggccttaccgaggagatgatccagcttctcaggagccacaggatcaagacagtggtggacctggtttctgcagacctggaagaggtagctcagaaatgtggcttgtcttacaaggccctggttgccctgaggcgggtgctgctggctcagttctcggctttccccgtgaatggcgctgatctctacgaggaactgaagacctccactgccatcctgtccactggcattggcagacatggagggcgcactcaagtgggaacctgggaggactgcagctgcctcaggtccccgcagggagatcgtggagtggggtcaggaatgctctgaagaaggcaggacttgggcatggaggaacagatggactttcgctgaatgctttcgatgaacgaggcactgcggtcagcacttcacgtcttgataaactgcttgatgctggtctctatactggagaagtgactgaaattgtaggaggcccaggtagcggcaaaactcaggtatgtctctgtatggcagcaaatgtggcccatggcctgcagcaaaacgtcctatatgtagattccaatggagggctgacagcttcccgcctcctccagctgcttcaggctaaaacccaggatgaggaggaacaggcagaagctctccggaggatccaggtggtgcatgcatttgacatcttccagatgctggatgtgctgcaggagctccgaggcactgtggcccagcaggtgagcctgctgttctgcccctccttgcttaattcagctttctaggtgctatctctgtgggcaggtgtcctactacagactgtttggaaatgcagatgtgcaatctggtgactccaactatgcttgctactcccaggatggaattcccgagcacctaaatcacatacctcattgtttacatgttcatcttccctgctgaacagtaaagccccctgagtggaaggatcatgtcatatttatgtctgcattccccactaggtgactggttcttcaggaactgtgaaggtggtggttgtggactcggtcactgcggtggtttccccacttctgggaggtcagcagagggaaggcttggccttgatgatgcagctggcccgagagctgaagaccctggcccgggaccttggcatggcagtggtggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacagattttatcatgtgggcaacctgctgcaactggttctgcctggatggacagcctgaggaggtcccaccaccccagggagccaggatgcaggcctattccaaccctgggtacagctccttcccttccccaacaggcttggaaccaagctgcaagtcctgtggggctcactttgcaaacacggccaggaagggccaatggccatgtgtctcaggatcaagaggaacccgtctacctggagagcgtggccagagtacctgctgaggatgagacccagtctattgactcagaggacagctttgtcccaggccgaagggcctctctgtctgacctgactgacctggaggacattgaaggcctgacagtgcggcagctgaaagagatcttggctcgcaactttgtcaactacaagggctgctgtgagaagtgggagctgatggagagagtgacccggctatacaaggatcagaaaggactccagcacctggtcagtggtgccgaagaccaaaacgggggagcagtaccatcaggcttggaggagaacctgtgtaagatctgcatggactcacccattgactgtgttcttctggagtgtggccacatggtaacctgtaccaagtgtggcaagcgcatgaatgaatgtcccatctgccggcagtatgtaatccgagctgtgcatgtcttccggtcctgagagcttgcatcggtttcttcagtgccttacagggaaatagcctggggtgtctgggctcagggttggccagcttgcagaggagcaagctagtagaaatattgcagggttcccaaaaccaggtcaagcaagatgccatgtcacccctgagcatgcctgtcttcccaggggtgtacctcttggctggcaaagcccaaggccagtgggaacttgtataaatcacatgggtatgttcttggttcagtgatcttggagtgatgatggtaactgatgaacagagaactttccagaacttgggtcctgtcttcctccctgaacctagacagtttcacccctcct

SEQ ID NO: 313720 - DNA, 764 bp, Homo sapiens
ctggaacccggaagcggcagcgcggcgcgacccggcgggcgggctctgggcgcgggaatcccggcggatcccgggcgggcggatgacccccagccctacccttggtgccgcctcctcctctctcctttctcctccggcagccagcgcgcctgtgtcctctctaggaaggggtaggggaggggcgtctggagaggaccccccgcgaatgcccacgtgacgtgcagtccccctggggctgttccggcctgcggggaacatgggcgtgctcagggtcggactgtgccctggccttaccgaggagatgatccagcttctcaggagccacaggatcaagacagtggtggacctggtttctgcagacctggaagaggtagctcagaaatgtggcttgtcttacaaggccctggttgccctgaggcgggtgctgctggctcagttctcggctttccccgtgaatggcgctgatctctacgaggaactgaagacctccactgccatcctgtccactggcattggcaggtttgtgtgtgtacttggggaagaaggagagaggcaggaggatggggcctcctctcagctctgcttttgatgcttgagtctagacgggaggggtttttttttaaccaataatggatgggaaggaaaggggtcaggacatctgaattcttatcctataacagggttatggggtatctcagccttggcactattgatatttagggacaggtaattatttgttggggggtgtaggctatcagcgcttt

SEQ ID NO: 313721 - DNA, 129 bp, Homo sapiens
tgggtttcagttgaaataaggttttagctttatttgtgagtaaatcagtagaatactggatgttaggatgcatctctccactttattataaataatgcaaggctgattttatgatgtgatctcttgcag

SEQ ID NO: 313722 - DNA, 848 bp, Homo sapiens
ctggaacccggaagcggcagcgcggcgcgacccggcgggcgggctctgggcgcgggaatcccggcggatcccgggcgggcggatgacccccagccctacccttggtgccgcctcctcctctctcctttctcctccggcagccagcgcgcctgtgtcctctctaggaagggtggtggacctggtttctgcagacctggaagaggtagctcagaaatgtggcttgtcttacaaggccctggttgccctgaggcgggtgctgctggctcagttctcggctttccccgtgaatggcgctgatctctacgaggaactgaagacctccactgccatcctgtccactggcattggcagtcttgataaactgcttgatgctggtctctatactggagaagtgactgaaattgtaggaggcccaggtagcggcaaaactcaggtatgtctctgtatggcagcaaatgtggcccatggcctgcagcaaaacgtcctatatgtagattccaatggagggctgacagcttcccgcctcctccagctgcttcaggctaaaacccaggatgaggaggaacaggcagaagctctccggaggatccaggtggtgcatgcatttgacatcttccagatgctggatgtgctgcaggagctccgaggcactgtggcccagcaggtgactggttcttcaggaactgtgaaggtggtggttgtggactcggtcactgcggtggtttccccacttctgggaggtcagcagagggaaggcttggccttgatgatgcagctggcccgagagctgaagaccctggcccgggaccttggcatggcagtggtggtgaggaagcaggcttggccaa

SEQ ID NO: 313723 - DNA, 1696 bp, Homo sapiens
cggtgtgtgtgttgcggcagaagccagcgcgcctgtgtcctctctaggaaggggtaggggaggggcgtctggagaggaccccccgcgaatgcccacgtgacgtgcagtccccctggggctgttccggcctgcggggaacatgggcgtgctcagggtcggactgtgccctggccttaccgaggagatgatccagcttctcaggagccacaggatcaagacagtggtggacctggtttctgcagacctggaagaggtagctcagaaatgtggcttgtcttacaaggccctggttgccctgaggcgggtgctgctggctcagttctcggctttccccgtgaatggcgctgatctctacgaggaactgaagacctccactgccatcctgtccactggcattggcagtcttgataaactgcttgatgctggtctctatactggagaagtgactgaaattgtaggaggcccaggtagcggcaaaactcaggtatgtctctgtatggcagcaaatgtggcccatggcctgcagcaaaacgtcctatatgtagattccaatggagggctgacagcttcccgcctcctccagctgcttcaggctaaaacccaggatgaggaggaacaggcagaagctctccggaggatccaggtggtgcatgcatttgacatcttccagatgctggatgtgctgcaggagctccgaggcactgtggcccagcaggtgactggttcttcaggaactgtgaaggtggtggttgtggactcggtcactgcggtggtttccccacttctgggaggtcagcagagggaaggcttggccttgatgatgcagctggcccgagagctgaagaccctggcccgggaccttggcatggcagtggtggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacagccaacaggtttccaggagatggtagacattgggacctgggggacctcagagcagagtgccacattacagggtgatcagacatgacctgtgctgttgtttgggaaacagggaagcattggggacccctcccaacttttcttcccagtaacgcctgctgtttactgccacctggcactggtgactacagacgttctcaggctggccagaagagacatcttgggttccttggcctcactctctgtaagcatataaaccacaggcgaaagaggatgctgcattgcgaggacccagaaattcatactggtgccacgtttccttcccttatttctaacgtgtatgtttctggtggaaaccaagttcaccctggctgggagcatctctgatgaggcatgctggcgactggatggataatcctgtgcatcaccattgtgtcctgtgctccctcctagcgcagtggccaagccgggaaagcctctaacttgcctttgctgctgctgccttttttttcttttgtctctgcctttccatttgttagatgggggcccactcttccttagctctgtctctgagttactgggtggaaataagcttataaatgaaatactcttcttcatctctgttttgctcttaaaaatataaaaaggcaattccccg

SEQ ID NO: 313724 - DNA, 1813 bp, Homo sapiens
ctggaacccggaagcggcagcgcggcgcgacccggcgggcgggctctgggcgcgggaatcccggcggatcccgggcgggcggatgacccccagccctacccttggtgccgcctcctcctctctcctttctcctccggcagccagcgcgcctgtgtcctctctaggaaggggtaggggaggggcgtctggagaggaccccccgcgaatgcccacgtgacgtgcagtccccctggggctgttccggcctgcggggaacatgggcgtgctcagggtcggactgtgccctggccttaccgaggagatgatccagcttctcaggagccacaggatcaagacagtggtggacctggtttctgcagacctggaagaggtagctcagaaatgtggcttgtcttacaaggccctggttgccctgaggcgggtgctgctggctcagttctcggctttccccgtgaatggcgctgatctctacgaggaactgaagacctccactgccatcctgtccactggcattggcagtcttgataaactgcttgatgctggtctctatactggagaagtgactgaaattgtaggaggcccaggtagcggcaaaactcaggtatgtctctgtatggcagcaaatgtggcccatggcctgcagcaaaacgtcctatatgtagattccaatggagggctgacagcttcccgcctcctccagctgcttcaggctaaaacccaggatgaggaggaacaggcagaagctctccggaggatccaggtggtgcatgcatttgacatcttccagatgctggatgtgctgcaggagctccgaggcactgtggcccagcaggtgactggttcttcaggaactgtgaaggtggtggttgtggactcggtcactgcggtggtttccccacttctgggaggtcagcagagggaaggcttggccttgatgatgcagctggcccgagagctgaagaccctggcccgggaccttggcatggcagtggtggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacagccaacaggtttccaggagatggtagacattgggacctgggggacctcagagcagagtgccacattacagggtgatcagacatgacctgtgctgttgtttgggaaacagggaagcattggggacccctcccaacttttcttcccagtaacgcctgctgtttactgccacctggcactggtgactacagacgttctcaggctggccagaagagacatcttgggttccttggcctcactctctgtaagcatataaaccacaggcgaaagaggatgctgcattgcgaggacccagaaattcatactggtgccacgtttccttcccttatttctaacgtgtatgtttctggtggaaaccaagttcaccctggctgggagcatctctgatgaggcatgctggcgactggatggataatcctgtgcatcaccattgtgtcctgtgctccctcctagcgcagtggccaagccgggaaagcctctaacttgcctttgctgctgctgccttttttttcttttgtctctgcctttccatttgttagatgggggcccactcttccttagctctgtctctgagttactgggtggaaataagcttataaatgaaatactcttcttcatctctgttttgctcttaaaaatataaaaaggcaattccccg

SEQ ID NO: 313725 - DNA, 3033 bp, Homo sapiens
ctggaacccggaagcggcagcgcggcgcgacccggcgggcgggctctgggcgcgggaatcccggcggatcccgggcgggcggatgacccccagccctacccttggtgccgcctcctcctctctcctttctcctccggcagccagcgcgcctgtgtcctctctaggaaggggtaggggaggggcgtctggagaggaccccccgcgaatgcccacgtgacgtgcagtccccctggggctgttccggcctgcggggaacatgggcgtgctcagggtcggactgtgccctggccttaccgaggagatgatccagcttctcaggagccacaggatcaagacagtggtggacctggtttctgcagacctggaagaggtagctcagaaatgtggcttgtcttacaaggccctggttgccctgaggcgggtgctgctggctcagttctcggctttccccgtgaatggcgctgatctctacgaggaactgaagacctccactgccatcctgtccactggcattggcagacatggagggcgcactcaagtgggaacctgggaggactgcagctgcctcaggtccccgcagggagatcgtggagtggggtcaggaatgctctgaagaaggcaggacttgggcatggaggaacagatggactttcgctgaatgctttcgatgaacgaggcactgcggtcagcacttcacgtcttgataaactgcttgatgctggtctctatactggagaagtgactgaaattgtaggaggcccaggtagcggcaaaactcaggtatgtctctgtatggcagcaaatgtggcccatggcctgcagcaaaacgtcctatatgtagattccaatggagggctgacagcttcccgcctcctccagctgcttcaggctaaaacccaggatgaggaggaacaggcagaagctctccggaggatccaggtggtgcatgcatttgacatcttccagatgctggatgtgctgcaggagctccgaggcactgtggcccagcaggtgagcctgctgttctgcccctccttgcttaattcagctttctaggtgctatctctgtgggcaggtgtcctactacagactgtttggaaatgcagatgtgcaatctggtgactccaactatgcttgctactcccaggatggaattcccgagcacctaaatcacatacctcattgtttacatgttcatcttccctgctgaacagtaaagccccctgagtggaaggatcatgtcatatttatgtctgcattccccactaggtgactggttcttcaggaactgtgaaggtggtggttgtggactcggtcactgcggtggtttccccacttctgggaggtcagcagagggaaggcttggccttgatgatgcagctggcccgagagctgaagaccctggcccgggaccttggcatggcagtggtggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacagattttatcatgtgggcaacctgctgcaactggttctgcctggatggacagcctgaggaggtcccaccaccccagggagccaggatgcaggcctattccaaccctgggtacagctccttcccttccccaacaggcttggaaccaagctgcaagtcctgtggggctcactttgcaaacacggccaggaagcagacctgcttggactgtaagaaaaatttttgcatgacctgttcgagccaagtagggaatgggccccgcctctgccttctctgccaacggtttcgagctacagcctttcagcgagaggagctcatgaagatgaaggtgaaggacttgagggactatctcagcctccatgacatctctaccgaaatgtgccgggagaaagaagagctggtgctcttggtccttggccagcagcctgtaatctcccaggaggacaggactcgtgcctccaccttgtccccagactttcctgagcagcaggccttcctgacccagcctcactccagcatggttccacctacctcacccaacctcccctcttcatctgcacaagccacctctgttcccccagcccaggttcaggagaatcagcagggccaatggccatgtgtctcaggatcaagaggaacccgtctacctggagagcgtggccagagtacctgctgaggatgagacccagtctattgactcagaggacagctttgtcccaggccgaagggcctctctgtctgacctgactgacctggaggacattgaaggcctgacagtgcggcagctgaaagagatcttggctcgcaactttgtcaactacaagggctgctgtgagaagtgggagctgatggagagagtgacccggctatacaaggatcagaaaggactccagcacctggtcagtggtgccgaagaccaaaacgggggagcagtaccatcaggcttggaggagaacctgtgtaagatctgcatggactcacccattgactgtgttcttctggagtgtggccacatggtaacctgtaccaagtgtggcaagcgcatgaatgaatgtcccatctgccggcagtatgtaatccgagctgtgcatgtcttccggtcctgagagcttgcatcggtttcttcagtgccttacagggaaatagcctggggtgtctgggctcagggttggccagcttgcagaggagcaagctagtagaaatattgcagggttcccaaaaccaggtcaagcaagatgccatgtcacccctgagcatgcctgtcttcccaggggtgtacctcttggctggcaaagcccaaggccagtgggaacttgtataaatcacatgggtatgttcttggttcagtgatcttggagtgatgatggtaactgatgaacagagaactttccagaacttgggtcctgtcttcctccctgaacctagacagtttcacccctcct

SEQ ID NO: 313726 - DNA, 2816 bp, Homo sapiens
ctggaacccggaagcggcagcgcggcgcgacccggcgggcgggctctgggcgcgggaatcccggcggatcccgggcgggcggatgacccccagccctacccttggtgccgcctcctcctctctcctttctcctccggcagccagcgcgcctgtgtcctctctaggaaggggtaggggaggggcgtctggagaggaccccccgcgaatgcccacgtgacgtgcagtccccctggggctgttccggcctgcggggaacatgggcgtgctcagggtcggactgtgccctggccttaccgaggagatgatccagcttctcaggagccacaggatcaagacagtggtggacctggtttctgcagacctggaagaggtagctcagaaatgtggcttgtcttacaaggccctggttgccctgaggcgggtgctgctggctcagttctcggctttccccgtgaatggcgctgatctctacgaggaactgaagacctccactgccatcctgtccactggcattggcagacatggagggcgcactcaagtgggaacctgggaggactgcagctgcctcaggtccccgcagggagatcgtggagtggggtcaggaatgctctgaagaaggcaggacttgggcatggaggaacagatggactttcgctgaatgctttcgatgaacgaggcactgcggtcagcacttcacggcagaagctctccggaggatccaggtggtgcatgcatttgacatcttccagatgctggatgtgctgcaggagctccgaggcactgtggcccagcaggtgagcctgctgttctgcccctccttgcttaattcagctttctaggtgctatctctgtgggcaggtgtcctactacagactgtttggaaatgcagatgtgcaatctggtgactccaactatgcttgctactcccaggatggaattcccgagcacctaaatcacatacctcattgtttacatgttcatcttccctgctgaacagtaaagccccctgagtggaaggatcatgtcatatttatgtctgcattccccactaggtgactggttcttcaggaactgtgaaggtggtggttgtggactcggtcactgcggtggtttccccacttctgggaggtcagcagagggaaggcttggccttgatgatgcagctggcccgagagctgaagaccctggcccgggaccttggcatggcagtggtggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacagattttatcatgtgggcaacctgctgcaactggttctgcctggatggacagcctgaggaggtcccaccaccccagggagccaggatgcaggcctattccaaccctgggtacagctccttcccttccccaacaggcttggaaccaagctgcaagtcctgtggggctcactttgcaaacacggccaggaagcagacctgcttggactgtaagaaaaatttttgcatgacctgttcgagccaagtagggaatgggccccgcctctgccttctctgccaacggtttcgagctacagcctttcagcgagaggagctcatgaagatgaaggtgaaggacttgagggactatctcagcctccatgacatctctaccgaaatgtgccgggagaaagaagagctggtgctcttggtccttggccagcagcctgtaatctcccaggaggacaggactcgtgcctccaccttgtccccagactttcctgagcagcaggccttcctgacccagcctcactccagcatggttccacctacctcacccaacctcccctcttcatctgcacaagccacctctgttcccccagcccaggttcaggagaatcagcagggccaatggccatgtgtctcaggatcaagaggaacccgtctacctggagagcgtggccagagtacctgctgaggatgagacccagtctattgactcagaggacagctttgtcccaggccgaagggcctctctgtctgacctgactgacctggaggacattgaaggcctgacagtgcggcagctgaaagagatcttggctcgcaactttgtcaactacaagggctgctgtgagaagtgggagctgatggagagagtgacccggctatacaaggatcagaaaggactccagcacctggtcagtggtgccgaagaccaaaacgggggagcagtaccatcaggcttggaggagaacctgtgtaagatctgcatggactcacccattgactgtgttcttctggagtgtggccacatggtaacctgtaccaagtgtggcaagcgcatgaatgaatgtcccatctgccggcagtatgtaatccgagctgtgcatgtcttccggtcctgagagcttgcatcggtttcttcagtgccttacagggaaatagcctggggtgtctgggctcagggttggccagcttgcagaggagcaagctagtagaaatattgcagggttcccaaaaccaggtcaagcaagatgccatgtcacccctgagcatgcctgtcttcccaggggtgtacctcttggctggcaaagcccaaggccagtgggaacttgtataaatcacatgggtatgttcttggttcagtgatcttggagtgatgatggtaactgatgaacagagaactttccagaacttgggtcctgtcttcctccctgaacctagacagtttcacccctcct

SEQ ID NO: 313727 - DNA, 2477 bp, Homo sapiens
ctggaacccggaagcggcagcgcggcgcgacccggcgggcgggctctgggcgcgggaatcccggcggatcccgggcgggcggatgacccccagccctacccttggtgccgcctcctcctctctcctttctcctccggcagccagcgcgcctgtgtcctctctaggaaggggtaggggaggggcgtctggagaggaccccccgcgaatgcccacgtgacgtgcagtccccctggggctgttccggcctgcggggaacatgggcgtgctcagggtcggactgtgccctggccttaccgaggagatgatccagcttctcaggagccacaggatcaagacagtggtggacctggtttctgcagacctggaagaggtagctcagaaatgtggcttgtcttacaagtcttgataaactgcttgatgctggtctctatactggagaagtgactgaaattgtaggaggcccaggtagcggcaaaactcaggtatgtctctgtatggcagcaaatgtggcccatggcctgcagcaaaacgtcctatatgtagattccaatggagggctgacagcttcccgcctcctccagctgcttcaggctaaaacccaggatgaggaggaacaggcagaagctctccggaggatccaggtggtgcatgcatttgacatcttccagatgctggatgtgctgcaggagctccgaggcactgtggcccagcaggtgactggttcttcaggaactgtgaaggtggtggttgtggactcggtcactgcggtggtttccccacttctgggaggtcagcagagggaaggcttggccttgatgatgcagctggcccgagagctgaagaccctggcccgggaccttggcatggcagtggtggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacagattttatcatgtgggcaacctgctgcaactggttctgcctggatggacagcctgaggaggtcccaccaccccagggagccaggatgcaggcctattccaaccctgggtacagctccttcccttccccaacaggcttggaaccaagctgcaagtcctgtggggctcactttgcaaacacggccaggaagcagacctgcttggactgtaagaaaaatttttgcatgacctgttcgagccaagtagggaatgggccccgcctctgccttctctgccaacggtttcgagctacagcctttcagcgagaggagctcatgaagatgaaggtgaaggacttgagggactatctcagcctccatgacatctctaccgaaatgtgccgggagaaagaagagctggtgctcttggtccttggccagcagcctgtaatctcccaggaggacaggactcgtgcctccaccttgtccccagactttcctgagcagcaggccttcctgacccagcctcactccagcatggttccacctacctcacccaacctcccctcttcatctgcacaagccacctctgttcccccagcccaggttcaggagaatcagcagggccaatggccatgtgtctcaggatcaagaggaacccgtctacctggagagcgtggccagagtacctgctgaggatgagacccagtctattgactcagaggacagctttgtcccaggccgaagggcctctctgtctgacctgactgacctggaggacattgaaggcctgacagtgcggcagctgaaagagatcttggctcgcaactttgtcaactacaagggctgctgtgagaagtgggagctgatggagagagtgacccggctatacaaggatcagaaaggactccagcacctggtcagtggtgccgaagaccaaaacgggggagcagtaccatcaggcttggaggagaacctgtgtaagatctgcatggactcacccattgactgtgttcttctggagtgtggccacatggtaacctgtaccaagtgtggcaagcgcatgaatgaatgtcccatctgccggcagtatgtaatccgagctgtgcatgtcttccggtcctgagagcttgcatcggtttcttcagtgccttacagggaaatagcctggggtgtctgggctcagggttggccagcttgcagaggagcaagctagtagaaatattgcagggttcccaaaaccaggtcaagcaagatgccatgtcacccctgagcatgcctgtcttcccaggggtgtacctcttggctggcaaagcccaaggccagtgggaacttgtataaatcacatgggtatgttcttggttcagtgatcttggagtgatgatggtaactgatgaacagagaactttccagaacttgggtcctgtcttcctccctgaacctagacagtttcacccctcct

SEQ ID NO: 313728 - DNA, 2637 bp, Homo sapiens
ctggaacccggaagcggcagcgcggcgcgacccggcgggcgggctctgggcgcgggaatcccggcggatcccgggcgggcggatgacccccagccctacccttggtgccgcctcctcctctctcctttctcctccggcagccagcgcgcctgtgtcctctctaggaaggggtaggggaggggcgtctggagaggaccccccgcgaatgcccacgtgacgtgcagtccccctggggctgttccggcctgcggggaacatgggcgtgctcagggtcggactgtgccctggccttaccgaggagatgatccagcttctcaggagccacaggatcaagacagtggtggacctggtttctgcagacctggaagaggtagctcagaaatgtggcttgtcttacaaggccctggttgccctgaggcgggtgctgctggctcagttctcggctttccccgtgaatggcgctgatctctacgaggaactgaagacctccactgccatcctgtccactggcattggcaggcagaagctctccggaggatccaggtggtgcatgcatttgacatcttccagatgctggatgtgctgcaggagctccgaggcactgtggcccagcaggtgagcctgctgttctgcccctccttgcttaattcagctttctaggtgctatctctgtgggcaggtgtcctactacagactgtttggaaatgcagatgtgcaatctggtgactccaactatgcttgctactcccaggatggaattcccgagcacctaaatcacatacctcattgtttacatgttcatcttccctgctgaacagtaaagccccctgagtggaaggatcatgtcatatttatgtctgcattccccactaggtgactggttcttcaggaactgtgaaggtggtggttgtggactcggtcactgcggtggtttccccacttctgggaggtcagcagagggaaggcttggccttgatgatgcagctggcccgagagctgaagaccctggcccgggaccttggcatggcagtggtggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacagattttatcatgtgggcaacctgctgcaactggttctgcctggatggacagcctgaggaggtcccaccaccccagggagccaggatgcaggcctattccaaccctgggtacagctccttcccttccccaacaggcttggaaccaagctgcaagtcctgtggggctcactttgcaaacacggccaggaagcagacctgcttggactgtaagaaaaatttttgcatgacctgttcgagccaagtagggaatgggccccgcctctgccttctctgccaacggtttcgagctacagcctttcagcgagaggagctcatgaagatgaaggtgaaggacttgagggactatctcagcctccatgacatctctaccgaaatgtgccgggagaaagaagagctggtgctcttggtccttggccagcagcctgtaatctcccaggaggacaggactcgtgcctccaccttgtccccagactttcctgagcagcaggccttcctgacccagcctcactccagcatggttccacctacctcacccaacctcccctcttcatctgcacaagccacctctgttcccccagcccaggttcaggagaatcagcagggccaatggccatgtgtctcaggatcaagaggaacccgtctacctggagagcgtggccagagtacctgctgaggatgagacccagtctattgactcagaggacagctttgtcccaggccgaagggcctctctgtctgacctgactgacctggaggacattgaaggcctgacagtgcggcagctgaaagagatcttggctcgcaactttgtcaactacaagggctgctgtgagaagtgggagctgatggagagagtgacccggctatacaaggatcagaaaggactccagcacctggtcagtggtgccgaagaccaaaacgggggagcagtaccatcaggcttggaggagaacctgtgtaagatctgcatggactcacccattgactgtgttcttctggagtgtggccacatggtaacctgtaccaagtgtggcaagcgcatgaatgaatgtcccatctgccggcagtatgtaatccgagctgtgcatgtcttccggtcctgagagcttgcatcggtttcttcagtgccttacagggaaatagcctggggtgtctgggctcagggttggccagcttgcagaggagcaagctagtagaaatattgcagggttcccaaaaccaggtcaagcaagatgccatgtcacccctgagcatgcctgtcttcccaggggtgtacctcttggctggcaaagcccaaggccagtgggaacttgtataaatcacatgggtatgttcttggttcagtgatcttggagtgatgatggtaactgatgaacagagaactttccagaacttgggtcctgtcttcctccctgaacctagacagtttcacccctcct

SEQ ID NO: 313729 - DNA, 2184 bp, Homo sapiens
gaaaatcaagtgaatacaagagagctgtaagcaccgagggaggcaacggtaaggagggagtggtgaacaggaagccgattggccttgggcttagggagtttataaatccaacagacatggagggcgcactcaagtgggaacctgggaggactgcagctgcctcaggtccccgcagggagatcgtggagtggggtcaggaatgctctgaagaaggcaggacttgggcatggaggaacagatggactttcgctgaatgctttcgatgaacgaggcactgcggtcagcacttcacgtcttgataaactgcttgatgctggtctctatactggagaagtgactgaaattgtaggaggcccaggtagcggcaaaactcaggtatgtctctgtatggcagcaaatgtggcccatggcctgcagcaaaacgtcctatatgtagattccaatggagggctgacagcttcccgcctcctccagctgcttcaggctaaaacccaggatgaggaggaacaggcagaagctctccggaggatccaggtggtgcatgcatttgacatcttccagatgctggatgtgctgcaggagctccgaggcactgtggcccagcaggtgactggttcttcaggaactgtgaaggtggtggttgtggactcggtcactgcggtggtttccccacttctgggaggtcagcagagggaaggcttggccttgatgatgcagctggcccgagagctgaagaccctggcccgggaccttggcatggcagtggtggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacagccaacaggtttccaggagatggtagacattgggacctgggggacctcagagcagagtgccacattacagggtgatcagacatgacctgtgctgttgtttgggaaacagggaagcattggggacccctcccaacttttcttcccagtaacgcctgctgtttactgccacctggcactggtgactacagacgttctcaggctggccagaagagacatcttgggttccttggcctcactctctgtaagcatataaaccacaggcgaaagaggatgctgcattgcgaggacccagaaattcatactggtgccacgtttccttcccttatttctaacgtgtatgtttctggtggaaaccaagttcaccctggctgggagcatctctgatgaggcatgctggcgactggatggataatcctgtgcatcaccattgtgtcctgtgctccctcctagcgcagtggccaagccgggaaagcctctaacttgcctttgctgctgctgccttttttttcttttgtctctgcctttccatttgttagatgggggcccactcttccttagctctgtctctgagttactgggtggaaataagcttataaatgaaatactcttcttcatctctgttttgctcttaaaaatataaaaaggcaattccccgagccctagagccacctgatttccccttagaaggctgtttttcagtttcccccagtgaggcccaaagaacagtttattcctcctttcctcttgctgatttggtttcagacctgcctgcatcaccatgactaggtgagaacgtgtgggctcgctgcagttccagggatataatttaacagaaagggagggtatgacctgctcctggtgaatccagccactcatttaatatgcatggtgccctgtggggcccctccacagtacagcataaccagaggtgctgaaccatggccttgcccataaacagacagaggagaatttgcacagtaaatagagccagctgggaaaattgatgctgacgtaaataatacatggcaaatctagtcctttatgcagaaattcattgctggtggctccaagatgcaatataattacacctctcttcctgccagctgtaccacagctagtgccctagtgtatgaaataatccctctgtctttcaccagcactgtggccatccgtctgagagccatgaccctggctgggaggggacgaagacaccagggaatggaaaataaaaggaaaagtacagaaatgatca

SEQ ID NO: 313730 - DNA, 2260 bp, Homo sapiens
ctggaacccggaagcggcagcgcggcgcgacccggcgggcgggctctgggcgcgggaatcccggcggatcccgggcgggcggatgacccccagccctacccttggtgccgcctcctcctctctcctttctcctccggcagccagcgcgcctgtgtcctctctaggaaggggtaggggaggggcgtctggagaggaccccccgcgaatgcccacgtgacgtgcagtccccctggggctgttccggcctgcggggaacatgggcgtgctcagggtcggactgtgccctggccttaccgaggagatgatccagcttctcaggagccacaggatcaagacagtggtggacctggtttctgcagacctggaagaggtagctcagaaatgtggcttgtcttacaaggcagaagctctccggaggatccaggtggtgcatgcatttgacatcttccagatgctggatgtgctgcaggagctccgaggcactgtggcccagcaggtgactggttcttcaggaactgtgaaggtggtggttgtggactcggtcactgcggtggtttccccacttctgggaggtcagcagagggaaggcttggccttgatgatgcagctggcccgagagctgaagaccctggcccgggaccttggcatggcagtggtggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacagattttatcatgtgggcaacctgctgcaactggttctgcctggatggacagcctgaggaggtcccaccaccccagggagccaggatgcaggcctattccaaccctgggtacagctccttcccttccccaacaggcttggaaccaagctgcaagtcctgtggggctcactttgcaaacacggccaggaagcagacctgcttggactgtaagaaaaatttttgcatgacctgttcgagccaagtagggaatgggccccgcctctgccttctctgccaacggtttcgagctacagcctttcagcgagaggagctcatgaagatgaaggtgaaggacttgagggactatctcagcctccatgacatctctaccgaaatgtgccgggagaaagaagagctggtgctcttggtccttggccagcagcctgtaatctcccaggaggacaggactcgtgcctccaccttgtccccagactttcctgagcagcaggccttcctgacccagcctcactccagcatggttccacctacctcacccaacctcccctcttcatctgcacaagccacctctgttcccccagcccaggttcaggagaatcagcagggccaatggccatgtgtctcaggatcaagaggaacccgtctacctggagagcgtggccagagtacctgctgaggatgagacccagtctattgactcagaggacagctttgtcccaggccgaagggcctctctgtctgacctgactgacctggaggacattgaaggcctgacagtgcggcagctgaaagagatcttggctcgcaactttgtcaactacaagggctgctgtgagaagtgggagctgatggagagagtgacccggctatacaaggatcagaaaggactccagcacctggtcagtggtgccgaagaccaaaacgggggagcagtaccatcaggcttggaggagaacctgtgtaagatctgcatggactcacccattgactgtgttcttctggagtgtggccacatggtaacctgtaccaagtgtggcaagcgcatgaatgaatgtcccatctgccggcagtatgtaatccgagctgtgcatgtcttccggtcctgagagcttgcatcggtttcttcagtgccttacagggaaatagcctggggtgtctgggctcagggttggccagcttgcagaggagcaagctagtagaaatattgcagggttcccaaaaccaggtcaagcaagatgccatgtcacccctgagcatgcctgtcttcccaggggtgtacctcttggctggcaaagcccaaggccagtgggaacttgtataaatcacatgggtatgttcttggttcagtgatcttggagtgatgatggtaactgatgaacagagaactttccagaacttgggtcctgtcttcctccctgaacctagacagtttcacccctcct

SEQ ID NO: 313731 - DNA, 1648 bp, Homo sapiens
ctgcttacttacaaatgcaacagttgtcctattttatgctcattgtgttgtcaccagcattttaaatctttacaagtcagggtgggtacctcaggcaggtttgctggaaaattccagtaaacagtttcaaaggagttcaagttgcttgccagactaacttacttttaaaagtaagcagccttccaagttaagagatgattttaaatttcagattttatcatgtgggcaacctgctgcaactggttctgcctggatggacagcctgaggaggtcccaccaccccagggagccaggatgcaggcctattccaaccctgggtacagctccttcccttccccaacaggcttggaaccaagctgcaagtcctgtggggctcactttgcaaacacggccaggaagcagacctgcttggactgtaagaaaaatttttgcatgacctgttcgagccaagtagggaatgggccccgcctctgccttctctgccaacggtttcgagctacagcctttcagcgagaggagctcatgaagatgaaggtgaaggacttgagggactatctcagcctccatgacatctctaccgaaatgtgccgggagaaagaagagctggtgctcttggtccttggccagcagcctgtaatctcccaggaggacaggactcgtgcctccaccttgtccccagactttcctgagcagcaggccttcctgacccagcctcactccagcatggttccacctacctcacccaacctcccctcttcatctgcacaagccacctctgttcccccagcccaggttcaggagaatcagcagggccaatggccatgtgtctcaggatcaagaggaacccgtctacctggagagcgtggccagagtacctgctgaggatgagacccagtctattgactcagaggacagctttgtcccaggccgaagggcctctctgtctgacctgactgacctggaggacattgaaggcctgacagtgcggcagctgaaagagatcttggctcgcaactttgtcaactacaagggctgctgtgagaagtgggagctgatggagagagtgacccggctatacaaggatcagaaaggactccagcacctggtcagtggtgccgaagaccaaaacgggggagcagtaccatcaggcttggaggagaacctgtgtaagatctgcatggactcacccattgactgtgttcttctggagtgtggccacatggtaacctgtaccaagtgtggcaagcgcatgaatgaatgtcccatctgccggcagtatgtaatccgagctgtgcatgtcttccggtcctgagagcttgcatcggtttcttcagtgccttacagggaaatagcctggggtgtctgggctcagggttggccagcttgcagaggagcaagctagtagaaatattgcagggttcccaaaaccaggtcaagcaagatgccatgtcacccctgagcatgcctgtcttcccaggggtgtacctcttggctggcaaagcccaaggccagtgggaacttgtataaatcacatgggtatgttcttggttcagtgatcttggagtgatgatggtaactgatgaacagagaactttccagaacttgggtcctgtcttcctccctgaacctagacagtttcacccctcct

SEQ ID NO: 313732 - DNA, 1477 bp, Homo sapiens
ctggaacccggaagcggcagcgcggcgcgacccggcgggcgggctctgggcgcgggaatcccggcggatcccgggcgggcggatgacccccagccctacccttggtgccgcctcctcctctctcctttctcctccggcagccagcgcgcctgtgtcctctctaggaaggggtaggggaggggcgtctggagaggaccccccgcgaatgcccacgtgacgtgcagtccccctggggctgttccggcctgcggggaacatgggcgtgctcagggtcggactgtgccctggccttaccgaggagatgatccagcttctcaggagccacaggatcaagacagtggtggacctggtttctgcagacctggaagaggtagctcagaaatgtggcttgtcttacaaggcagaagctctccggaggatccaggtggtgcatgcatttgacatcttccagatgctggatgtgctgcaggagctccgaggcactgtggcccagcaggtgactggttcttcaggaactgtgaaggtggtggttgtggactcggtcactgcggtggtttccccacttctgggaggtcagcagagggaaggcttggccttgatgatgcagctggcccgagagctgaagaccctggcccgggaccttggcatggcagtggtggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacagccaacaggtttccaggagatggtagacattgggacctgggggacctcagagcagagtgccacattacagggtgatcagacatgacctgtgctgttgtttgggaaacagggaagcattggggacccctcccaacttttcttcccagtaacgcctgctgtttactgccacctggcactggtgactacagacgttctcaggctggccagaagagacatcttgggttccttggcctcactctctgtaagcatataaaccacaggcgaaagaggatgctgcattgcgaggacccagaaattcatactggtgccacgtttccttcccttatttctaacgtgtatgtttctggtggaaaccaagttcaccctggctgggagcatctctgatgaggcatgctggcgactggatggataatcctgtgcatcaccattgtgtcctgtgctccctcctagcgcagtggccaagccgggaaagcctctaacttgcctttgctgctgctgccttttttttcttttgtctctgcctttccatttgttagatgggggcccactcttccttagctctgtctctgagttactgggtggaaataagcttataaatgaaatactcttcttcatctctgttttgctcttaaaaatataaaaaggcaattccccg

SEQ ID NO: 313733 - DNA, 1559 bp, Homo sapiens
ctggaacccggaagcggcagcgcggcgcgacccggcgggcgggctctgggcgcgggaatcccggcggatcccgggcgggcggatgacccccagccctacccttggtgccgcctcctcctctctcctttctcctccggcagccagcgcgcctgtgtcctctctaggaaggggtaggggaggggcgtctggagaggaccccccgcgaatgcccacgtgacgtgcagtccccctggggctgttccggcctgcggggaacatgggcgtgctcagggtcggactgtgccctggccttaccgaggagatgatccagcttctcaggagccacaggatcaagacagtggtggacctggtttctgcagacctggaagaggtagctcagaaatgtggcttgtcttacaagtcttgataaactgcttgatgctggtctctatactggagaagtgactgaaattgtaggaggcccaggtagcggcaaaactcaggcagaagctctccggaggatccaggtggtgcatgcatttgacatcttccagatgctggatgtgctgcaggagctccgaggcactgtggcccagcaggtgactggttcttcaggaactgtgaaggtggtggttgtggactcggtcactgcggtggtttccccacttctgggaggtcagcagagggaaggcttggccttgatgatgcagctggcccgagagctgaagaccctggcccgggaccttggcatggcagtggtggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacagccaacaggtttccaggagatggtagacattgggacctgggggacctcagagcagagtgccacattacagggtgatcagacatgacctgtgctgttgtttgggaaacagggaagcattggggacccctcccaacttttcttcccagtaacgcctgctgtttactgccacctggcactggtgactacagacgttctcaggctggccagaagagacatcttgggttccttggcctcactctctgtaagcatataaaccacaggcgaaagaggatgctgcattgcgaggacccagaaattcatactggtgccacgtttccttcccttatttctaacgtgtatgtttctggtggaaaccaagttcaccctggctgggagcatctctgatgaggcatgctggcgactggatggataatcctgtgcatcaccattgtgtcctgtgctccctcctagcgcagtggccaagccgggaaagcctctaacttgcctttgctgctgctgccttttttttcttttgtctctgcctttccatttgttagatgggggcccactcttccttagctctgtctctgagttactgggtggaaataagcttataaatgaaatactcttcttcatctctgttttgctcttaaaaatataaaaaggcaattccccg

SEQ ID NO: 313734 - DNA, 2658 bp, Homo sapiens
ctggaacccggaagcggcagcgcggcgcgacccggcgggcgggctctgggcgcgggaatcccggcggatcccgggcgggcggatgacccccagccctacccttggtgccgcctcctcctctctcctttctcctccggcagccagcgcgcctgtgtcctctctaggaaggggtaggggaggggcgtctggagaggaccccccgcgaatgcccacgtgacgtgcagtccccctggggctgttccggcctgcggggaacatgggcgtgctcagggtcggactgtgccctggccttaccgaggagatgatccagcttctcaggagccacaggatcaagacagtggtggacctggtttctgcagacctggaagaggtagctcagaaatgtggcttgtcttacaaggccctggttgccctgaggcgggtgctgctggctcagttctcggctttccccgtgaatggcgctgatctctacgaggaactgaagacctccactgccatcctgtccactggcattggcagacatggagggcgcactcaagtgggaacctgggaggactgcagctgcctcaggtccccgcagggagatcgtggagtggggtcaggaatgctctgaagaaggcaggacttgggcatggaggaacagatggactttcgctgaatgctttcgatgaacgaggcactgcggtcagcacttcacgtcttgataaactgcttgatgctggtctctatactggagaagtgactgaaattgtaggaggcccaggtagcggcaaaactcaggtatgtctctgtatggcagcaaatgtggcccatggcctgcagcaaaacgtcctatatgtagattccaatggagggctgacagcttcccgcctcctccagctgcttcaggctaaaacccaggatgaggaggaacaggcagaagctctccggaggatccaggtggtgcatgcatttgacatcttccagatgctggatgtgctgcaggagctccgaggcactgtggcccagcaggtgagcctgctgttctgcccctccttgcttaattcagctttctaggtgctatctctgtgggcaggtgtcctactacagactgtttggaaatgcagatgtgcaatctggtgactccaactatgcttgctactcccaggatggaattcccgagcacctaaatcacatacctcattgtttacatgttcatcttccctgctgaacagtaaagccccctgagtggaaggatcatgtcatatttatgtctgcattccccactaggtgactggttcttcaggaactgtgaaggtggtggttgtggactcggtcactgcggtggtttccccacttctgggaggtcagcagagggaaggcttggccttgatgatgcagctggcccgagagctgaagaccctggcccgggaccttggcatggcagtggtggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacagattttatcatgtgggcaacctgctgcaactggttctgcctggatggacagcctgaggaggtcccaccaccccagggagccaggatgcaggcctattccaaccctgggtacagctccttccgttccacctacctcacccaacctcccctcttcatctgcacaagccacctctgttcccccagcccaggttcaggagaatcagcagggccaatggccatgtgtctcaggatcaagaggaacccgtctacctggagagcgtggccagagtacctgctgaggatgagacccagtctattgactcagaggacagctttgtcccaggccgaagggcctctctgtctgacctgactgacctggaggacattgaaggcctgacagtgcggcagctgaaagagatcttggctcgcaactttgtcaactacaagggctgctgtgagaagtgggagctgatggagagagtgacccggctatacaaggatcagaaaggactccagcacctggggggagcagtaccatcaggcttggaggagaacctgtgtaagatctgcatggactcacccattgactgtgttcttctggagtgtggccacatggtaacctgtaccaagtgtggcaagcgcatgaatgaatgtcccatctgccggcagtatgtaatccgagctgtgcatgtcttccggtcctgagagcttgcatcggtttcttcagtgccttacagggaaatagcctggggtgtctgggctcagggttggccagcttgcagaggagcaagctagtagaaatattgcagggttcccaaaaccaggtcaagcaagatgccatgtcacccctgagcatgcctgtcttcccaggggtgtacctcttggctggcaaagcccaaggccagtgggaacttgtagtgttcttcaagagtggagacaatgctgtggaacaaagcaggctttcacaaaatgttttcaaacaaaccgtttgtctacagcactggacagcagtgaatgtatacacagggaaaataaaggggatgaggcccttttgtttctgaaacatttccccctccgggtaccga

SEQ ID NO: 313735 - DNA, 1607 bp, Homo sapiens
ctggaacccggaagcggcagcgcggcgcgacccggcgggcgggctctgggcgcgggaatcccggcggatcccgggcgggcggatgacccccagccctacccttggtgccgcctcctcctctctcctttctcctccggcagccagcgcgcctgtgtcctctctaggaaggggtaggggaggggcgtctggagaggaccccccgcgaatgcccacgtgacgtgcagtccccctggggctgttccggcctgcggggaacatgggcgtgctcagggtcggactgtgccctggccttaccgaggagatgatccagcttctcaggagccacaggatcaagacagtggtggacctggtttctgcagacctggaagaggtagctcagaaatgtggcttgtcttacaaggccctggttgccctgaggcgggtgctgctggctcagttctcggctttccccgtgaatggcgctgatctctacgaggaactgaagacctccactgccatcctgtccactggcattggcagacatggagggcgcactcaagtgggaacctgggaggactgcagctgcctcaggtccccgcagggagatcgtggagtggggtcaggaatgctctgaagaaggcaggacttgggcatggaggaacagatggactttcgctgaatgctttcgatgaacgaggcactgcggtcagcacttcacgtcttgataaactgcttgatgctggtctctatactggagaagtgactgaaattgtaggaggcccaggtagcggcaaaactcaggtatgtctctgtatggcagcaaatgtggcccatggcctgcagcaaaacgtcctatatgtagattccaatggagggctgacagcttcccgcctcctccagctgcttcaggctaaaacccaggatgaggaggaacaggcagaagctctccggaggatccaggtggtgcatgcatttgacatcttccagatgctggatgtgctgcaggagctccgaggcactgtggcccagcaggtgactggttcttcaggaactgtgaaggtggtggttgtggactcggtcactgcggtggtttccccacttctgggaggtcagcagagggaaggcttggccttgatgatgcagctggcccgagagctgaagaccctggcccgggaccttggcatggcagtggtggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacagccaacaggtttccaggagatggtagacattgggacctgggggacctcagagcagagtgccacattacagggtgatcagacatgacctgtgctgttgtttgggaaacagggaagcattggggacccctcccaacttttcttcccagtaacgcctgctgtttactgccacctggcactggtgactacagacgttctcaggctggccagaagagacatcttgggttccttggcctcactctctgtaagcatataaaccacaggcgaaagagg

SEQ ID NO: 313736 - DNA, 496 bp, Homo sapiens
atgtgggcaacctgctgcaactggttctgcctggatggacagcctgaggaggtcccaccaccccagggagccaggatgcaggcctattccaaccctgggtacagctccttcccttccccaacaggcttggaaccaagctgcaagtcctgtggggctcactttgcaaacacggccaggaaggtgagtgctgacttcttggcctgctctgccactgcagcctatggaccatgggcaagcgccactgacccctctgaatgcctgcaacctttcctttccctgtgtgatgctggtgacccagagctgtccctttcacaaaaatgttcaagaagaactaactgagtaaaagcaaaagcaaagcatgtcagcatagatttggagtcagtagacctaaattcagttatcagcgttgctacctactagctatatgatctaacctctcttgagattcagtttccctgttataaaatggggatgattgtagtcctcatctttcagg

SEQ ID NO: 313737 - DNA, 1101 bp, Homo sapiens
  misc_feature (881)..(881): n is a, c, g, or t
acaccaccacacaccacacgactatcaccaccgcaactaacggtaggtagcgaggctgggtggtggcaaagtgagcagtagccaacatgtcagggtgggagtcatattacaaaaccgagggcgatgaagaagcagaggaagaacaagaagagaaccttgaagcaagtggagactataaatattcaggaagagatagtttgatttttttggttgatgcctccaaggctatgtttgaatctcagagtgaagatgagttgacaccttttgacatgagcatccagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcagtaagctgaagcaacaagaattnggggctctggcgggcttatcacgcctgggccccaaagggtcctcaggacctcctccaaataagcgctcatcgcgaaccaatgagcccgggagaacagaaccgggcacttaaacacgaacaggcggaggagactgccacacaaacccacagggcgaacatcagggagcgcagcaaatcgcggagcactgcacaagaacacagggcgttcatcgccggacag

SEQ ID NO: 313738 - DNA, 911 bp, Homo sapiens
  misc_feature (797)..(797): n is a, c, g, or t
  misc_feature (811)..(811): n is a, c, g, or t
gacaccacacatcgaggcacaagtttgtactagtacgaggcgggtgtgtaatcggacgagggcgcttccctgcgcaaagtgagcagtagccaacatgtcagggtgggagtcatattacaaaaccgagggcgatgaagaagcagaggaagaacaagaagagaaccttgaagcaagtggagactataaatattcaggaagagatagtttgatttttttggttgatgcctccaaggctatgtttgaatctcagagtgaagatgagttgacaccttttgacatgagcatccagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggtccttgggatcnaagtaaactgtggnaggtccccgagaccagaagacctgagtagggagcaagaatgactgggtaacgcaaagcacccaaattggaataggaaccgtaagagttccaaagaaggat

SEQ ID NO: 313739 - DNA, 1442 bp, Homo sapiens
gccctcccaaagtgctggggatgacagatgtgagccactgtgcctggccagttgtcttgactttaatattaccacgaatggtgattatttgaaaagttgtctgaagtcattatagcagttggtttccttagtcactttttctaagtcctgaaaatgttaatagtctagttttcagggagcttttaaaagcatgtttcagttttaactgaaagaacttctcacttgctgaaaattgttttttcctccctcacttttgtttacccttgcaacagcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcagggtgtgcactcagcccgggtcagctgcctacactgcccttaaatcagaagcaggctgggcgcggtggctcacacctgtaatcccaacagtttgggaggccaaggcaggcggattgcttgagcctaggagttgagaccagcttgggcaacatggcaagaccctctctctacctaaaaaaaaaaaaaaaaaaatcagaagcaatgcactgctacacattgcttaacaaaccagaagcaatacattgctctgacctgactggctacttaactcgactatgccactgcctcactgtcttcctctaaaatagtttatttcaggatagcagaagctatttgctgctttatctctggcaagagctggcatgatatttctctaaagtaacacagccctccatttcgtgggggtagacagttatggtctaagagtatccttagctgtactcactagtacagtcatgtgttaattaatgatagggataccttcttagaattgcgtcattaggcgattttgtcattgtgcaaacatagagggtacttcacacacccagagagtacagcttgactacacacctgggctgtgtggttagcctgttgctcttaggctacaaacctgtatagcatattaccatactgtttactgtaggcaatggtaagtatttgtgtatctaaatgtatctaaaggtatagaaaaggtacaataaaaatatgatataggccagacacggtggctcacgccttgtaatcccaccactttgggatgccgaggcgggtggatcacaagttcaagagattgagaccatcctggcctacatggtgaaaccttgttctctactaaagatacaaaaattagctggacgtgatggcgcgcgcctgtagtcccagctactcaggaggctgagaatcgcttgaacccaggagtcagaggtggcagtgagccaagatcatgccactgcactccagcctggtgacaaagtgagactccgcctca

SEQ ID NO: 313740 - DNA, 332 bp, Homo sapiens
tgtcggcctatctgtgggtcggctatctgtgtcggcctatctgtaggaaacagaagagctaaaacggtttgatgatccaggtttgatgctcatgggtttcaagccgttggtactgctgaagaaacaccattacctgaggccctccctgttcgtgtacccagaggagtcgctggtgattgggagctcaaccctgttcagtgctctgctcatcaagtgtctggagaaggaggttgcagcattgtgcagatacacaccccgtggagtacaacctgccggtggagtacaacctgccggtggagtacaacctgccggtggagtacaacctgccggtg

SEQ ID NO: 313741 - DNA, 758 bp, Homo sapiens
gagtaaagggcatcttccttttatcatcagcaaagggtaaaaatttactgaaaaaatcatggcaactccagagcaggtgggcaagatgaaggctatcgttgagaagcttcgcttcacatacagaagtgacagctttgagaaccccgtgctgcagcagcacttcaggaacctggaggccttggccttggatttgatggagccggaacaagcagtggacctgacattgcccaaggttgaagcaatgaataaaagactgggctccttggtggatgagtttaaggagcttgtttacccaccagattacaatcctgaagggaaagttaccaagagaaaacacgataatgaaggttctggaagcaaaaggcccaaggtggagtattcagaagaggagctgaagacccacatcagcaagggtacgctgggcaagttcactgtgcccatgctgaaagaggcctgccgggcttacgggctgaagagtgggctgaagaagcaggagctgctggaagccctcaccaagcacttccaggactgaccagaggccgcgcgtccagctgcccttccgcagtgtggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttactttactgcctgaataaagagccctaagtttgtactata

SEQ ID NO: 313742 - DNA, 899 bp, Homo sapiens
ggaggattgcctgagctcagaagttttagatcagcctgggcagtgtagcacaataccatctctacagtaaacttaaaaaattagctggtcatggtggcacacacctgtagtcccagttgctcaggaggctgagtcaggatgatggcttgagcccaggagttcgaggttgcagtgagctatcatcgcgtcactgcactccagcctgggtgatgggagtgtgaccctatctcagaaaaaaaagtcaggatattgacttttttggggaggtgggtgttgtaattgggagggaatgtaagagggatttctggggtgtctggcaagactcaatttcctgacataggtggagattttatggttgttcaccttataataatttattaggttatactttcctttatggcctttatttatcttatatggtaaacaaatacgaaaacaaggacaaacattttcttccatttttttccccataggagactataaatattcaggaagagatagtttgatttttttggttgatgcctccaaggctatgtttgaatctcagagtgaagatgagttgacaccttttgacatgagcatccagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccagcttgtcctcagccagttaaaatgtgtttctcctgagctaggaagagtctacccgacataagtcgagggactttatgtttttgaggctttctgttgccatggtgatggtgtagccctcccactttgctgttccttactttactgcctgaataaagagccctaagtttgtactata

SEQ ID NO: 313743 - DNA, 2743 bp, Homo sapiens
aattaggctaggtacgaggctgggtgtggtaagcgggccgttatccatttgtgttgttcgccagctaggcctggcctcgtcccgcttcgctcggtcggtctcgcgcgcccccatagccttgctagagggttagcgttagccttaagtgtgcgaatccgaggagcagcgacagactcgagaccacgctccttcctcgggaaggaggcggcacctcgcgtttgaggcccgcctgcgtttgaggcccgcctgcgcttgcggcccgcctgcgcttgaggcctgtctgcgtttgagatctcattgggcgtgattgaggaatttggggaggtttttgggcggtattgaggacgagggggtccgttagtcagcatagaatcctggagcgggaatccctcaccgtctaaatggcgtcgggggcgggacctccgggatctggcttccgcgggccgccgccggccctgaaacgtgagggatagctgagatgaggcagctactgggatggcccccatgcgcatttacatgcagtccgactgccgagctttcgaggcagcaggatttaccgtccacattcctcactactaaccaagcttttagaacagatctcacaagaacctagaggtcggtattttttcgatttaaatttgcctgttactgacgttaacgtctttcgcctagtgagcagtagccaacatgtcagggtgggagtcatattacaaaaccgagggcgatgaagaagcagaggaagaacaagaagagaaccttgaagcaagtggagactataaatattcaggaagagatagtttgatttttttggttgatgcctccaaggctatgtttgaatctcagagtgaagatgagttgacaccttttgacatgagcatccagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcagatctatgggagtcgtcagattatactggagaaagaggaaacagaagagctaaaacggtttgatgatccaggtttgatgctcatgggtttcaagccgttggtactgctgaagaaacaccattacctgaggccctccctgttcgtgtacccagaggagtcgctggtgattgggagctcaaccctgttcagtgctctgctcatcaagtgtctggagaaggaggttgcagcattgtgcagatacacaccccgcaggaacatccctccttattttgtggctttggtgccacaggaagaagagttggatgaccagaaaattcaggtgactcctccaggcttccagctggtctttttaccctttgctgatgataaaaggaagatgccctttactgaaaaaatcatggcaactccagagcaggtgggcaagatgaaggctatcgttgagaagcttcgcttcacatacagaagtgacagctttgagaaccccgtgctgcagcagcacttcaggaacctggaggccttggccttggatttgatggagccggaacaagcagtggacctgacattgcccaaggttgaagcaatgaataaaagactgggctccttggtggatgagtttaaggagcttgtttacccaccagattacaatcctgaagggaaagttaccaagagaaaacacgataatgaaggttctggaagcaaaaggcccaaggtggagtattcagaagaggagctgaagacccacatcagcaagggtacgctgggcaagttcactgtgcccatgctgaaagaggcctgccgggcttacgggctgaagagtgggctgaagaagcaggagctgctggaagccctcaccaagcacttccaggactgaccagaggccgcgcgtccagctgcccttccgcagtgtggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttactttactgcctgaataaagagccctaagtttgtactata

SEQ ID NO: 313744 - DNA, 2123 bp, Homo sapiens
aattaggctaggtacgaggctgggtgtggttggtcgcttccctgcgccaaagtgagcagtagccaacatgtcagggtgggagtcatattacaaaaccgagggcgatgaagaagcagaggaagaacaagaagagaaccttgaagcaagtggagactataaatattcaggaagagatagtttgatttttttggttgatgcctccaaggctatgtttgaatctcagagtgaagatgagttgacaccttttgacatgagcatccagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcagatctatgggagtcgtcagattatactggagaaagaggaaacagaagagctaaaacggtttgatgatccaggtttgatgctcatgggtttcaagccgttggtactgctgaagaaacaccattacctgaggccctccctgttcgtgtacccagaggagtcgctggtgattgggagctcaaccctgttcagtgctctgctcatcaagtgtctggagaaggaggttgcagcattgtgcagatacacaccccgcaggaacatccctccttattttgtggctttggtgccacaggaagaagagttggatgaccagaaaattcaggtgactcctccaggcttccagctggtctttttaccctttgctgatgataaaaggaagatgccctttactgaaaaaatcatggcaactccagagcaggtgggcaagatgaaggctatcgttgagaagcttcgcttcacatacagaagtgacagctttgagaaccccgtgctgcagcagcacttcaggaacctggaggccttggccttggatttgatggagccggaacaagcagtggacctgacattgcccaaggttgaagcaatgaataaaagactgggctccttggtggatgagtttaaggagcttgtttacccaccagattacaatcctgaagggaaagttaccaagagaaaacacgataatgaaggttctggaagcaaaaggcccaaggtggagtattcagaagaggagctgaagacccacatcagcaagggtacgctgggcaagttcactgtgcccatgctgaaagaggcctgccgggcttacgggctgaagagtgggctgaagaagcaggagctgctggaagccctcaccaagcacttccaggactgaccagaggccgcgcgtccagctgcccttccgcagtgtggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttactttactgcctgaataaagagccctaagtttgtactata

SEQ ID NO: 313745 - DNA, 2265 bp, Homo sapiens
gggaaggagatggcttcgtgaacagcagcacaggcggtggagacttcactgcttgaaacttcagcctctctcccctgtgtccaagtgacattgagatttcaagaggacaaactccaaaagctgtggatgtccttgccaaggagatttcatctgcaagcaatccaatccaagttggtcgcttccctgcgccaaagtgagcagtagccaacatgtcagggtgggagtcatattacaaaaccgagggcgatgaagaagcagaggaagaacaagaagagaaccttgaagcaagtggagactataaatattcaggaagagatagtttgatttttttggttgatgcctccaaggctatgtttgaatctcagagtgaagatgagttgacaccttttgacatgagcatccagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcagatctatgggagtcgtcagattatactggagaaagaggaaacagaagagctaaaacggtttgatgatccaggtttgatgctcatgggtttcaagccgttggtactgctgaagaaacaccattacctgaggccctccctgttcgtgtacccagaggagtcgctggtgattgggagctcaaccctgttcagtgctctgctcatcaagtgtctggagaaggaggttgcagcattgtgcagatacacaccccgcaggaacatccctccttattttgtggctttggtgccacaggaagaagagttggatgaccagaaaattcaggtgactcctccaggcttccagctggtctttttaccctttgctgatgataaaaggaagatgccctttactgaaaaaatcatggcaactccagagcaggtgggcaagatgaaggctatcgttgagaagcttcgcttcacatacagaagtgacagctttgagaaccccgtgctgcagcagcacttcaggaacctggaggccttggccttggatttgatggagccggaacaagcagtggacctgacattgcccaaggttgaagcaatgaataaaagactgggctccttggtggatgagtttaaggagcttgtttacccaccagattacaatcctgaagggaaagttaccaagagaaaacacgataatgaaggttctggaagcaaaaggcccaaggtggagtattcagaagaggagctgaagacccacatcagcaagggtacgctgggcaagttcactgtgcccatgctgaaagaggcctgccgggcttacgggctgaagagtgggctgaagaagcaggagctgctggaagccctcaccaagcacttccaggactgaccagaggccgcgcgtccagctgcccttccgcagtgtggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttactttactgcctgaataaagagccctaagtttgtactata

SEQ ID NO: 313746 - DNA, 2164 bp, Homo sapiens
aattaggctaggtacgaggctgggtgtggtaagcgggccgttatccatttgtgttgttcgccagctaggcctggcctcgtcccgcttcgctcgtgagcagtagccaacatgtcagggtgggagtcatattacaaaaccgagggcgatgaagaagcagaggaagaacaagaagagaaccttgaagcaagtggagactataaatattcaggaagagatagtttgatttttttggttgatgcctccaaggctatgtttgaatctcagagtgaagatgagttgacaccttttgacatgagcatccagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcagatctatgggagtcgtcagattatactggagaaagaggaaacagaagagctaaaacggtttgatgatccaggtttgatgctcatgggtttcaagccgttggtactgctgaagaaacaccattacctgaggccctccctgttcgtgtacccagaggagtcgctggtgattgggagctcaaccctgttcagtgctctgctcatcaagtgtctggagaaggaggttgcagcattgtgcagatacacaccccgcaggaacatccctccttattttgtggctttggtgccacaggaagaagagttggatgaccagaaaattcaggtgactcctccaggcttccagctggtctttttaccctttgctgatgataaaaggaagatgccctttactgaaaaaatcatggcaactccagagcaggtgggcaagatgaaggctatcgttgagaagcttcgcttcacatacagaagtgacagctttgagaaccccgtgctgcagcagcacttcaggaacctggaggccttggccttggatttgatggagccggaacaagcagtggacctgacattgcccaaggttgaagcaatgaataaaagactgggctccttggtggatgagtttaaggagcttgtttacccaccagattacaatcctgaagggaaagttaccaagagaaaacacgataatgaaggttctggaagcaaaaggcccaaggtggagtattcagaagaggagctgaagacccacatcagcaagggtacgctgggcaagttcactgtgcccatgctgaaagaggcctgccgggcttacgggctgaagagtgggctgaagaagcaggagctgctggaagccctcaccaagcacttccaggactgaccagaggccgcgcgtccagctgcccttccgcagtgtggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttactttactgcctgaataaagagccctaagtttgtactata

SEQ ID NO: 313747 - DNA, 2345 bp, Homo sapiens
aattaggctaggtacgaggctgggtgtggtaagcgggccgttatccatttgtgttgttcgccagctaggcctggcctcgtcccgcttcgctcggtcggtctcgcgcgcccccatagccttgctagagggttagcgttagccttaagtgtgcgaatccgaggagcagcgacagactcgagaccacgctccttcctcgggaaggaggcggcacctcgcgtttgaggcccgcctgcgtttgaggcccgcctgcgcttgcggcccgcctgcgcttgagtgagcagtagccaacatgtcagggtgggagtcatattacaaaaccgagggcgatgaagaagcagaggaagaacaagaagagaaccttgaagcaagtggagactataaatattcaggaagagatagtttgatttttttggttgatgcctccaaggctatgtttgaatctcagagtgaagatgagttgacaccttttgacatgagcatccagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcagatctatgggagtcgtcagattatactggagaaagaggaaacagaagagctaaaacggtttgatgatccaggtttgatgctcatgggtttcaagccgttggtactgctgaagaaacaccattacctgaggccctccctgttcgtgtacccagaggagtcgctggtgattgggagctcaaccctgttcagtgctctgctcatcaagtgtctggagaaggaggttgcagcattgtgcagatacacaccccgcaggaacatccctccttattttgtggctttggtgccacaggaagaagagttggatgaccagaaaattcaggtgactcctccaggcttccagctggtctttttaccctttgctgatgataaaaggaagatgccctttactgaaaaaatcatggcaactccagagcaggtgggcaagatgaaggctatcgttgagaagcttcgcttcacatacagaagtgacagctttgagaaccccgtgctgcagcagcacttcaggaacctggaggccttggccttggatttgatggagccggaacaagcagtggacctgacattgcccaaggttgaagcaatgaataaaagactgggctccttggtggatgagtttaaggagcttgtttacccaccagattacaatcctgaagggaaagttaccaagagaaaacacgataatgaaggttctggaagcaaaaggcccaaggtggagtattcagaagaggagctgaagacccacatcagcaagggtacgctgggcaagttcactgtgcccatgctgaaagaggcctgccgggcttacgggctgaagagtgggctgaagaagcaggagctgctggaagccctcaccaagcacttccaggactgaccagaggccgcgcgtccagctgcccttccgcagtgtggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttactttactgcctgaataaagagccctaagtttgtactata

SEQ ID NO: 313748 - DNA, 2142 bp, Homo sapiens
acaccaccacacaccacacgactatcaccaccgcaactaacggtaggtagcgaggctgggtggtggcaaagtgagcagtagccaacatgtcagggtgggagtcatattacaaaaccgagggcgatgaagaagcagaggaagaacaagaagagaaccttgaagcaagtggagactataaatattcaggaagagatagtttgatttttttggttgatgcctccaaggctatgtttgaatctcagagtgaagatgagttgacaccttttgacatgagcatccagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcagatctatgggagtcgtcagattatactggagaaagaggaaacagaagagctaaaacggtttgatgatccaggtttgatgctcatgggtttcaagccgttggtactgctgaagaaacaccattacctgaggccctccctgttcgtgtacccagaggagtcgctggtgattgggagctcaaccctgttcagtgctctgctcatcaagtgtctggagaaggaggttgcagcattgtgcagatacacaccccgcaggaacatccctccttattttgtggctttggtgccacaggaagaagagttggatgaccagaaaattcaggtgactcctccaggcttccagctggtctttttaccctttgctgatgataaaaggaagatgccctttactgaaaaaatcatggcaactccagagcaggtgggcaagatgaaggctatcgttgagaagcttcgcttcacatacagaagtgacagctttgagaaccccgtgctgcagcagcacttcaggaacctggaggccttggccttggatttgatggagccggaacaagcagtggacctgacattgcccaaggttgaagcaatgaataaaagactgggctccttggtggatgagtttaaggagcttgtttacccaccagattacaatcctgaagggaaagttaccaagagaaaacacgataatgaaggttctggaagcaaaaggcccaaggtggagtattcagaagaggagctgaagacccacatcagcaagggtacgctgggcaagttcactgtgcccatgctgaaagaggcctgccgggcttacgggctgaagagtgggctgaagaagcaggagctgctggaagccctcaccaagcacttccaggactgaccagaggccgcgcgtccagctgcccttccgcagtgtggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttactttactgcctgaataaagagccctaagtttgtactata

SEQ ID NO: 313749 - DNA, 2107 bp, Homo sapiens
  misc_feature (27)..(27): n is a, c, g, or t
ttggctggtacgaggctgggttgaatnggccgaggatgagcagtagccaacatgtcagggtgggagtcatattacaaaaccgagggcgatgaagaagcagaggaagaacaagaagagaaccttgaagcaagtggagactataaatattcaggaagagatagtttgatttttttggttgatgcctccaaggctatgtttgaatctcagagtgaagatgagttgacaccttttgacatgagcatccagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcagatctatgggagtcgtcagattatactggagaaagaggaaacagaagagctaaaacggtttgatgatccaggtttgatgctcatgggtttcaagccgttggtactgctgaagaaacaccattacctgaggccctccctgttcgtgtacccagaggagtcgctggtgattgggagctcaaccctgttcagtgctctgctcatcaagtgtctggagaaggaggttgcagcattgtgcagatacacaccccgcaggaacatccctccttattttgtggctttggtgccacaggaagaagagttggatgaccagaaaattcaggtgactcctccaggcttccagctggtctttttaccctttgctgatgataaaaggaagatgccctttactgaaaaaatcatggcaactccagagcaggtgggcaagatgaaggctatcgttgagaagcttcgcttcacatacagaagtgacagctttgagaaccccgtgctgcagcagcacttcaggaacctggaggccttggccttggatttgatggagccggaacaagcagtggacctgacattgcccaaggttgaagcaatgaataaaagactgggctccttggtggatgagtttaaggagcttgtttacccaccagattacaatcctgaagggaaagttaccaagagaaaacacgataatgaaggttctggaagcaaaaggcccaaggtggagtattcagaagaggagctgaagacccacatcagcaagggtacgctgggcaagttcactgtgcccatgctgaaagaggcctgccgggcttacgggctgaagagtgggctgaagaagcaggagctgctggaagccctcaccaagcacttccaggactgaccagaggccgcgcgtccagctgcccttccgcagtgtggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttactttactgcctgaataaagagccctaagtttgtactata

SEQ ID NO: 313750 - DNA, 3104 bp, Homo sapiens
aattaggctaggtacgaggctgggtgtggtaagcgggccgttatccatttgtgttgttcgccagctaggcctggcctcgtcccgcttcgctcggtcggtctcgcgcgcccccatagccttgctagagggttagcgttagccttaagtgtgcgaatccgaggagcagcgacagactcgagaccacgctccttcctcgggaaggaggcggcacctcgcgtttgaggcccgcctgcgtttgaggcccgcctgcgcttgcggcccgcctgcgcttgaggcctgtctgcgtttgagatctcattgggcgtgattgaggaatttggggaggtttttgggcggtattgaggacgagggggtccgttagtcagcatagaatcctggagcgggaatccctcaccgtctaaatggcgtcgggggcgggacctccgggatctggcttccgcgggccgccgccggccctgaaacgtgagggatagctgagatgaggcagctactgggatggcccccatgcgcatttacatgcagtccgactgccgagctttcgaggcagcaggatttaccgtccacattcctcactactaaccaagcttttagaacagatctcacaagaacctagaggtcggtattttttcgatttaaatttgcctgttactgacgttaacgtctttcgcctagtgagcagtagccaacatgtcagggtgggagtcatattacaaaaccgagggcgatgaagaagcagaggaagaacaagaagagaaccttgaagcaagtggagactataaatattcaggaagagatagtttgatttttttggttgatgcctccaaggctatgtttgaatctcagagtgaagatgagttgacaccttttgacatgagcatccagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcagatctatgggagtcgtcagattatactggagaaagaggaaacagaagagctaaaacggtttgatgatccaggtttgatgctcatgggtttcaagccgttggtactgctgaagaaacaccattacctgaggccctccctgttcgtgtacccagaggagtcgctggtgattgggagctcaaccctgttcagtgctctgctcatcaagtgtctggagaaggaggttgcagcattgtgcagatacacaccccgcaggaacatccctccttattttgtggctttggtgccacaggaagaagagttggatgaccagaaaattcaggtgactcctccaggcttccagctggtctttttaccctttgctgatgataaaaggaagatgccctttactgaaaaaatcatggcaactccagagcaggtgggcaagatgaaggctatcgttgagaagcttcgcttcacatacagaagtgacagctttgagaaccccgtgctgcagcagcacttcaggaacctggaggccttggccttggatttgatggagccggaacaagcagtggacctgacattgcccaaggttgaagcaatgaataaaagactgggctccttggtggatgagtttaaggagcttgtttacccaccagattacaatcctgaagggaaagttaccaagagaaaacacgataatgaaggttctggaagcaaaaggcccaaggtggagtattcagaagaggagctgaagacccacatcagcaagggtacgctgggcaagttcactgtgcccatgctgaaagaggcctgccgggcttacgggctgaagagtgggctgaagaagcaggagctgctggaagccctcaccaagcacttccaggactgaccagaggccgcgcgtccagctgcccttccgcagtgtggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttactttactgcctgaataaagagccctaagtttgtactataaaaaaaaaaaaacaaacaacaaaagaaaaaaaaaaaaaaaaagaaaaaaaaaaaaaaaaacacaaacacgcaacaccaacaatgaaacagaaaacaaaaggggggggcgcacacgaaaagaacccctggggggggccaaagtactacgcgcgaccggctgttcttggaagagggggcccaataaggagggataataagaagggcaaggcggcgctgtcacacgcaccggcgggacaagcggcgcgggactttgagagagaccaaccggtgggggacatacggcaaccacccacagaattgaacgcccgcaactaactcgggatcgggtacgccgattagcgggaaactgcggtgtagatag

SEQ ID NO: 313751 - DNA, 2689 bp, Homo sapiens
aattaggctaggtacgaggctgggtgtggtaagcgggccgttatccatttgtgttgttcgccagctaggcctggcctcgtcccgcttcgctcggtcggtctcgcgcgcccccatagccttgctagagggttagcgttagccttaagtgtgcgaatccgaggagcagcgacagactcgagaccacgctccttcctcgggaaggaggcggcacctcgcgtttgaggcccgcctgcgtttgaggcccgcctgcgcttgcggcccgcctgcgcttgaggcctgtctgcgtttgagatctcattgggcgtgattgaggaatttggggaggtttttgggcggtattgaggacgagggggtccgttagtcagcatagaatcctggagcgggaatccctcaccgtctaaatggcgtcgggggcgggacctccgggatctggcttccgcgggccgccgccggccctgaaacgtgagggatagctgagatgaggcagctactgggatggcccccatgcgcatttacatgcagtccgactgccgagctttcgaggcagcaggatttaccgtccacattcctcactactaaccaagcttttagaacagatctcacaagaacctagaggtcggtattttttcgatttaaatttgcctgttactgacgttaacgtctttcgcctagtgagcagtagccaacatgtcagggtgggagtcatattacaaaagagactataaatattcaggaagagatagtttgatttttttggttgatgcctccaaggctatgtttgaatctcagagtgaagatgagttgacaccttttgacatgagcatccagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcagatctatgggagtcgtcagattatactggagaaagaggaaacagaagagctaaaacggtttgatgatccaggtttgatgctcatgggtttcaagccgttggtactgctgaagaaacaccattacctgaggccctccctgttcgtgtacccagaggagtcgctggtgattgggagctcaaccctgttcagtgctctgctcatcaagtgtctggagaaggaggttgcagcattgtgcagatacacaccccgcaggaacatccctccttattttgtggctttggtgccacaggaagaagagttggatgaccagaaaattcaggtgactcctccaggcttccagctggtctttttaccctttgctgatgataaaaggaagatgccctttactgaaaaaatcatggcaactccagagcaggtgggcaagatgaaggctatcgttgagaagcttcgcttcacatacagaagtgacagctttgagaaccccgtgctgcagcagcacttcaggaacctggaggccttggccttggatttgatggagccggaacaagcagtggacctgacattgcccaaggttgaagcaatgaataaaagactgggctccttggtggatgagtttaaggagcttgtttacccaccagattacaatcctgaagggaaagttaccaagagaaaacacgataatgaaggttctggaagcaaaaggcccaaggtggagtattcagaagaggagctgaagacccacatcagcaagggtacgctgggcaagttcactgtgcccatgctgaaagaggcctgccgggcttacgggctgaagagtgggctgaagaagcaggagctgctggaagccctcaccaagcacttccaggactgaccagaggccgcgcgtccagctgcccttccgcagtgtggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttactttactgcctgaataaagagccctaagtttgtactata

SEQ ID NO: 313752 - DNA, 2100 bp, Homo sapiens
ggtcaatcagtgacgcagtacctcaacgatgtcacggttggtgaggtcagtgatcacatatacatcggtagggcgatgaagaagctacgaggaacgaagcagtgaacgagaaccttgaagcaagtggagactataaatattcaggaagagatagtttgatttttttggttgatgcctccaaggctatgtttgaatctcagagtgaagatgagttgacaccttttgacatgagcatccagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcagatctatgggagtcgtcagattatactggagaaagaggaaacagaagagctaaaacggtttgatgatccaggtttgatgctcatgggtttcaagccgttggtactgctgaagaaacaccattacctgaggccctccctgttcgtgtacccagaggagtcgctggtgattgggagctcaaccctgttcagtgctctgctcatcaagtgtctggagaaggaggttgcagcattgtgcagatacacaccccgcaggaacatccctccttattttgtggctttggtgccacaggaagaagagttggatgaccagaaaattcaggtgactcctccaggcttccagctggtctttttaccctttgctgatgataaaaggaagatgccctttactgaaaaaatcatggcaactccagagcaggtgggcaagatgaaggctatcgttgagaagcttcgcttcacatacagaagtgacagctttgagaaccccgtgctgcagcagcacttcaggaacctggaggccttggccttggatttgatggagccggaacaagcagtggacctgacattgcccaaggttgaagcaatgaataaaagactgggctccttggtggatgagtttaaggagcttgtttacccaccagattacaatcctgaagggaaagttaccaagagaaaacacgataatgaaggttctggaagcaaaaggcccaaggtggagtattcagaagaggagctgaagacccacatcagcaagggtacgctgggcaagttcactgtgcccatgctgaaagaggcctgccgggcttacgggctgaagagtgggctgaagaagcaggagctgctggaagccctcaccaagcacttccaggactgaccagaggccgcgcgtccagctgcccttccgcagtgtggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttactttactgcctgaataaagagccctaagtttgtactata

SEQ ID NO: 313753 - DNA, 3060 bp, Homo sapiens
aattaggctaggtacgaggctgggtgtggtaagcgggccgttatccatttgtgttgttcgccagctaggcctggcctcgtcccgcttcgctcggtcggtctcgcgcgcccccatagccttgctagagggttagcgttagccttaagtgtgcgaatccgaggagcagcgacagactcgagaccacgctccttcctcgggaaggaggcggcacctcgcgtttgaggcccgcctgcgtttgaggcccgcctgcgcttgcggcccgcctgcgcttgaggcctgtctgcgtttgagatctcattgggcgtgattgaggaatttggggaggtttttgggcggtattgaggacgagggggtccgttagtcagcatagaatcctggagcgggaatccctcaccgtctaaatggcgtcgggggcgggacctccgggatctggcttccgcgggccgccgccggccctgaaacgtgagggatagctgagatgaggcagctactgggatggcccccatgcgcatttacatgcagtccgactgccgagctttcgaggcagcaggatttaccgtccacattcctcactactaaccaagcttttagaacagatctcacaagaacctagaggtcggtattttttcgatttaaatttgcctgttactgacgttaacgtctttcgcctagtgagcagtagccaacatgtcagggtgggagtcatattacaaaaccgagggcgatgaagaagcagaggaagaacaagaagagaaccttgaagcaagtggagactataaatattcaggaagagatagtttgatttttttggttgatgcctccaaggctatgtttgaatctcagagtgaagatgagttgacaccttttgacatgagcatccagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcagatctatgggagtcgtcagattatactggagaaagaggaaacagaagagctaaaacggtttgatgatccaggtttgatgctcatgggtttcaagccgttggtactgctgaagaaacaccattacctgaggccctccctgttcgtgtacccagaggagtcgctggtgattgggagctcaaccctgttcagtgctctgctcatcaagtgtctggagaaggaggttgcagcattgtgcagatacacaccccgcaggaacatccctccttattttgtggctttggtgccacaggaagaagagttggatgaccagaaaattcaggtgactcctccaggcttccagctggtctttttaccctttgctgatgataaaaggaagatgccctttactgaaaaaatcatggcaactccagagcaggtgggcaagatgaaggctatcgttgagaagcttcgcttcacatacagaagtgacagctttgagaaccccgtgctgcagcagcacttcaggaacctggaggccttggccttggatttgatggagccggaacaagcagtggacctgacattgcccaaggttgaagcaatgaataaaagactgggctccttggtggatgagtttaaggagcttgtttacccaccagattacaatcctgaagggaaagttaccaagagaaaacacgataatgaaggttctggaagcaaaaggcccaaggtggagtattcagaagaggagctgaagacccacatcagcaagggtacgctgggcaagttcactgtgcccatgctgaaagaggcctgccgggcttacgggctgaagagtgggctgaagaagcaggagctgctggaagccctcaccaagcacttccaggactgaccagaggccgcgcgtccagctgcccttccgcagtgtggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttactttactgcctgaataaagagccctaagtttgtactataaaaaaaaaaaaaaaaacacaaacacgcaacaccaacaatgaaacagaaaacaaaaggggggggcgcacacgaaaagaacccctggggggggccaaagtactacgcgcgaccggctgttcttggaagagggggcccaataaggagggataataagaagggcaaggcggcgctgtcacacgcaccggcgggacaagcggcgcgggactttgagagagaccaaccggtgggggacatacggcaaccacccacagaattgaacgcccgcaactaactcgggatcgggtacgccgattagcgggaaactgcggtgtagatag

SEQ ID NO: 313754 - DNA, 2693 bp, Homo sapiens
aattaggctaggtacgaggctgggtgtggtaagcgggccgttatccatttgtgttgttcgccagctaggcctggcctcgtcccgcttcgctcggtcggtctcgcgcgcccccatagccttgctagagggttagcgttagccttaagtgtgcgaatccgaggagcagcgacagactcgagaccacgctccttcctcgggaaggaggcggcacctcgcgtttgaggcccgcctgcgtttgaggcccgcctgcgcttgcggcccgcctgcgcttgaggcctgtctgcgtttgagatctcattgggcgtgattgaggaatttggggaggtttttgggcggtattgaggacgagggggtccgttagtcagcatagaatcctggagcgggaatccctcaccgtctaaatggcgtcgggggcgggacctccgggatctggcttccgcgggccgccgccggccctgaaacgtgagggatagctgagatgaggcagctactgggatggcccccatgcgcatttacatgcagtccgactgccgagctttcgaggcagcaggatttaccgtccacattcctcactactaaccaagcttttagaacagatctcacaagaacctagaggtcggtattttttcgatttaaatttgcctgttactgacgttaacgtctttcgcctagtgagcagtagccaacatgtcagggtgggagtcatattacaaaaccgagggcgatgaagaagcagaggaagaacaagaagagaaccttgaagcaagtggagactataaatattcaggaagagatagtttgatttttttggttgatgcctccaaggctatgtttgaatctcagagtgaagatgagttgacaccttttgacatgagcatccagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcagatctatgggagtcgtcagattatactggagaaagaggaaacagaagagctaaaacggtttgatgatccaggtttgatgctcatgggtttcaagccgttggtactgctgaagaaacaccattacctgaggccctccctgttcgtgtacccagaggagtcgctggtgattgggagctcaaccctgttcagtgctctgctcatcaagtgtctggagaaggaggttgcagcattgtgcagatacacaccccgcaggaacatccctccttattttgtggctttggtgccacaggaagaagagttggatgaccagaaaattcaggtgactcctccagtttactgaaaaaatcatggcaactccagagcaggtgggcaagatgaaggctatcgttgagaagcttcgcttcacatacagaagtgacagctttgagaaccccgtgctgcagcagcacttcaggaacctggaggccttggccttggatttgatggagccggaacaagcagtggacctgacattgcccaaggttgaagcaatgaataaaagactgggctccttggtggatgagtttaaggagcttgtttacccaccagattacaatcctgaagggaaagttaccaagagaaaacacgataatgaaggttctggaagcaaaaggcccaaggtggagtattcagaagaggagctgaagacccacatcagcaagggtacgctgggcaagttcactgtgcccatgctgaaagaggcctgccgggcttacgggctgaagagtgggctgaagaagcaggagctgctggaagccctcaccaagcacttccaggactgaccagaggccgcgcgtccagctgcccttccgcagtgtggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttactttactgcctgaataaagagccctaagtttgtactata

SEQ ID NO: 313755 - DNA, 2630 bp, Homo sapiens
aattaggctaggtacgaggctgggtgtggtaagcgggccgttatccatttgtgttgttcgccagctaggcctggcctcgtcccgcttcgctcggtcggtctcgcgcgcccccatagccttgctagagggttagcgttagccttaagtgtgcgaatccgaggagcagcgacagactcgagaccacgctccttcctcgggaaggaggcggcacctcgcgtttgaggcccgcctgcgtttgaggcccgcctgcgcttgcggcccgcctgcgcttgaggcctgtctgcgtttgagatctcattgggcgtgattgaggaatttggggaggtttttgggcggtattgaggacgagggggtccgttagtcagcatagaatcctggagcgggaatccctcaccgtctaaatggcgtcgggggcgggacctccgggatctggcttccgcgggccgccgccggccctgaaacgtgagggatagctgagatgaggcagctactgggatggcccccatgcgcatttacatgcagtccgactgccgagctttcgaggcagcaggatttaccgtccacattcctcactactaaccaagcttttagaacagatctcacaagaacctagaggtcggtattttttcgatttaaatttgcctgttactgacgttaacgtctttcgcctagtgagcagtagccaacatgtcagggtgggagtcatattacaaaaccgagggcgatgaagaagcagaggaagaacaagaagagaaccttgaagcaagtgtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcagatctatgggagtcgtcagattatactggagaaagaggaaacagaagagctaaaacggtttgatgatccaggtttgatgctcatgggtttcaagccgttggtactgctgaagaaacaccattacctgaggccctccctgttcgtgtacccagaggagtcgctggtgattgggagctcaaccctgttcagtgctctgctcatcaagtgtctggagaaggaggttgcagcattgtgcagatacacaccccgcaggaacatccctccttattttgtggctttggtgccacaggaagaagagttggatgaccagaaaattcaggtgactcctccaggcttccagctggtctttttaccctttgctgatgataaaaggaagatgccctttactgaaaaaatcatggcaactccagagcaggtgggcaagatgaaggctatcgttgagaagcttcgcttcacatacagaagtgacagctttgagaaccccgtgctgcagcagcacttcaggaacctggaggccttggccttggatttgatggagccggaacaagcagtggacctgacattgcccaaggttgaagcaatgaataaaagactgggctccttggtggatgagtttaaggagcttgtttacccaccagattacaatcctgaagggaaagttaccaagagaaaacacgataatgaaggttctggaagcaaaaggcccaaggtggagtattcagaagaggagctgaagacccacatcagcaagggtacgctgggcaagttcactgtgcccatgctgaaagaggcctgccgggcttacgggctgaagagtgggctgaagaagcaggagctgctggaagccctcaccaagcacttccaggactgaccagaggccgcgcgtccagctgcccttccgcagtgtggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttactttactgcctgaataaagagccctaagtttgtactata

SEQ ID NO: 313756 - DNA, 2688 bp, Homo sapiens
aattaggctaggtacgaggctgggtgtggtaagcgggccgttatccatttgtgttgttcgccagctaggcctggcctcgtcccgcttcgctcggtcggtctcgcgcgcccccatagccttgctagagggttagcgttagccttaagtgtgcgaatccgaggagcagcgacagactcgagaccacgctccttcctcgggaaggaggcggcacctcgcgtttgaggcccgcctgcgtttgaggcccgcctgcgcttgcggcccgcctgcgcttgaggcctgtctgcgtttgagatctcattgggcgtgattgaggaatttggggaggtttttgggcggtattgaggacgagggggtccgttagtcagcatagaatcctggagcgggaatccctcaccgtctaaatggcgtcgggggcgggacctccgggatctggcttccgcgggccgccgccggccctgaaacgtgagggatagctgagatgaggcagctactgggatggcccccatgcgcatttacatgcagtccgactgccgagctttcgaggcagcaggatttaccgtccacattcctcactactaaccaagcttttagaacagatctcacaagaacctagaggtcggtattttttcgatttaaatttgcctgttactgacgttaacgtctttcgcctagtgagcagtagccaacatgtcagggtgggagtcatattacaaaaccgagggcgatgaagaagcagaggaagaacaagaagagaaccttgaagcaagtggagactataaatattcaggaagagatagtttgatttttttggttgatgcctccaaggctatgtttgaatctcagagtgaagatgagttgacaccttttgacatgagcatccagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcagatctatgggagtcgtcagattatactggagaaagaggaaacagaagagtgctgaagaaacaccattacctgaggccctccctgttcgtgtacccagaggagtcgctggtgattgggagctcaaccctgttcagtgctctgctcatcaagtgtctggagaaggaggttgcagcattgtgcagatacacaccccgcaggaacatccctccttattttgtggctttggtgccacaggaagaagagttggatgaccagaaaattcaggtgactcctccaggcttccagctggtctttttaccctttgctgatgataaaaggaagatgccctttactgaaaaaatcatggcaactccagagcaggtgggcaagatgaaggctatcgttgagaagcttcgcttcacatacagaagtgacagctttgagaaccccgtgctgcagcagcacttcaggaacctggaggccttggccttggatttgatggagccggaacaagcagtggacctgacattgcccaaggttgaagcaatgaataaaagactgggctccttggtggatgagtttaaggagcttgtttacccaccagattacaatcctgaagggaaagttaccaagagaaaacacgataatgaaggttctggaagcaaaaggcccaaggtggagtattcagaagaggagctgaagacccacatcagcaagggtacgctgggcaagttcactgtgcccatgctgaaagaggcctgccgggcttacgggctgaagagtgggctgaagaagcaggagctgctggaagccctcaccaagcacttccaggactgaccagaggccgcgcgtccagctgcccttccgcagtgtggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttactttactgcctgaataaagagccctaagtttgtactata

SEQ ID NO: 313757 - DNA, 2688 bp, Homo sapiens
aattaggctaggtacgaggctgggtgtggtaagcgggccgttatccatttgtgttgttcgccagctaggcctggcctcgtcccgcttcgctcggtcggtctcgcgcgcccccatagccttgctagagggttagcgttagccttaagtgtgcgaatccgaggagcagcgacagactcgagaccacgctccttcctcgggaaggaggcggcacctcgcgtttgaggcccgcctgcgtttgaggcccgcctgcgcttgcggcccgcctgcgcttgaggcctgtctgcgtttgagatctcattgggcgtgattgaggaatttggggaggtttttgggcggtattgaggacgagggggtccgttagtcagcatagaatcctggagcgggaatccctcaccgtctaaatggcgtcgggggcgggacctccgggatctggcttccgcgggccgccgccggccctgaaacgtgagggatagctgagatgaggcagctactgggatggcccccatgcgcatttacatgcagtccgactgccgagctttcgaggcagcaggatttaccgtccacattcctcactactaaccaagcttttagaacagatctcacaagaacctagaggtcggtattttttcgatttaaatttgcctgttactgacgttaacgtctttcgcctagtgagcagtagccaacatgtcagggtgggagtcatattacaaaaccgagggcgatgaagaagcagaggaagaacaagaagagaaccttgaagcaagtggagactataaatattcaggaagagatagtttgatttttttggttgatgcctccaaggctatgtttgaatctcagagtgaagatgagttgacaccttttgacatgagcatccagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcaggttaaagctgaagctcaacaaagatatagtgatctctgtgggcatttataatctggtccagaaggctctcaagcctcctccaataaagctctatcgggaaacaaatgaaccagtgaaaaccaagacccggacatctatgggagtcgtcagattatactggagaaagaggaaacagaagagctaaaacggtttgatgatccaggtttgatgctcatgggtttcaagccgttggtactgctgaagaaacaccattacctgaggccctccctgttcgtgtacccagaggagtcgctggtgattgggagctcaaccctgttcagtgctctgctcatcaagtgtctggagaaggaggttgcagcattgtgcagatacacaccccgcaggaacatccctccttattttgtggctttggtgccacaggaagaagagttggatgaccagaaaattcaggtgactcctccaggcttccagctggtctttttaccctttgctgatgataaaaggaagatgccctttactgaaaaaatcatggcaactccagagcaggtgggcaagatgaaggctatcgttgagaagcttcgcttcacatacagaagtgacagctttgagaaccccgtgctgcagcagcacttcaggaacctggaggccttggccttggatttgatggagccggaacaagcagtggacctgacattgcccaaggttgaagcaatgaataaaagactgggctccttggtggatgagtttaaggagcttgtttacccaccagattacaatcctgaagggaaagttaccaagagaaaacacgataatgaaggttctggaagcaaaaggcccaaggtggagtattcagaagaggagctgaagacccacatcagcaagggtacgctgggcaagttcactgtgcccatgctgaaagaggcctgccgggcttacgggctgaagagtgggctgaagaagcaggagctgctggaagccctcaccaagcacttccaggactgaccagaggccgcgcgtccagctgcccttccgcagtgtggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttactttactgcctgaataaagagccctaagtttgtactata

SEQ ID NO: 313758 - DNA, 1530 bp, Homo sapiens
tggcaggtgggaggcgggtgaatcggacgagggcaggaccaaagccggtgatctccgagatacgcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcagatctatgggagtcgtcagattatactggagaaagaggaaacagaagagctaaaacggtttgatgatccaggtttgatgctcatgggtttcaagccgttggtactgctgaagaaacaccattacctgaggccctccctgttcgtgtacccagaggagtcgctggtgattgggagctcaaccctgttcagtgctctgctcatcaagtgtctggagaaggaggttgcagcattgtgcagatacacaccccgcaggaacatccctccttattttgtggctttggtgccacaggaagaagagttggatgaccagaaaattcaggtgactcctccaggcttccagctggtctttttaccctttgctgatgataaaaggaagatgccctttactgaaaaaatcatggcaactccagagcaggtgggcaagatgaaggctatcgttgagaagcttcgcttcacatacagaagtgacagctttgagaaccccgtgctgcagcagcacttcaggaacctggaggccttggccttggatttgatggagccggaacaagcagtggacctgacattgcccaaggttgaagcaatgaataaaagactgggctccttggtggatgagtttaaggagcttgtttacccaccagattacaatcctgaagggaaagttaccaagagaaaacacgataatgaaggttctggaagcaaaaggcccaaggtggagtattcagaagaggagctgaagacccacatcagcaagggtacgctgggcaagttcactgtgcccatgctgaaagaggcctgccgggcttacgggctgaagagtgggctgaagaagcaggagctgctggaagccctcaccaagcacttccaggactgaccagaggccgcgcgtccagctgcccttccgcagtgtggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttactttactgcctgaataaagagccctaagtttgtactata

SEQ ID NO: 313759 - DNA, 2150 bp, Homo sapiens
aattaggctaggtacgaggctgggtgtggtaagcgggccgttatccatttgtgttgttcgccagctaggcctggcctcgtcccgcttcgctcggtcggtctcgcgcgcccccatagccttgctagagggttagcgttagccttaagtgtgcgaatccgaggagcagcgacagactcgagaccacgctccttcctcgggaaggaggcggcacctcgcgtttgaggcccgcctgcgtttgaggcccgcctgcgcttgcggcccgcctgcgcttgaggcctgtctgcgtttgagatctcattgggcgtgattgaggaatttggggaggtttttgggcggtattgaggacgagggggtccgttagtcagcatagaatcctggagcgggaatccctcaccgtctaaatggcgtcgggggcgggacctccgggatctggcttccgcgggccgccgccggccctgaaacgtgagggatagctgagatgaggcagctactgggatggcccccatgcgcatttacatgcagtccgactgccgagctttcgaggcagcaggatttaccgtccacattcctcactactaaccaagcttttagaacagatctcacaagaacctagaggtcggtattttttcgatttaaatttgcctgttactgacgttaacgtctttcgcctagtgagcagtagccaacatgtcagggtgggagtcatattacaaaaccgagggcgatgaagaagcagaggaagaacaagaagagaaccttgaagcaagtggagactataaatattcaggaagagatagtttgatttttttggttgatgcctccaaggctatgtttgaatctcagagtgaagatgagttgacaccttttgacatgagcatccagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcagatctatgggagtcgtcagattatactggagaaagaggaaacagaagagctaaaacggtttgatgatccaggtttgatgctcatgggtttcaagccgttggtactgctgaagaaacaccattacctgaggccctccctgttcgtgtacccagaggagtcgctggtgattgggagctcaaccctgttcagtgctctgctcatcaagtgtctggagaaggaggttgcagcattgtgcagatacacaccccgcaggaacatccctccttattttgtggctttggtgccacaggaagaagagttggatgaccagaaaattcaggtgactcctccaggcttccagctggtctttttaccctttgctgatgataaaaggaagatgccctaacttccttcacatacagaatttaccacttttataacgccgtacttcaacagcaccttaagaaccctgaggcccttgcccttgtattgattgaaccctaacaaaccattaccctaccattc

SEQ ID NO: 313760 - DNA, 1273 bp, Homo sapiens
cgcgctgcaggaattcggcacgagcaggaagcgagcactcagcaggttaaagctgaagctcaacaaagatatagtgatctctgtgggcatttataatctggtccagaaggctctcaagcctcctccaataaagctctatcgggaaacaaatgaaccagtgaaaaccaagacccggacatctatgggagtcgtcagattatactggagaaagaggaaacagaagagctaaaacggtttgatgatccaggtttgatgctcatgggtttcaagccgttggtactgctgaagaaacaccattacctgaggccctccctgttcgtgtacccagaggagtcgctggtgattgggagctcaaccctgttcagtgctctgctcatcaagtgtctggagaaggaggttgcagcattgtgcagatacacaccccgcaggaacatccctccttattttgtggctttggtgccacaggaagaagagttggatgaccagaaaattcaggtgactcctccaggcttccagctggtctttttaccctttgctgatgataaaaggaagatgccctttactgaaaaaatcatggcaactccagagcaggtgggcaagatgaaggctatcgttgagaagcttcgcttcacatacagaagtgacagctttgagaaccccgtgctgcagcagcacttcaggaacctggaggccttggccttggatttgatggagccggaacaagcagtggacctgacattgcccaaggttgaagcaatgaataaaagactgggctccttggtggatgagtttaaggagcttgtttacccaccagattacaatcctgaagggaaagttaccaagagaaaacacgataatgaaggttctggaagcaaaaggcccaaggtggagtattcagaagaggagctgaagacccacatcagcaagggtacgctgggcaagttcactgtgcccatgctgaaagaggcctgccgggcttacgggctgaagagtgggctgaagaagcaggagctgctggaagccctcaccaagcacttccaggactgaccagaggccgcgcgtccagctgcccttccgcagtgtggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttactttactgcctgaataaagagccctaagtttgtactata

SEQ ID NO: 313761 - DNA, 1794 bp, Homo sapiens
  misc_feature (1648)..(1649): n is a, c, g, or t
  misc_feature (1651)..(1651): n is a, c, g, or t
  misc_feature (1653)..(1653): n is a, c, g, or t
  misc_feature (1655)..(1655): n is a, c, g, or t
aattaggctaggtacgaggctgggtgtggtaagcgggccgttatccatttgtgttgttcgccagctaggcctggcctcgtcccgcttcgctcggtcggtctcgcgcgcccccatagccttgctagagggttagcgttagccttaagtgtgcgaatccgaggagcagcgacagactcgagaccacgctccttcctcgggaaggaggcggcacctcgcgtttgaggcccgcctgcgtttgaggcccgcctgcgcttgcggcccgcctgcgcttgaggcctgtctgcgtttgagatctcattgggcgtgattgaggaatttggggaggtttttgggcggtattgaggacgagggggtccgttagtcagcatagaatcctggagcgggaatccctcaccgtctaaatggcgtcgggggcgggacctccgggatctggcttccgcgggccgccgccggccctgaaacgtgagggatagctgagatgaggcagctactgggatggcccccatgcgcatttacatgcagtccgactgccgagctttcgaggcagcaggatttaccgtccacattcctcactactaaccaagcttttagaacagatctcacaagaacctagaggtcggtattttttcgatttaaatttgcctgttactgacgttaacgtctttcgcctagtgagcagtagccaacatgtcagggtgggagtcatattacaaaaccgagggcgatgaagaagcagaggaagaacaagaagagaaccttgaagcaagtggagactataaatattcaggaagagatagtttgatttttttggttgatgcctccaaggctatgtttgaatctcagagtgaagatgagttgacaccttttgacatgagcatccagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcagnnantntnggagcgcagatatacgcgaagagaaccgaggacgcaaggtgcgaccgggtgacgcgcagggtcacgccgggtcgggaaaaccgcgaggcccggggtccagggcggaggcccccccgcgcccaagtgaaggggtggaacg

SEQ ID NO: 313762 - DNA, 1635 bp, Homo sapiens
  misc_feature (1464)..(1464): n is a, c, g, or t
  misc_feature (1471)..(1472): n is a, c, g, or t
aattaggctaggtacgaggctgggtgtggtaagcgggccgttatccatttgtgttgttcgccagctaggcctggcctcgtcccgcttcgctcggtcggtctcgcgcgcccccatagccttgctagagggttagcgttagccttaagtgtgcgaatccgaggagcagcgacagactcgagaccacgctccttcctcgggaaggaggcggcacctcgcgtttgaggcccgcctgcgtttgaggcccgcctgcgcttgcggcccgcctgcgcttgaggcctgtctgcgtttgagatctcattgggcgtgattgaggaatttggggaggtttttgggcggtattgaggacgagggggtccgttagtcagcatagaatcctggagcgggaatccctcaccgtctaaatggcgtcgggggcgggacctccgggatctggcttccgcgggccgccgccggccctgaaacgtgagggatagctgagatgaggcagctactgggatggcccccatgcgcatttacatgcagtccgactgccgagctttcgaggcagcaggatttaccgtccacattcctcactactaaccaagcttttagaacagatctcacaagaacctagaggtcggtattttttcgatttaaatttgcctgttactgacgttaacgtctttcgcctagtgagcagtagccaacatgtcagggtgggagtcatattacaaaaccgagggcgatgaagaagcagaggaagaacaagaagagaaccttgaagcaagtggagactataaatattcaggaagagatagtttgatttttttggttgatgcctccaaggctatgtttgaatctcagagtgaagatgagttgacaccttttgacatgagcatccagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcagtaangtgaggnnacaagattgtggtccggggggtaaaacggcaaggggctaagcccaaaaggtgtgggaactggcctggaacgcggctataacacggggggtcggcagacaaggcatagggagcgaatgagaaaaagacaaggtcacaagtggcggggaaaaccgccagaagatc

SEQ ID NO: 313763 - DNA, 2447 bp, Homo sapiens
aattaggctaggtacgaggctgggtgtggtaagcgggccgttatccatttgtgttgttcgccagctaggcctggcctcgtcccgcttcgctcggtcggtctcgcgcgcccccatagccttgctagagggttagcgttagccttaagtgtgcgaatccgaggagcagcgacagactcgagaccacgctccttcctcgggaaggaggcggcacctcgcgtttgaggcccgcctgcgtttgaggcccgcctgcgcttgcggcccgcctgcgcttgaggcctgtctgcgtttgagatctcattgggcgtgattgaggaatttggggaggtttttgggcggtattgaggacgagggggtccgttagtcagcatagaatcctggagcgggaatccctcaccgtctaaatggcgtcgggggcgggacctccgggatctggcttccgcgggccgccgccggccctgaaacgtgagggatagctgagatgaggcagctactgggatggcccccatgcgcatttacatgcagtccgactgccgagctttcgaggcagcaggatttaccgtccacattcctcactactaaccaagcttttagaacagatctcacaagaacctagaggtcggtattttttcgatttaaatttgcctgttactgacgttaacgtctttcgcctagtgagcagtagccaacatgtcagggtgggagtcatattacaaaaccgagggcgatgaagaagcagaggaagaacaagaagagaaccttgaagcaagtggagactataaatattcaggaagagatagtttgatttttttggttgatgcctccaaggctatgtttgaatctcagagtgaagatgagttgacaccttttgacatgagcatccagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcagggtgtgcactcagcccgggtcagctgcctacactgcccttaaatcagaagcaggctgggcgcggtggctcacacctgtaatcccaacagtttgggaggccaaggcaggcggattgcttgagcctaggagttgagaccagcttgggcaacatggcaagaccctctctctacctaaaaaaaaaaaaaaaaaaatcagaagcaatgcactgctacacattgcttaacaaaccagaagcaatacattgctctgacctgactggctacttaactcgactatgccactgcctcactgtcttcctctaaaatagtttatttcaggatagcagaagctatttgctgctttatctctggcaagagctggcatgatatttctctaaagtaacacagccctccatttcgtgggggtagacagttatggtctaagagtatccttagctgtactcactagtacagtcatgtgttaattaatgatagggataccttcttagaattgcgtcattaggcgattttgtcattgtgcaaacatagagggtacttcacacacccagagagtacagcttgactacacacctgggctgtgtggttagcctgttgctcttaggctacaaacctgtatagcatattaccatactgtttactgtaggcaatggtaagtatttgtgtatctaaatgtatctaaaggtatagaaaaggtacaataaaaatatgatataggccagacacggtggctcacgccttgtaatcccaccactttgggatgccgaggcgggtggatcacaagttcaagagattgagaccatcctggcctacatggtgaaaccttgttctctactaaagatacaaaaattagctggacgtgatggcgcgcgcctgtagtcccagctactcaggaggctgagaatcgcttgaacccaggagtcagaggtggcagtgagccaagatcatgccactgcactccagcctggtgacaaagtgagactccgcctca

SEQ ID NO: 313764 - DNA, 1056 bp, Homo sapiens
  misc_feature (885)..(885): n is a, c, g, or t
  misc_feature (892)..(893): n is a, c, g, or t
aattaggctaggtacgaggctgggtgtggtaagcgggccgttatccatttgtgttgttcgccagctaggcctggcctcgtcccgcttcgctcgtgagcagtagccaacatgtcagggtgggagtcatattacaaaaccgagggcgatgaagaagcagaggaagaacaagaagagaaccttgaagcaagtggagactataaatattcaggaagagatagtttgatttttttggttgatgcctccaaggctatgtttgaatctcagagtgaagatgagttgacaccttttgacatgagcatccagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcagtaangtgaggnnacaagattgtggtccggggggtaaaacggcaaggggctaagcccaaaaggtgtgggaactggcctggaacgcggctataacacggggggtcggcagacaaggcatagggagcgaatgagaaaaagacaaggtcacaagtggcggggaaaaccgccagaagatc

SEQ ID NO: 313765 - DNA, 1504 bp, Homo sapiens
  misc_feature (1390)..(1390): n is a, c, g, or t
  misc_feature (1404)..(1404): n is a, c, g, or t
aattaggctaggtacgaggctgggtgtggtaagcgggccgttatccatttgtgttgttcgccagctaggcctggcctcgtcccgcttcgctcggtcggtctcgcgcgcccccatagccttgctagagggttagcgttagccttaagtgtgcgaatccgaggagcagcgacagactcgagaccacgctccttcctcgggaaggaggcggcacctcgcgtttgaggcccgcctgcgtttgaggcccgcctgcgcttgcggcccgcctgcgcttgaggcctgtctgcgtttgagatctcattgggcgtgattgaggaatttggggaggtttttgggcggtattgaggacgagggggtccgttagtcagcatagaatcctggagcgggaatccctcaccgtctaaatggcgtcgggggcgggacctccgggatctggcttccgcgggccgccgccggccctgaaacgtgagggatagctgagatgaggcagctactgggatggcccccatgcgcatttacatgcagtccgactgccgagctttcgaggcagcaggatttaccgtccacattcctcactactaaccaagcttttagaacagatctcacaagaacctagaggtcggtattttttcgatttaaatttgcctgttactgacgttaacgtctttcgcctagtgagcagtagccaacatgtcagggtgggagtcatattacaaaaccgagggcgatgaagaagcagaggaagaacaagaagagaaccttgaagcaagtggagactataaatattcaggaagagatagtttgatttttttggttgatgcctccaaggctatgtttgaatctcagagtgaagatgagttgacaccttttgacatgagcatccagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggtccttgggatcnaagtaaactgtggnaggtccccgagaccagaagacctgagtagggagcaagaatgactgggtaacgcaaagcacccaaattggaataggaaccgtaagagttccaaagaaggat

SEQ ID NO: 313766 - DNA, 1942 bp, Homo sapiens
  misc_feature (1796)..(1797): n is a, c, g, or t
  misc_feature (1799)..(1799): n is a, c, g, or t
  misc_feature (1801)..(1801): n is a, c, g, or t
  misc_feature (1803)..(1803): n is a, c, g, or t
aattaggctaggtacgaggctgggtgtggtaagcgggccgttatccatttgtgttgttcgccagctaggcctggcctcgtcccgcttcgctcggtcggtctcgcgcgcccccatagccttgctagagggttagcgttagccttaagtgtgcgaatccgaggagcagcgacagactcgagaccacgctccttcctcgggaaggaggcggcacctcgcgtttgaggcccgcctgcgtttgaggcccgcctgcgcttgcggcccgcctgcgcttgaggcctgtctgcgtttgagatctcattgggcgtgattgaggaatttggggaggtttttgggcggtattgaggacgagggggtccgttagtcagcatagaatcctggagcgggaatccctcaccgtctaaatggcgtcgggggcgggacctccgggatctggcttccgcgggccgccgccggccctgaaacgtgagggatagctgagatgaggcagctactgggatggcccccatgcgcatttacatgcagtccgactgccgagctttcgaggcagcaggatttaccgtccacattcctcactactaaccaagcttttagaacagatctcacaagaacctagaggtcggtattttttcgatttaaatttgcctgttactgacgttaacgtctttcgcctagtgagcagtagccaacatgtcagggtgggagtcatattacaaaaccgagggcgatgaagaagcagaggaagaacaagaagagaaccttgaagcaagtggagactataaatattcaggaagagatagtttgatttttttggttgatgcctccaaggctatgtttgaatctcagagtgaagatgagttgacaccttttgacatgagcatccaggcagaggaccctgaggccttccgcagtgtttgtgtccctgggtacttgagattagggagtggtgatgactcttaacgagcatgctgccttcaatccatttaaccctgagtggacacagcacatgtttcagagagcacagggttgtgggtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcagnnantntnggagcgcagatatacgcgaagagaaccgaggacgcaaggtgcgaccgggtgacgcgcagggtcacgccgggtcgggaaaaccgcgaggcccggggtccagggcggaggcccccccgcgcccaagtgaaggggtggaacg

SEQ ID NO: 313767 - DNA, 1228 bp, Homo sapiens
aattaggctaggtacgaggctgggtgtggtaagcgggccgttatccatttgtgttgttcgccagctaggcctggcctcgtcccgcttcgctcggtcggtctcgcgcgcccccatagccttgctagagggttagcgttagccttaagtgtgcgaatccgaggagcagcgacagactcgagaccacgctccttcctcgggaaggaggcggcacctcgcgtttgaggcccgcctgcgtttgaggcccgcctgcgcttgcggcccgcctgcgcttgaggcctgtctgcgtttgagatctcattgggcgtgattgaggaatttggggaggtttttgggcggtattgaggacgagggggtccgttagtcagcatagaatcctggagcgggaatccctcaccgtctaaatggcgtcgggggcgggacctccgggatctggcttccgcgggccgccgccggccctgaaacgtgagggatagctgagatgaggcagctactgggatggcccccatgcgcatttacatgcagtccgactgccgagctttcgaggcagcaggatttaccgtccacattcctcactactaaccaagcttttagaacagatctcacaagaacctagaggtcggtattttttcgatttaaatttgcctgttactgacgttaacgtctttcgcctagtgagcagtagccaacatgtcagggtgggagtcatattacaaaaccgagggcgatgaagaagcagaggaagaacaagaagagaaccttgaagcaagtggagactataaatattcaggaagagatagtttgatttttttggttgatgcctccaaggctatgtttgaatctcagagtgaagatgagttgacaccttttgacatgagcatccagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccagctgcccttccgcagtgtggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttactttactgcctgaataaagagccctaagtttgtactata

SEQ ID NO: 313768 - DNA, 861 bp, Homo sapiens
aattaggctaggtacgaggctgggtgtggtaagcgggccgttatccatttgtgttgttcgccagctaggcctggcctcgtcccgcttcgctcggtcggtctcgcgcgcccccatagccttgctagagggttagcgttagccttaagtgtgcgaatccgaggagcagcgacagactcgagaccacgctccttcctcgggaaggaggcggcacctcgcgtttgaggcccgcctgcgtttgaggcccgcctgcgcttgcggcccgcctgcgcttgaggcctgtctgcgtttgagatctcattgggcgtgattgaggaatttggggaggtttttgggcggtattgaggacgagggggtccgttagtcagcatagaatcctggagcgggaatccctcaccgtctaaatggcgtcgggggcgggacctccgggatctggcttccgcgggccgccgccggccctgaaacgtgagggatagctgagatgaggcagctactgggatggcccccatgcgcatttacatgcagtccgactgccgagctttcgaggcagcaggatttaccgtccacattcctcactactaaccaagcttttagaacagatctcacaagaacctagaggtcggtattttttcgatttaaatttgcctgttactgacgttaacgtctttcgcctagtgagcagtagccaacatgtcagggtgggagtcatattacaaaaccgagggcgatgaagaagcagaggaagaacaagaagagaaccttgaagcaagtgagactatgaatattcaggaaattaaaagtattacagaaataaatgctaactttgaaaagagtgtaagactcaataaagacaggcaaaataag

SEQ ID NO: 313769 - DNA, 354 bp, Homo sapiens
tgggaccacaggcgtgcaccaacatgcctggctgatttttaaattttttgtagagacagggtctcaccatgttgtccaagctggtcttgaactgctagactcaagcattccgcctaccttggcctaccaaagtgctgggattacaggcatgggctactgcacctgacctcaactgttttacttggggtgtttttctcagctcaccccggacctgtagtatctcaggtggttttattctaattttttcaatgtttaaattgtcatgtttcagttgagttacattattgttttaacagaagtgacagctttgagaaccccgtgctgcagcagcacttcaggaacctggaggccttg

SEQ ID NO: 313770 - DNA, 338 bp, Homo sapiens
gttgatgcctccaaggctatgtttgaatctcagagtgaagatgagttgacaccttttgacatgagcatccaggtaagactaccttttaatttaagacaaatttaaaaacagtattggctgggcatggtggcggctcatgcctgtaatctcaggacattgggaggccgagacgggcagatcacttgagcctaggagtttgagaccaacctggtaacatggagaaaccccgtctctacaaaaaatacacaaatcatccaggtgtggtggtgcaaacctgtagtcctagctactcaggaggccgaggcgagaggcttgcttgagcccaggaggtcaaacag

SEQ ID NO: 313771 - DNA, 993 bp, Homo sapiens
  misc_feature (27)..(27): n is a, c, g, or t
  misc_feature (802)..(802): n is a, c, g, or t
  misc_feature (825)..(825): n is a, c, g, or t
  misc_feature (829)..(829): n is a, c, g, or t
ttggctggtacgaggctgggttgaatnggccgaggagttggtcgcttccctgcgccaaagtgagcagtagccaacatgtcagggtgggagtcatattacaaaaccgagggcgatgaagaagcagaggaagaacaagaagagaaccttgaagcaagtggagactataaatattcaggaagagatagtttgatttttttggttgatgcctccaaggctatgtttgaatctcagagtgaagatgagttgacaccttttgacatgagcatccagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttccttgggggatcaccagttaaactgttgggaagntcgccagggaccggagggcctcngtangggggcacaagaatggcctggggtaaaagggagaaggggacctccaagcttgtggaataccgaacaccgcaataagggggtggcgagacagagcgatgtgggttagaaaaaacatgtggtttccgaaaacccggggactgtcgaacaacggcgcacacgaacgc

SEQ ID NO: 313772 - DNA, 242 bp, Homo sapiens
agcggggcgttgattgggaccgagtacagggcccgcgcatgcgtggattgtcgtcttctgtccaagttggtcgcttccctgcgccaaagtgagcagtagccaacatgtcagggtgggagtcatattacaaaaccgagggcgatgaagaagcagaggaagaacaagaagagaaccttgaagcaagtgagactataaatatctatcacaaccgacttattaaccacccacaatgacttattaaa

SEQ ID NO: 313773 - DNA, 697 bp, Homo sapiens
cggacgcgtgggtcgacccacgcgtccgggctatcggttgagaagcttcgcttcacatacagaagtgacagctttgagaaccccgtgctgcagcagcacttcaggaacctggaggccttggccttggatttgatggagccggaacaagcagtggacctgacattgcccaaggttgaagcaatgaataaaagactgggctccttggtggatgagtttaaggagcttgtttacccaccagattacaatcctgaagggaaagttaccaagagaaaacacgataatgaaggttctggaagcaaaaggcccaaggtggagtattcagaagaggagctgaagacccacatcagcaagggtacgctgggcaagttcactgtgcccatgctgaaagaggcctgccgggcttacgggctgaagagtgggctgaagaagcaggagctgctggaagccctcaccaagcacttccaggactgaccagaggccgcgcgtccagctgcccttccgcagtgtggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttactttactgcctgaataaagagccctaagtttgtactata

SEQ ID NO: 313774 - DNA, 2131 bp, Homo sapiens
  misc_feature (27)..(27): n is a, c, g, or t
ttggctggtacgaggctgggttgaatnggccgaggagttggtcgcttccctgcgccaaagtgagcagtagccaacatgtcagggtgggagtcatattacaaaaccgagggcgatgaagaagcagaggaagaacaagaagagaaccttgaagcaagtggagactataaatattcaggaagagatagtttgatttttttggttgatgcctccaaggctatgtttgaatctcagagtgaagatgagttgacaccttttgacatgagcatccagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcagatctatgggagtcgtcagattatactggagaaagaggaaacagaagagctaaaacggtttgatgatccaggtttgatgctcatgggtttcaagccgttggtactgctgaagaaacaccattacctgaggccctccctgttcgtgtacccagaggagtcgctggtgattgggagctcaaccctgttcagtgctctgctcatcaagtgtctggagaaggaggttgcagcattgtgcagatacacaccccgcaggaacatccctccttattttgtggctttggtgccacaggaagaagagttggatgaccagaaaattcaggtgactcctccaggcttccagctggtctttttaccctttgctgatgataaaaggaagatgccctttactgaaaaaatcatggcaactccagagcaggtgggcaagatgaaggctatcgttgagaagcttcgcttcacatacagaagtgacagctttgagaaccccgtgctgcagcagcacttcaggaacctggaggccttggccttggatttgatggagccggaacaagcagtggacctgacattgcccaaggttgaagcaatgaataaaagactgggctccttggtggatgagtttaaggagcttgtttacccaccagattacaatcctgaagggaaagttaccaagagaaaacacgataatgaaggttctggaagcaaaaggcccaaggtggagtattcagaagaggagctgaagacccacatcagcaagggtacgctgggcaagttcactgtgcccatgctgaaagaggcctgccgggcttacgggctgaagagtgggctgaagaagcaggagctgctggaagccctcaccaagcacttccaggactgaccagaggccgcgcgtccagctgcccttccgcagtgtggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttactttactgcctgaataaagagccctaagtttgtactata

SEQ ID NO: 313775 - DNA, 2150 bp, Homo sapiens
gacaccacacatcgaggcacaagtttgtactagtacgaggcgggtgtgtaatcggacgagggcgcttccctgcgcaaagtgagcagtagccaacatgtcagggtgggagtcatattacaaaaccgagggcgatgaagaagcagaggaagaacaagaagagaaccttgaagcaagtggagactataaatattcaggaagagatagtttgatttttttggttgatgcctccaaggctatgtttgaatctcagagtgaagatgagttgacaccttttgacatgagcatccagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcagatctatgggagtcgtcagattatactggagaaagaggaaacagaagagctaaaacggtttgatgatccaggtttgatgctcatgggtttcaagccgttggtactgctgaagaaacaccattacctgaggccctccctgttcgtgtacccagaggagtcgctggtgattgggagctcaaccctgttcagtgctctgctcatcaagtgtctggagaaggaggttgcagcattgtgcagatacacaccccgcaggaacatccctccttattttgtggctttggtgccacaggaagaagagttggatgaccagaaaattcaggtgactcctccaggcttccagctggtctttttaccctttgctgatgataaaaggaagatgccctttactgaaaaaatcatggcaactccagagcaggtgggcaagatgaaggctatcgttgagaagcttcgcttcacatacagaagtgacagctttgagaaccccgtgctgcagcagcacttcaggaacctggaggccttggccttggatttgatggagccggaacaagcagtggacctgacattgcccaaggttgaagcaatgaataaaagactgggctccttggtggatgagtttaaggagcttgtttacccaccagattacaatcctgaagggaaagttaccaagagaaaacacgataatgaaggttctggaagcaaaaggcccaaggtggagtattcagaagaggagctgaagacccacatcagcaagggtacgctgggcaagttcactgtgcccatgctgaaagaggcctgccgggcttacgggctgaagagtgggctgaagaagcaggagctgctggaagccctcaccaagcacttccaggactgaccagaggccgcgcgtccagctgcccttccgcagtgtggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttactttactgcctgaataaagagccctaagtttgtactata

SEQ ID NO: 313776 - DNA, 2099 bp, Homo sapiens
aattaggctaggtacgaggctgggtgtgtgagcagtagccaacatgtcagggtgggagtcatattacaaaaccgagggcgatgaagaagcagaggaagaacaagaagagaaccttgaagcaagtggagactataaatattcaggaagagatagtttgatttttttggttgatgcctccaaggctatgtttgaatctcagagtgaagatgagttgacaccttttgacatgagcatccagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcagatctatgggagtcgtcagattatactggagaaagaggaaacagaagagctaaaacggtttgatgatccaggtttgatgctcatgggtttcaagccgttggtactgctgaagaaacaccattacctgaggccctccctgttcgtgtacccagaggagtcgctggtgattgggagctcaaccctgttcagtgctctgctcatcaagtgtctggagaaggaggttgcagcattgtgcagatacacaccccgcaggaacatccctccttattttgtggctttggtgccacaggaagaagagttggatgaccagaaaattcaggtgactcctccaggcttccagctggtctttttaccctttgctgatgataaaaggaagatgccctttactgaaaaaatcatggcaactccagagcaggtgggcaagatgaaggctatcgttgagaagcttcgcttcacatacagaagtgacagctttgagaaccccgtgctgcagcagcacttcaggaacctggaggccttggccttggatttgatggagccggaacaagcagtggacctgacattgcccaaggttgaagcaatgaataaaagactgggctccttggtggatgagtttaaggagcttgtttacccaccagattacaatcctgaagggaaagttaccaagagaaaacacgataatgaaggttctggaagcaaaaggcccaaggtggagtattcagaagaggagctgaagacccacatcagcaagggtacgctgggcaagttcactgtgcccatgctgaaagaggcctgccgggcttacgggctgaagagtgggctgaagaagcaggagctgctggaagccctcaccaagcacttccaggactgaccagaggccgcgcgtccagctgcccttccgcagtgtggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttactttactgcctgaataaagagccctaagtttgtactata

SEQ ID NO: 313777 - DNA, 2945 bp, Homo sapiens
aattaggctaggtacgaggctgggtgtggtaagcgggccgttatccatttgtgttgttcgccagctaggcctggcctcgtcccgcttcgctcggtcggtctcgcgcgcccccatagccttgctagagggttagcgttagccttaagtgtgcgaatccgaggagcagcgacagactcgagaccacgctccttcctcgggaaggaggcggcacctcgcgtttgaggcccgcctgcgtttgaggcccgcctgcgcttgcggcccgcctgcgcttgaggcctgtctgcgtttgagatctcattgggcgtgattgaggaatttggggaggtttttgggcggtattgaggacgagggggtccgttagtcagcatagaatcctggagcgggaatccctcaccgtctaaatggcgtcgggggcgggacctccgggatctggcttccgcgggccgccgccggccctgaaacgtgagggatagctgagatgaggcagctactgggatggcccccatgcgcatttacatgcagtccgactgccgagctttcgaggcagcaggatttaccgtccacattcctcactactaaccaagcttttagaacagatctcacaagaacctagaggtcggtattttttcgatttaaatttgcctgttactgacgttaacgtctttcgcctagtgagcagtagccaacatgtcagggtgggagtcatattacaaaaccgagggcgatgaagaagcagaggaagaacaagaagagaaccttgaagcaagtggagactataaatattcaggaagagatagtttgatttttttggttgatgcctccaaggctatgtttgaatctcagagtgaagatgagttgacaccttttgacatgagcatccagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcagatctatgggagtcgtcagattatactggagaaagaggaaacagaagagctaaaacggtttgatgatccaggtttgatgctcatgggtttcaagccgttggtactgctgaagaaacaccattacctgaggccctccctgttcgtgtacccagaggagtcgctggtgattgggagctcaaccctgttcagtgctctgctcatcaagtgtctggagaaggaggttgcagcattgtgcagatacacaccccgcaggaacatccctccttattttgtggctttggtgccacaggaagaagagttggatgaccagaaaattcaggtgactcctccaggcttccagctggtctttttaccctttgctgatgataaaaggaagatgccctttactgaaaaaatcatggcaactccagagcaggtgggcaagatgaaggctatcgttgagaagcttcgcttcacatacagaagtgacagctttgagaaccccgtgctgcagcagcacttcaggaacctggaggccttggccttggatttgatggagccggaacaagcagtggacctgacattgcccaaggttgaagcaatgaataaaagactgggctccttggtggatgagtttaaggagcttgtttacccaccagattacaatcctgaagggaaagttaccaagagaaaacacgataatgaaggttctggaagcaaaaggcccaaggtggagtattcagaagaggagctgaagacccacatcagcaagggtacgctgggcaagttcactgtgcccatgctgaaagaggcctgccgggcttacgggctgaagagtgggctgaagaagcaggagctgctggaagccctcaccaagcacttccaggactgaccagaggccgcgcgtccagctgcccttccgcagtgtggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttactttactgcctgaataaagagccctaagtttgtactataaaaaaaaaaaaacaaacaacaaaagaaaaaaaaaaaaaaaaagaggagaaaaaaaagaaggggggggagaaaaaaaagggggggggggaaaaatgggggggggggggaaaaaggggtagagggggggggggggggatgtgttggaagaagggattgggggaggggggaaaaagggggggggaaatgggggggggagaggggg

SEQ ID NO: 313778 - DNA, 2291 bp, Homo sapiens
aattaggctaggtacgaggctgggtgtggtaagcgggccgttatccatttgtgttgttcgccagctaggcctggcctcgtcccgcttcgctcggtcggtctcgcgcgcccccatagccttgctagagggttagcgttagccttaagtgtgcgaatccgaggagcagcgacagactcgagaccacgctccttcctcgggaaggaggcggcacctcgcgtttgaggcccgcctgcgtttgaggcccgcctgcgcttgcggcccgcctgcgcttgagtgagcagtagccaacatgtcagggtgggagtcatattacaaaagagactataaatattcaggaagagatagtttgatttttttggttgatgcctccaaggctatgtttgaatctcagagtgaagatgagttgacaccttttgacatgagcatccagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcagatctatgggagtcgtcagattatactggagaaagaggaaacagaagagctaaaacggtttgatgatccaggtttgatgctcatgggtttcaagccgttggtactgctgaagaaacaccattacctgaggccctccctgttcgtgtacccagaggagtcgctggtgattgggagctcaaccctgttcagtgctctgctcatcaagtgtctggagaaggaggttgcagcattgtgcagatacacaccccgcaggaacatccctccttattttgtggctttggtgccacaggaagaagagttggatgaccagaaaattcaggtgactcctccaggcttccagctggtctttttaccctttgctgatgataaaaggaagatgccctttactgaaaaaatcatggcaactccagagcaggtgggcaagatgaaggctatcgttgagaagcttcgcttcacatacagaagtgacagctttgagaaccccgtgctgcagcagcacttcaggaacctggaggccttggccttggatttgatggagccggaacaagcagtggacctgacattgcccaaggttgaagcaatgaataaaagactgggctccttggtggatgagtttaaggagcttgtttacccaccagattacaatcctgaagggaaagttaccaagagaaaacacgataatgaaggttctggaagcaaaaggcccaaggtggagtattcagaagaggagctgaagacccacatcagcaagggtacgctgggcaagttcactgtgcccatgctgaaagaggcctgccgggcttacgggctgaagagtgggctgaagaagcaggagctgctggaagccctcaccaagcacttccaggactgaccagaggccgcgcgtccagctgcccttccgcagtgtggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttactttactgcctgaataaagagccctaagtttgtactata

SEQ ID NO: 313779 - DNA, 3197 bp, Homo sapiens
aattaggctaggtacgaggctgggtgtggtaagcgggccgttatccatttgtgttgttcgccagctaggcctggcctcgtcccgcttcgctcggtcggtctcgcgcgcccccatagccttgctagagggttagcgttagccttaagtgtgcgaatccgaggagcagcgacagactcgagaccacgctccttcctcgggaaggaggcggcacctcgcgtttgaggcccgcctgcgtttgaggcccgcctgcgcttgcggcccgcctgcgcttgaggcctgtctgcgtttgagatctcattgggcgtgattgaggaatttggggaggtttttgggcggtattgaggacgagggggtccgttagtcagcatagaatcctggagcgggaatccctcaccgtctaaatggcgtcgggggcgggacctccgggatctggcttccgcgggccgccgccggccctgaaacgtgagggatagctgagatgaggcagctactgggatggcccccatgcgcatttacatgcagtccgactgccgagctttcgaggcagcaggatttaccgtccacattcctcactactaaccaagcttttagaacagatctcacaagaacctagaggtcggtattttttcgatttaaatttgcctgttactgacgttaacgtctttcgcctagtgagcagtagccaacatgtcagggtgggagtcatattacaaaaccgagggcgatgaagaagcagaggaagaacaagaagagaaccttgaagcaagtggagactataaatattcaggaagagatagtttgatttttttggttgatgcctccaaggctatgtttgaatctcagagtgaagatgagttgacaccttttgacatgagcatccagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcagatctatgggagtcgtcagattatactggagaaagaggaaacagaagagctaaaacggtttgatgatccaggtttgatgctcatgggtttcaagccgttggtactgctgaagaaacaccattacctgaggccctccctgttcgtgtacccagaggagtcgctggtgattgggagctcaaccctgttcagtgctctgctcatcaagtgtctggagaaggaggttgcagcattgtgcagatacacaccccgcaggaacatccctccttattttgtggctttggtgccacaggaagaagagttggatgaccagaaaattcaggtgactcctccaggcttccagctggtctttttaccctttgctgatgataaaaggaagatgccctttactgaaaaaatcatggcaactccagagcaggtgggcaagatgaaggctatcgttgagaagcttcgcttcacatacagaagtgacagctttgagaaccccgtgctgcagcagcacttcaggaacctggaggccttggccttggatttgatggagccggaacaagcagtggacctgacattgcccaaggttgaagcaatgaataaaagactgggctccttggtggatgagtttaaggagcttgtttacccaccagattacaatcctgaagggaaagttaccaagagaaaacacgataatgaaggttctggaagcaaaaggcccaaggtggagtattcagaagaggagctgaagacccacatcagcaagggtacgctgggcaagttcactgtgcccatgctgaaagaggcctgccgggcttacgggctgaagagtgggctgaagaagcaggagctgctggaagccctcaccaagcacttccaggactgaccagaggccgcgcgtccagctgcccttccgcagtgtggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttactttactgcctgaataaagagccctaagtttgtactatactaaaacaaaaacacaccacccacccaccaacacacccttttttcccccgctccccgccccacacacaaaccttttcacacacccacccccggggcccagggcccacacctagctcactcgaaccccgcgccccccaacgctgcccccccgagaaaccccggccgccgaacaccagccgccggcctccccccccgataaacaccgcccggggggcaccccgcagccttccgtaccacctccccacagggcgctccgagcagccccacgggaccctaatccccacgcatccaaggcgacccaatacaatacccccgcgcacggtcacccgacgtacctccgcgcccccagccgcaaccccgaacaaccacccacccacaccaccccccctgcgcccagccggccacgcccaccgcgcgccaaccccagccccaaaccgcccaaccccaccactcc

SEQ ID NO: 313780 - DNA, 2891 bp, Homo sapiens
aattaggctaggtacgaggctgggtgtggtaagcgggccgttatccatttgtgttgttcgccagctaggcctggcctcgtcccgcttcgctcggtcggtctcgcgcgcccccatagccttgctagagggttagcgttagccttaagtgtgcgaatccgaggagcagcgacagactcgagaccacgctccttcctcgggaaggaggcggcacctcgcgtttgaggcccgcctgcgtttgaggcccgcctgcgcttgcggcccgcctgcgcttgaggcctgtctgcgtttgagatctcattgggcgtgattgaggaatttggggaggtttttgggcggtattgaggacgagggggtccgttagtcagcatagaatcctggagcgggaatccctcaccgtctaaatggcgtcgggggcgggacctccgggatctggcttccgcgggccgccgccggccctgaaacgtgagggatagctgagatgaggcagctactgggatggcccccatgcgcatttacatgcagtccgactgccgagctttcgaggcagcaggatttaccgtccacattcctcactactaaccaagcttttagaacagatctcacaagaacctagaggtcggtattttttcgatttaaatttgcctgttactgacgttaacgtctttcgcctagtgagcagtagccaacatgtcagggtgggagtcatattacaaaaccgagggcgatgaagaagcagaggaagaacaagaagagaaccttgaagcaagtggagactataaatattcaggaagagatagtttgatttttttggttgatgcctccaaggctatgtttgaatctcagagtgaagatgagttgacaccttttgacatgagcatccaggcagaggaccctgaggccttccgcagtgtttgtgtccctgggtacttgagattagggagtggtgatgactcttaacgagcatgctgccttcaatccatttaaccctgagtggacacagcacatgtttcagagagcacagggttgtgggtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcagatctatgggagtcgtcagattatactggagaaagaggaaacagaagagctaaaacggtttgatgatccaggtttgatgctcatgggtttcaagccgttggtactgctgaagaaacaccattacctgaggccctccctgttcgtgtacccagaggagtcgctggtgattgggagctcaaccctgttcagtgctctgctcatcaagtgtctggagaaggaggttgcagcattgtgcagatacacaccccgcaggaacatccctccttattttgtggctttggtgccacaggaagaagagttggatgaccagaaaattcaggtgactcctccaggcttccagctggtctttttaccctttgctgatgataaaaggaagatgccctttactgaaaaaatcatggcaactccagagcaggtgggcaagatgaaggctatcgttgagaagcttcgcttcacatacagaagtgacagctttgagaaccccgtgctgcagcagcacttcaggaacctggaggccttggccttggatttgatggagccggaacaagcagtggacctgacattgcccaaggttgaagcaatgaataaaagactgggctccttggtggatgagtttaaggagcttgtttacccaccagattacaatcctgaagggaaagttaccaagagaaaacacgataatgaaggttctggaagcaaaaggcccaaggtggagtattcagaagaggagctgaagacccacatcagcaagggtacgctgggcaagttcactgtgcccatgctgaaagaggcctgccgggcttacgggctgaagagtgggctgaagaagcaggagctgctggaagccctcaccaagcacttccaggactgaccagaggccgcgcgtccagctgcccttccgcagtgtggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttactttactgcctgaataaagagccctaagtttgtactata

SEQ ID NO: 313781 - DNA, 2617 bp, Homo sapiens
aattaggctaggtacgaggctgggtgtggtaagcgggccgttatccatttgtgttgttcgccagctaggcctggcctcgtcccgcttcgctcggtcggtctcgcgcgcccccatagccttgctagagggttagcgttagccttaagtgtgcgaatccgaggagcagcgacagactcgagaccacgctccttcctcgggaaggaggcggcacctcgcgtttgaggcccgcctgcgtttgaggcccgcctgcgcttgcggcccgcctgcgcttgaggcctgtctgcgtttgagatctcattgggcgtgattgaggaatttggggaggtttttgggcggtattgaggacgagggggtccgttagtcagcatagaatcctggagcgggaatccctcaccgtctaaatggcgtcgggggcgggacctccgggatctggcttccgcgggccgccgccggccctgaaacgtgagggatagctgagatgaggcagctactgggatggcccccatgcgcatttacatgcagtccgactgccgagctttcgaggcagcaggatttaccgtccacattcctcactactaaccaagcttttagaacagatctcacaagaacctagaggtcggtattttttcgatttaaatttgcctgttactgacgttaacgtctttcgcctagtgagcagtagccaacatgtcagggtgggagtcatattacaaaaccgagggcgatgaagaagcagaggaagaacaagaagagaaccttgaagcaagtggagactataaatattcaggaagagatagtttgatttttttggttgatgcctccaaggctatgtttgaatctcagagtgaagatgagttgacaccttttgacatgagcatccagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcagatctatgggagtcgtcagattatactggagaaagaggaaacagaagagctaaaacggtttgatgatccaggtttgatgctcatgggtttcaagccgttggtactgctgaagaaacaccattacctgaggccctccctgttcgtgtacccagaggagtcgctggtgattgggagctcaaccctgttcagtgctctgctcatcaagtgtctggagaaggaggttgcagcattgtgcagatacacaccccgcaggaacatccctccttattttgtggctttggtgccacaggaagaagagttggatgaccagaaaattcaggtgactcctccaggcttccagctggtctttttaccctttgctgatgataaaaggaagatgcccctggaggccttggccttggatttgatggagccggaacaagcagtggacctgacattgcccaaggttgaagcaatgaataaaagactgggctccttggtggatgagtttaaggagcttgtttacccaccagattacaatcctgaagggaaagttaccaagagaaaacacgataatgaaggttctggaagcaaaaggcccaaggtggagtattcagaagaggagctgaagacccacatcagcaagggtacgctgggcaagttcactgtgcccatgctgaaagaggcctgccgggcttacgggctgaagagtgggctgaagaagcaggagctgctggaagccctcaccaagcacttccaggactgaccagaggccgcgcgtccagctgcccttccgcagtgtggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttactttactgcctgaataaagagccctaagtttgtactata

SEQ ID NO: 313782 - DNA, 2585 bp, Homo sapiens
aattaggctaggtacgaggctgggtgtggtaagcgggccgttatccatttgtgttgttcgccagctaggcctggcctcgtcccgcttcgctcggtcggtctcgcgcgcccccatagccttgctagagggttagcgttagccttaagtgtgcgaatccgaggagcagcgacagactcgagaccacgctccttcctcgggaaggaggcggcacctcgcgtttgaggcccgcctgcgtttgaggcccgcctgcgcttgcggcccgcctgcgcttgaggcctgtctgcgtttgagatctcattgggcgtgattgaggaatttggggaggtttttgggcggtattgaggacgagggggtccgttagtcagcatagaatcctggagcgggaatccctcaccgtctaaatggcgtcgggggcgggacctccgggatctggcttccgcgggccgccgccggccctgaaacgtgagggatagctgagatgaggcagctactgggatggcccccatgcgcatttacatgcagtccgactgccgagctttcgaggcagcaggatttaccgtccacattcctcactactaaccaagcttttagaacagatctcacaagaacctagaggtcggtattttttcgatttaaatttgcctgttactgacgttaacgtctttcgcctagtgagcagtagccaacatgtcagggtgggagtcatattacaaaaccgagggcgatgaagaagcagaggaagaacaagaagagaaccttgaagcaagtggagactataaatattcaggaagagatagtttgatttttttggttgatgcctccaaggctatgtttgaatctcagagtgaagatgagttgacaccttttgacatgagcatccagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcagatctatgggagtcgtcagattatactggagaaagaggaaacagaagagctaaaacggtttgatgatccaggtttgatgctcatgggtttcaagccgttggtactgctgaagaaacaccattacctgaggccctccctgttcgtgtacccagaggagtcgctggtgattgggagctcaaccctgttcagtgctctgctcatcaagtgtctggagaaggaggttgcagcattgtgcagatacacaccccgcaggaacatccctccttattttgtggctttggtgccacaggaagaagagttggatgaccagaaaattcaggtgactcctccaggcttccagctggtctttttaccctttgctgatgataaaaggaagatgccctttactgaaaaaatcatggcaactccagagcaggtgggcaagatgaaggctatcgttgagaagcttcgcttcacatacagaagtgacagctttgagaaccccgtgctgcagcagcacttcaggaacctggaggccttggccttggatttgatggagccggaacaagcagtggacctgacattgcccaaggttgaagcaatgaataaaagactgggctccttggtggatgagtttaaggagcttgtttacccaccagattacaatcctgaagggaaagttaccaagagaaaacacgctgctggaagccctcaccaagcacttccaggactgaccagaggccgcgcgtccagctgcccttccgcagtgtggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttactttactgcctgaataaagagccctaagtttgtactata

SEQ ID NO: 313783 - DNA, 2327 bp, Homo sapiens
aattaggctaggtacgaggctgggtgtggtaagcgggccgttatccatttgtgttgttcgccagctaggcctggcctcgtcccgcttcgctcggtcggtctcgcgcgcccccatagccttgctagagggttagcgttagccttaagtgtgcgaatccgaggagcagcgacagactcgagaccacgctccttcctcgggaaggaggcggcacctcgcgtttgaggcccgcctgcgtttgaggcccgcctgcgcttgcggcccgcctgcgcttgaggcctgtctgcgtttgagatctcattgggcgtgattgaggaatttggggaggtttttgggcggtattgaggacgagggggtccgttagtcagcatagaatcctggagcgggaatccctcaccgtctaaatggcgtcgggggcgggacctccgggatctggcttccgcgggccgccgccggccctgaaacgtgagggatagctgagatgaggcagctactgggatggcccccatgcgcatttacatgcagtccgactgccgagctttcgaggcagcaggatttaccgtccacattcctcactactaaccaagcttttagaacagatctcacaagaacctagaggtcggtattttttcgatttaaatttgcctgttactgacgttaacgtctttcgcctagtgagcagtagccaacatgtcagggtgggagtcatattacaaaaccgagggcgatgaagaagcagaggaagaacaagaagagaaccttgaagcaagtggagactataaatattcaggaagagatagtttgatttttttggttgatgcctccaaggctatgtttgaatctcagagtgaagatgagttgacaccttttgacatgagcatccagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcagatctatgggagtcgtcagattatactggagaaagaggaaacagaagagctaaaacggtttgatgatccaggtttgatgctcatgggtttcaagccgttggtactgctgaagaaacaccattacctgaggccctccctgttcgtgtacccagaggagtcgctggtgattgggagctcaaccctgttcagtgctctgctcatcaagtgtctggagaaggaggttgcagcattgtgcagatacacaccccgcaggaacatccctccttattttgtggctttggtgccacaggaagaagagttggatgaccagaaaattcaggtgactcctccaggcttccagctggtctttttaccctttgctgatgataaaaggaagatgccctttactgaaaaaatcatggcaactccagagcaggtgggcaagatgaaggctatcgttgagaagcttcgcttcacatacagaagtgacagctttgagaaccccgtgctgcagcagcacttcaggaacctggaggccttggccttggatttgatggagccggaacaagcagtggacctgacatggcccaagggtggagcaatgaaataaagactgggccctgggtgggtagtttaaagggctgttaccacccgatttaaccgggggagatccacaaaaagcatagggctgggcaagcccgg

SEQ ID NO: 313784 - DNA, 1991 bp, Homo sapiens
  misc_feature (1907)..(1907): n is a, c, g, or t
  misc_feature (1917)..(1917): n is a, c, g, or t
  misc_feature (1923)..(1923): n is a, c, g, or t
aattaggctaggtacgaggctgggtgtggtaagcgggccgttatccatttgtgttgttcgccagctaggcctggcctcgtcccgcttcgctcggtcggtctcgcgcgcccccatagccttgctagagggttagcgttagccttaagtgtgcgaatccgaggagcagcgacagactcgagaccacgctccttcctcgggaaggaggcggcacctcgcgtttgaggcccgcctgcgtttgaggcccgcctgcgcttgcggcccgcctgcgcttgaggcctgtctgcgtttgagatctcattgggcgtgattgaggaatttggggaggtttttgggcggtattgaggacgagggggtccgttagtcagcatagaatcctggagcgggaatccctcaccgtctaaatggcgtcgggggcgggacctccgggatctggcttccgcgggccgccgccggccctgaaacgtgagggatagctgagatgaggcagctactgggatggcccccatgcgcatttacatgcagtccgactgccgagctttcgaggcagcaggatttaccgtccacattcctcactactaaccaagcttttagaacagatctcacaagaacctagaggtcggtattttttcgatttaaatttgcctgttactgacgttaacgtctttcgcctagtgagcagtagccaacatgtcagggtgggagtcatattacaaaaccgagggcgatgaagaagcagaggaagaacaagaagagaaccttgaagcaagtggagactataaatattcaggaagagatagtttgatttttttggttgatgcctccaaggctatgtttgaatctcagagtgaagatgagttgacaccttttgacatgagcatccagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcagatctatgggagtcgtcagattatactggagaaagaggaaacagaagagctaaaacggtttgatgatccaggtttgatgctcatgggtttcaagccgttggtactgctgaagaaacaccattacctgaggccctccctgttcgtgtacccagaggagtcgctggtgattgggagctcaaccctgttcagtgctctgctcatcaagtgtctggagaaggaggttgcagcattgtgcagatacacaccccgggggaatcctcntatttgggtngggccngaacaattgtttcccaaatcgggctccgctcacggtttcctttggaagggaggctttgaaaagggccg

SEQ ID NO: 313785 - DNA, 1605 bp, Homo sapiens
gacaccacacatcgaggcacaagtttgtactagtacgaggcgggtgtgtaatcggacgagggcgcttccctgcgcaaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcagatctatgggagtcgtcagattatactggagaaagaggaaacagaagagctaaaacggtttgatgatccaggtttgatgctcatgggtttcaagccgttggtactgctgaagaaacaccattacctgaggccctccctgttcgtgtacccagaggagtcgctggtgattgggagctcaaccctgttcagtgctctgctcatcaagtgtctggagaaggaggttgcagcattgtgcagatacacaccccgcaggaacatccctccttattttgtggctttggtgccacaggaagaagagttggatgaccagaaaattcaggtgactcctccagtttactgaaaaaatcatggcaactccagagcaggtgggcaagatgaaggctatcgttgagaagcttcgcttcacatacagaagtgacagctttgagaaccccgtgctgcagcagcacttcaggaacctggaggccttggccttggatttgatggagccggaacaagcagtggacctgacattgcccaaggttgaagcaatgaataaaagactgggctccttggtggatgagtttaaggagcttgtttacccaccagattacaatcctgaagggaaagttaccaagagaaaacacgataatgaaggttctggaagcaaaaggcccaaggtggagtattcagaagaggagctgaagacccacatcagcaagggtacgctgggcaagttcactgtgcccatgctgaaagaggcctgccgggcttacgggctgaagagtgggctgaagaagcaggagctgctggaagccctcaccaagcacttccaggactgaccagaggccgcgcgtccagctgcccttccgcagtgtggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttactttactgcctgaataaagagccctaagtttgtactata

SEQ ID NO: 313786 - DNA, 1558 bp, Homo sapiens
  misc_feature (1469)..(1469): n is a, c, g, or t
  misc_feature (1481)..(1481): n is a, c, g, or t
  misc_feature (1484)..(1484): n is a, c, g, or t
  misc_feature (1488)..(1488): n is a, c, g, or t
  misc_feature (1496)..(1496): n is a, c, g, or t
  misc_feature (1502)..(1502): n is a, c, g, or t
aattaggctaggtacgaggctgggtgtggtaagcgggccgttatccatttgtgttgttcgccagctaggcctggcctcgtcccgcttcgctcggtcggtctcgcgcgcccccatagccttgctagagggttagcgttagccttaagtgtgcgaatccgaggagcagcgacagactcgagaccacgctccttcctcgggaaggaggcggcacctcgcgtttgaggcccgcctgcgtttgaggcccgcctgcgcttgcggcccgcctgcgcttgaggcctgtctgcgtttgagatctcattgggcgtgattgaggaatttggggaggtttttgggcggtattgaggacgagggggtccgttagtcagcatagaatcctggagcgggaatccctcaccgtctaaatggcgtcgggggcgggacctccgggatctggcttccgcgggccgccgccggccctgaaacgtgagggatagctgagatgaggcagctactgggatggcccccatgcgcatttacatgcagtccgactgccgagctttcgaggcagcaggatttaccgtccacattcctcactactaaccaagcttttagaacagatctcacaagaacctagaggtcggtattttttcgatttaaatttgcctgttactgacgttaacgtctttcgcctagtgagcagtagccaacatgtcagggtgggagtcatattacaaaaccgagggcgatgaagaagcagaggaagaacaagaagagaaccttgaagcaagtggagactataaatattcaggaagagatagtttgatttttttggttgatgcctccaaggctatgtttgaatctcagagtgaagatgagttgacaccttttgacatgagcatccagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcagtaactgaanctaacaagattnggnaccngggggctnataccnggccaaaggctaaagctcaaaagttttggaacatgacctgaaacacgcgctacata

SEQ ID NO: 313787 - DNA, 1535 bp, Homo sapiens
aattaggctaggtacgaggctgggtgtggtaagcgggccgttatccatttgtgttgttcgccagctaggcctggcctcgtcccgcttcgctcggtcggtctcgcgcgcccccatagccttgctagagggttagcgttagccttaagtgtgcgaatccgaggagcagcgacagactcgagaccacgctccttcctcgggaaggaggcggcacctcgcgtttgaggcccgcctgcgtttgaggcccgcctgcgcttgcggcccgcctgcgcttgaggcctgtctgcgtttgagatctcattgggcgtgattgaggaatttggggaggtttttgggcggtattgaggacgagggggtccgttagtcagcatagaatcctggagcgggaatccctcaccgtctaaatggcgtcgggggcgggacctccgggatctggcttccgcgggccgccgccggccctgaaacgtgagggatagctgagatgaggcagctactgggatggcccccatgcgcatttacatgcagtccgactgccgagctttcgaggcagcaggatttaccgtccacattcctcactactaaccaagcttttagaacagatctcacaagaacctagaggtcggtattttttcgatttaaatttgcctgttactgacgttaacgtctttcgcctagtgagcagtagccaacatgtcagggtgggagtcatattacaaaaccgagggcgatgaagaagcagaggaagaacaagaagagaaccttgaagcaagtggagactataaatattcaggaagagatagtttgatttttttggttgatgcctccaaggctatgtttgaatctcagagtgaagatgagttgacaccttttgacatgagcatccagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcagtaaagctgaagctcaactcaagatatagtgatctacgtggccgtctatgaattgggatacttaggagtcgctatg

SEQ ID NO: 313788 - DNA, 1024 bp, Homo sapiens
aattaggctaggtacgaggctgggtgtggtaagcgggccgttatccatttgtgttgttcgccagctaggcctggcctcgtcccgcttcgctcggtcggtctcgcgcgcccccatagccttgctagagggttagcgttagccttaagtgtgcgaatccgaggagcagcgacagactcgagaccacgctccttcctcgggaaggaggcggcacctcgcgtttgaggcccgcctgcgtttgaggcccgcctgcgcttgcggcccgcctgcgcttgaggcctgtctgcgtttgagatctcattgggcgtgattgaggaatttggggaggtttttgggcggtattgaggacgagggggtccgttagtcagcatagaatcctggagcgggaatccctcaccgtctaaatggcgtcgggggcgggacctccgggatctggcttccgcgggccgccgccggccctgaaacgtgagggatagctgagatgaggcagctactgggatggcccccatgcgcatttacatgcagtccgactgccgagctttcgaggcagcaggatttaccgtccacattcctcactactaaccaagcttttagaacagatctcacaagaacctagaggtcggtattttttcgatttaaatttgcctgttactgacgttaacgtctttcgcctagtgagcagtagccaacatgtcagggtgggagtcatattacaaaaccgagggcgatgaagaagcagaggaagaacaagaagagaaccttgaagcaagtggagactataaatattcaggaagagatagtttgatttttttggttgatgcctccaaggctatgtttgaatctcagactggtagcttcaaacatctcacagttaaggaagctgtgctgaatggtttggtggccactgaggtgttgatgtggtttatgtcggagagattataggcaagcggggcatcattggctatgatgtttgaagcccaatctttaacatctgattatatttgatttattatttgagtgttgttgg

SEQ ID NO: 313789 - DNA, 211 bp, Homo sapiens
atttcaatgtcatgatgaaagctaatgggagaaggcttttattctacaaaaattttctttattttttcaactttattgaggttataattgatattaaaaaactgtacagatttaatgtgtacagtctaatgagttgggacatatgcttacacccatgatgctgttaccacaggcaaggtaatacacatatccgtcacctgcaagagtttct

SEQ ID NO: 313790 - DNA, 609 bp, Homo sapiens
cggccgcctttttgggctccgggacccccgggagtgggagcggcagtcggggacgcctcaactcgttcactcagggaatcctgcccatcgccttctccaggccgacttcgcagaactactgctccctggagcagccaggccagggcggcagcaccagcgccttcgagcagctgcagaggtcccgacggcgcctcatctcccagagatcttccttggagaccctggaagatattgaggagaacgcccctctccggagatgtcgaactctctcaggttcacccagaccaaagaattttaagaagattcattttatcaagaacatgcggcaacacgataccaggaatggcagaatagtccttatcagtggcagaagatccttctgtagtatattttcagtgctgccgtatcgcgacagtacccaagtcgggtcgggtatgtatatgcatgcatgctttgtagttctctgggtgaaaagatctcacaccaatgtacataatgtggccatcctttccattttcaagaagttgccttgctttgatactgcaaattcagtatttgtacactggaatgataaaaagatgttccactttcttttcagccagaaagctt

SEQ ID NO: 313791 - DNA, 554 bp, Homo sapiens
cggccgcctttttgggctccgggacccccgggagtgggagcggcagtcggggacgcctcaactcgttcactcagggaatcctgcccatcgccttctccaggccgacttcgcagaactactgctccctggagcagccaggccagggcggcagcaccagcgccttcgagcagctgcagaggtcccgacggcgcctcatctcccagagatcttccttggagaccctggaagatattgaggagaacgcccctctccggagatgtcgaactctctcaggttcacccagaccaaagaattttaagaagattcattttatcaagaacatgcggcaacacgataccaggaatggcagctcctgagtctccttgggacccctgatgagcacagcccaggctctcagtctgcaggccagatccacggctgatttgctcttctgaccctgaaaacgctggcatggaggctcccgcgtccccagacctgctgaccgtgtgatagaggccccagtattgaggaggatttggacttctcatctcagcaaggaccagagtgcagctcaa

SEQ ID NO: 313792 - DNA, 4297 bp, Homo sapiens
ggccatttttcttcctggaatgtttgaatgactcataaaatgagtttggagtggtctgaagcctctgcctccttccttgaatgctttctaagaggggctgccatgcaagaatatatgctgattttcccatacggcgcctcatctcccagagatcttccttggagaccctggaagatattgaggagaacgcccctctccggagatgtcgaactctctcaggttcacccagaccaaagaattttaagaagattcattttatcaagaacatgcggcaacacgataccaggaatggcagaatagtccttatcagtggcagaagatccttctgtagtatattttcagtgctgccgtatcgcgacagtacccaagtcggggacttgaagttggacggaggaagacaatcaactggtgcagtgagtttgaaagagatcattggtctggaaggtgtggagctgggtgctgatgggaagactgtttcctatacccaatttctgttacccacaaatgcctttggagcccggagaaataccatagactccacctcctctttctcccagttccgtaacctgagccaccgcagcctctccataggccgggcaagcggcacccaggggagcctcgacacaggtagtgacctgggagactttatggactatgacccaaatctcttggatgacccccagtggccttgtggcaaacacaaacgcgttctgatcttcccttcctacatgacaacagtgattgactacgtgaagccctcggatctcaagaaggacatgaacgagaccttcaaggagaagtttcctcacattaagctgacactcagcaaaattaggagtctgaaacgagagatgcggaagcttgcgcaggaggactgtggccttgaggagcccacggtggccatggccttcgtctactttgaaaagctcgccctcaaggggaaactcaacaaacagaaccggaagctgtgtgctggggcatgtgtgctgttagcagccaaaattggaagtgacctcaaaaaacacgaagtcaagcatttaattgacaaactggaagagaagttccggctgaacaggcgagaactgattgcctttgaattcccggtgttagtggccttggaattcgccctccacttgcccgagcacgaagtcatgccccactacagacggctggtccagagttcctagcactggccccgaggacagccaagggccatttcttctcagcttggtggagcagcacttacttactactggaaatgaaaaaaagtagaactcagaataccagacttttcttcctctcgacatagtttggggagaagcagtactagaaactttccaaggagtcttgggtgtgtagccaagaggagccatgagctatggactcctcaagcacgggaagaggaggtgtgtgctgagaacagagaggccctgccctctgtccactagcgagaatccctagctgccccagcccagtctttctccccggcattcacaaactttgcaagcgtggtccagggccttctccagatctgttccaacttggagtgtgaagggcttgagcatacgggggaagagagtctgcagaagttgggggaaaacttttaaaagataccctcattgtgtcaaagagtgtgccaatctatttttgtatcagcattggaagtgcactttcccctggggcgtgtgggtgtgtgaatgtgcaagtgtctgagagatactgcatcagccctagacccccagagccagtcccgccctttacagagcagcccttagcctggggccatgggtcaggctgaccttcaacaattatttctagatgatttctggataagaattgctctctcggtaccagacagtttgacatcctccacccttagaaaatgactgacattgttttgttactgctcctacccaccaaggggataaagaaggcgagttctgagtgttggatgagtcagtcgcgtggaaggacgtggagcgtggcgctctgtaacttcctgccgtctgccaccccgccacgtgtatttaaccctcgcactttctccactgtggagatggctggggcggcgccccacagtgtgtattcctgtcctctatgttagagtgcatcagaagcacatttactgtgctatctatatctctatataaaagtgttttataaaaacccagaataggagcacgacgcatgattggtgtttgaggcgtttgccagctgggacaaactgcgtttggagctgtggttaagctgactaaggaggcggtggctctttcttaacattcccacgtgcccagggctgttcatgcaagattttaatggtgacttgtcctggcttactgggacagtctgtatgaggcatgtcaccacactgtcgcctcatagctgcaagagagaggcaccagctgaagttcccctgactgaagagagcctgtggccatgtaaaaagagaattaaactcttgttgctttttgtatacctgtatgcgtttgtgtagacgtgtgtctcaccagtcacctttgccctgcattgctgatccccttgcgcacactgattctagtgaggtcacagattcggagcttcacacaccagcccagagaaagggcgatggaaccgaaccgagggtctgcagctttcgttagcagagctgtcagattcttgacagtcttggaggatggagaaattcaagcagcagctggtgagggccaaaacagaatacttggcttcttcagaatcttagattgcactgagtttagtcctaaatattttgctaacaaatttccttggccagaatcagttgtaagacagtgatttgggtggggggggagggaggagggagaggatatgattaatgtggtctctttggctgatcgaaagctagatcaactggtacttagggcacttgctgtttataaagcaaaattgagaaaatattcaaggtgcctccatcgcctgaactacaaaatgcccttggccttcctcacatggggtctgtcaccttgcatctctgataagccatccaccttcctggtcagtgcctacagggggagagcctttctgagaagcaggtcctgtggtatctgagaatggtctagagagctccccactgcccatctgcccccgaatttcctgccaagctctggggagtggggtggggggagggacgtccgatggatgacaggccgccagcccagacgtggggagagaagcctgagtcctttcctgtgtgataaaatcaggctaatttacttggatttggggtgatttgtttggtttttagcatttatgaggtgagcccatgaagttagtggtccattactttttaaagatgcattttcattttaaactgtctcctggcctgtggatttgtggaatggacagttttgtgggttttaatttatttgtgaggagtcggggctgagaaggcattttatcaggaggtctccttttgcacgtccatgacatgagcttttcggaggcaaaggaagtggaggagggtgagagatgcaggtcactgccagaggcacctctgtgacacggaacattccagacacgtcgcagccttgggcttcggcgaggaggaagtctgagcctgtgaagcgagaaggccaggcagtagactggctctgaggttttgccctttgacctcctccacagagggcagcttcagccccttgtaagccctgccccctctcaggactgccctgaggcctctccagtcctccccacactcagagatctgtggggaagctccgcccagccacactccttgggataatactagccggttctgcctgattccttttcccccggagccagcctagggggcccgggactcctctagtgagccttgactgttaggtaagagacaggaagcagacaagccaagaggttgctgcagctgcccccaggaggaaacgggcagcagggagtgtggcccagcccccactgtacccctccaggggcccgagcccttgccagcccaatgacaccttgaagtcaccacttttcctttcttgcccgctaataaaacctatttaaacaggaaattcataccaaatgcaaatgggttttgttttccttggcattttgttgttccgatcacagatttccctgccagggtgtctgtggttatcagctgcaggctcagcttggggcggccgcttcacacaagccactctgtaccacgtgccctaccttagtgacgggagtaaggagcttccttcccctccatgtcattccttcctgttcccttcattccccaacagcaaataaaactgttgaatgctctggctgctga

SEQ ID NO: 313793 - DNA, 3752 bp, Homo sapiens
ggattagacgacaatgtaaacgacgggaagtgtaacacacggagggtgttacaaggggggcccgtggaaacctgagggacaggtagtgacctgggagactttatggactatgacccaaatctcttggatgacccccagtggccttgtggcaaacacaaacgcgttctgatcttcccttcctacatgacaacagtgattgactacgtgaagccctcggatctcaagaaggacatgaacgagaccttcaaggagaagtttcctcacattaagctgacactcagcaaaattaggagtctgaaacgagagatgcggaagcttgcgcaggaggactgtggccttgaggagcccacggtggccatggccttcgtctactttgaaaagctcgccctcaaggggaaactcaacaaacagaaccggaagctgtgtgctggggcatgtgtgctgttagcagccaaaattggaagtgacctcaaaaaacacgaagtcaagcatttaattgacaaactggaagagaagttccggctgaacaggcgagaactgattgcctttgaattcccggtgttagtggccttggaattcgccctccacttgcccgagcacgaagtcatgccccactacagacggctggtccagagttcctagcactggccccgaggacagccaagggccatttcttctcagcttggtggagcagcacttacttactactggaaatgaaaaaaagtagaactcagaataccagacttttcttcctctcgacatagtttggggagaagcagtactagaaactttccaaggagtcttgggtgtgtagccaagaggagccatgagctatggactcctcaagcacgggaagaggaggtgtgtgctgagaacagagaggccctgccctctgtccactagcgagaatccctagctgccccagcccagtctttctccccggcattcacaaactttgcaagcgtggtccagggccttctccagatctgttccaacttggagtgtgaagggcttgagcatacgggggaagagagtctgcagaagttgggggaaaacttttaaaagataccctcattgtgtcaaagagtgtgccaatctatttttgtatcagcattggaagtgcactttcccctggggcgtgtgggtgtgtgaatgtgcaagtgtctgagagatactgcatcagccctagacccccagagccagtcccgccctttacagagcagcccttagcctggggccatgggtcaggctgaccttcaacaattatttctagatgatttctggataagaattgctctctcggtaccagacagtttgacatcctccacccttagaaaatgactgacattgttttgttactgctcctacccaccaaggggataaagaaggcgagttctgagtgttggatgagtcagtcgcgtggaaggacgtggagcgtggcgctctgtaacttcctgccgtctgccaccccgccacgtgtatttaaccctcgcactttctccactgtggagatggctggggcggcgccccacagtgtgtattcctgtcctctatgttagagtgcatcagaagcacatttactgtgctatctatatctctatataaaagtgttttataaaaacccagaataggagcacgacgcatgattggtgtttgaggcgtttgccagctgggacaaactgcgtttggagctgtggttaagctgactaaggaggcggtggctctttcttaacattcccacgtgcccagggctgttcatgcaagattttaatggtgacttgtcctggcttactgggacagtctgtatgaggcatgtcaccacactgtcgcctcatagctgcaagagagaggcaccagctgaagttcccctgactgaagagagcctgtggccatgtaaaaagagaattaaactcttgttgctttttgtatacctgtatgcgtttgtgtagacgtgtgtctcaccagtcacctttgccctgcattgctgatccccttgcgcacactgattctagtgaggtcacagattcggagcttcacacaccagcccagagaaagggcgatggaaccgaaccgagggtctgcagctttcgttagcagagctgtcagattcttgacagtcttggaggatggagaaattcaagcagcagctggtgagggccaaaacagaatacttggcttcttcagaatcttagattgcactgagtttagtcctaaatattttgctaacaaatttccttggccagaatcagttgtaagacagtgatttgggtggggggggagggaggagggagaggatatgattaatgtggtctctttggctgatcgaaagctagatcaactggtacttagggcacttgctgtttataaagcaaaattgagaaaatattcaaggtgcctccatcgcctgaactacaaaatgcccttggccttcctcacatggggtctgtcaccttgcatctctgataagccatccaccttcctggtcagtgcctacagggggagagcctttctgagaagcaggtcctgtggtatctgagaatggtctagagagctccccactgcccatctgcccccgaatttcctgccaagctctggggagtggggtggggggagggacgtccgatggatgacaggccgccagcccagacgtggggagagaagcctgagtcctttcctgtgtgataaaatcaggctaatttacttggatttggggtgatttgtttggtttttagcatttatgaggtgagcccatgaagttagtggtccattactttttaaagatgcattttcattttaaactgtctcctggcctgtggatttgtggaatggacagttttgtgggttttaatttatttgtgaggagtcggggctgagaaggcattttatcaggaggtctccttttgcacgtccatgacatgagcttttcggaggcaaaggaagtggaggagggtgagagatgcaggtcactgccagaggcacctctgtgacacggaacattccagacacgtcgcagccttgggcttcggcgaggaggaagtctgagcctgtgaagcgagaaggccaggcagtagactggctctgaggttttgccctttgacctcctccacagagggcagcttcagccccttgtaagccctgccccctctcaggactgccctgaggcctctccagtcctccccacactcagagatctgtggggaagctccgcccagccacactccttgggataatactagccggttctgcctgattccttttcccccggagccagcctagggggcccgggactcctctagtgagccttgactgttaggtaagagacaggaagcagacaagccaagaggttgctgcagctgcccccaggaggaaacgggcagcagggagtgtggcccagcccccactgtacccctccaggggcccgagcccttgccagcccaatgacaccttgaagtcaccacttttcctttcttgcccgctaataaaacctatttaaacaggaaattcataccaaatgcaaatgggttttgttttccttggcattttgttgttccgatcacagatttccctgccagggtgtctgtggttatcagctgcaggctcagcttggggcggccgcttcacacaagccactctgtaccacgtgccctaccttagtgacgggagtaaggagcttccttcccctccatgtcattccttcctgttcccttcattccccaacagcaaataaaactgttgaatgctctggctgctga

SEQ ID NO: 313794 - DNA, 3292 bp, Homo sapiens
cccccggacttctcttccagtttgtcaattaaatgcttgacaaactggaagagaagttccggctgaacaggcgagaactgattgcctttgaattcccggtgttagtggccttggaattcgccctccacttgcccgagcacgaagtcatgccccactacagacggctggtccagagttcctagcactggccccgaggacagccaagggccatttcttctcagcttggtggagcagcacttacttactactggaaatgaaaaaaagtagaactcagaataccagacttttcttcctctcgacatagtttggggagaagcagtactagaaactttccaaggagtcttgggtgtgtagccaagaggagccatgagctatggactcctcaagcacgggaagaggaggtgtgtgctgagaacagagaggccctgccctctgtccactagcgagaatccctagctgccccagcccagtctttctccccggcattcacaaactttgcaagcgtggtccagggccttctccagatctgttccaacttggagtgtgaagggcttgagcatacgggggaagagagtctgcagaagttgggggaaaacttttaaaagataccctcattgtgtcaaagagtgtgccaatctatttttgtatcagcattggaagtgcactttcccctggggcgtgtgggtgtgtgaatgtgcaagtgtctgagagatactgcatcagccctagacccccagagccagtcccgccctttacagagcagcccttagcctggggccatgggtcaggctgaccttcaacaattatttctagatgatttctggataagaattgctctctcggtaccagacagtttgacatcctccacccttagaaaatgactgacattgttttgttactgctcctacccaccaaggggataaagaaggcgagttctgagtgttggatgagtcagtcgcgtggaaggacgtggagcgtggcgctctgtaacttcctgccgtctgccaccccgccacgtgtatttaaccctcgcactttctccactgtggagatggctggggcggcgccccacagtgtgtattcctgtcctctatgttagagtgcatcagaagcacatttactgtgctatctatatctctatataaaagtgttttataaaaacccagaataggagcacgacgcatgattggtgtttgaggcgtttgccagctgggacaaactgcgtttggagctgtggttaagctgactaaggaggcggtggctctttcttaacattcccacgtgcccagggctgttcatgcaagattttaatggtgacttgtcctggcttactgggacagtctgtatgaggcatgtcaccacactgtcgcctcatagctgcaagagagaggcaccagctgaagttcccctgactgaagagagcctgtggccatgtaaaaagagaattaaactcttgttgctttttgtatacctgtatgcgtttgtgtagacgtgtgtctcaccagtcacctttgccctgcattgctgatccccttgcgcacactgattctagtgaggtcacagattcggagcttcacacaccagcccagagaaagggcgatggaaccgaaccgagggtctgcagctttcgttagcagagctgtcagattcttgacagtcttggaggatggagaaattcaagcagcagctggtgagggccaaaacagaatacttggcttcttcagaatcttagattgcactgagtttagtcctaaatattttgctaacaaatttccttggccagaatcagttgtaagacagtgatttgggtggggggggagggaggagggagaggatatgattaatgtggtctctttggctgatcgaaagctagatcaactggtacttagggcacttgctgtttataaagcaaaattgagaaaatattcaaggtgcctccatcgcctgaactacaaaatgcccttggccttcctcacatggggtctgtcaccttgcatctctgataagccatccaccttcctggtcagtgcctacagggggagagcctttctgagaagcaggtcctgtggtatctgagaatggtctagagagctccccactgcccatctgcccccgaatttcctgccaagctctggggagtggggtggggggagggacgtccgatggatgacaggccgccagcccagacgtggggagagaagcctgagtcctttcctgtgtgataaaatcaggctaatttacttggatttggggtgatttgtttggtttttagcatttatgaggtgagcccatgaagttagtggtccattactttttaaagatgcattttcattttaaactgtctcctggcctgtggatttgtggaatggacagttttgtgggttttaatttatttgtgaggagtcggggctgagaaggcattttatcaggaggtctccttttgcacgtccatgacatgagcttttcggaggcaaaggaagtggaggagggtgagagatgcaggtcactgccagaggcacctctgtgacacggaacattccagacacgtcgcagccttgggcttcggcgaggaggaagtctgagcctgtgaagcgagaaggccaggcagtagactggctctgaggttttgccctttgacctcctccacagagggcagcttcagccccttgtaagccctgccccctctcaggactgccctgaggcctctccagtcctccccacactcagagatctgtggggaagctccgcccagccacactccttgggataatactagccggttctgcctgattccttttcccccggagccagcctagggggcccgggactcctctagtgagccttgactgttaggtaagagacaggaagcagacaagccaagaggttgctgcagctgcccccaggaggaaacgggcagcagggagtgtggcccagcccccactgtacccctccaggggcccgagcccttgccagcccaatgacaccttgaagtcaccacttttcctttcttgcccgctaataaaacctatttaaacaggaaattcataccaaatgcaaatgggttttgttttccttggcattttgttgttccgatcacagatttccctgccagggtgtctgtggttatcagctgcaggctcagcttggggcggccgcttcacacaagccactctgtaccacgtgccctaccttagtgacgggagtaaggagcttccttcccctccatgtcattccttcctgttcccttcattccccaacagcaaataaaactgttgaatgctctggctgctga

SEQ ID NO: 313795 - DNA, 2527 bp, Homo sapiens
cggccgcctttttgggctccgggacccccgggagtgggagcggcagtcggggacgcctcaactcgttcactcagggaatcctgcccatcgccttctccaggccgacttcgcagaactactgctccctggagcagccaggccagggcggcagcaccagcgccttcgagcagctgcagaggtcccgacggcgcctcatctcccagagatcttccttggagaccctggaagatattgaggagaacgcccctctccggagatgtcgaactctctcaggttcacccagaccaaagaattttaagaagattcattttatcaagaacatgcggcaacacgataccaggaatggcagaatagtccttatcagtggcagaagatccttctgtagtatattttcagtgctgccgtatcgcgacagtacccaagtcggggacttgaagttggacggaggaagacaatcaactggtgcagtgagtttgaaagagatcattggtctggaaggtgtggagctgggtgctgatgggaagactgtttcctatacccaatttctgttacccacaaatgcctttggagcccggagaaataccatagactccacctcctctttctcccagttccgtaacctgagccaccgcagcctctccataggccgggcaagcggcacccaggggagcctcgacacaggtagtgacctgggagactttatggactatgacccaaatctcttggatgacccccagtggccttgtggcaaacacaaacgcgttctgatcttcccttcctacatgacaacagtgattgactacgtgaagccctcggatctcaagaaggacatgaacgagaccttcaaggagaagtttcctcacattaagctgacactcagcaaaattaggagtctgaaacgagagatgcggaagcttgcgcaggaggactgtggccttgaggagcccacggtggccatggccttcgtctactttgaaaagctcgccctcaaggggaaactcaacaaacagaaccggaagctgtgtgctggggcatgtgtgctgttagcagccaaaattggaagtgacctcaaaaaacacgaagtcaagcatttaattgacaaactggaagagaagttccggctgaacaggcgagaactgattgcctttgaattcccggtgttagtggccttggaattcgccctccacttgcccgagcacgaagtcatgccccactacagacggctggtccagagttcctagcactggccccgaggacagccaagggccatttcttctcagcttggtggagcagcacttacttactactggaaatgaaaaaaagtagaactcagaataccagacttttcttcctctcgacatagtttggggagaagcagtactagaaactttccaaggagtcttgggtgtgtagccaagaggagccatgagctatggactcctcaagcacgggaagaggaggtgtgtgctgagaacagagaggccctgccctctgtccactagcgagaatccctagctgccccagcccagtctttctccccggcattcacaaactttgcaagcgtggtccagggccttctccagatctgttccaacttggagtgtgaagggcttgagcatacgggggaagagagtctgcagaagttgggggaaaacttttaaaagataccctcattgtgtcaaagagtgtgccaatctatttttgtatcagcattggaagtgcactttcccctggggcgtgtgggtgtgtgaatgtgcaagtgtctgagagatactgcatcagccctagacccccagagccagtcccgccctttacagagcagcccttagcctggggccatgggtcaggctgaccttcaacaattatttctagatgatttctggataagaattgctctctcggtaccagacagtttgacatcctccacccttagaaaatgactgacattgttttgttactgctcctacccaccaaggggataaagaaggcgagttctgagtgttggatgagtcagtcgcgtggaaggacgtggagcgtggcgctctgtaacttcctgccgtctgccaccccgccacgtgtatttaaccctcgcactttctccactgtggagatggctggggcggcgccccacagtgtgtattcctgtcctctatgttagagtgcatcagaagcacatttactgtgctatctatatctctatataaaagtgttttataaaaacccagaataggagcacgacgcatgattggtgtttgaggcgtttgccagctgggacaaactgcgtttggagctgtggttaagctgactaaggaggcggtggctctttcttaacattcccacgtgcccagggctgttcatgcaagattttaatggtgacttgtcctggcttactgggacagtctgtatgaggcatgtcaccacactgtcgcctcatagctgcaagagagaggcaccagctgaagttcccctgactgaagagagcctgtggccatgtaaaaagagaattaaactcttgttgctttttgta

SEQ ID NO: 313796 - DNA, 3483 bp, Homo sapiens
acggacgcgtgtatccgcaggccggtgtaaaagagtgtgctggtacatagatggtgatagtagacagaaggggaatgtacctcgaagaaccacgaagtaaaacgttcaatggacggtctcactctgtcacccagactggagtgcagtggcacaatcatagctcactgcagcctccacctcccagactcaagcaatcctcccatctccgcctcccaagtagctggaactacagaaactggaagagaagttccggctgaacaggcgagaactgattgcctttgaattcccggtgttagtggccttggaattcgccctccacttgcccgagcacgaagtcatgccccactacagacggctggtccagagttcctagcactggccccgaggacagccaagggccatttcttctcagcttggtggagcagcacttacttactactggaaatgaaaaaaagtagaactcagaataccagacttttcttcctctcgacatagtttggggagaagcagtactagaaactttccaaggagtcttgggtgtgtagccaagaggagccatgagctatggactcctcaagcacgggaagaggaggtgtgtgctgagaacagagaggccctgccctctgtccactagcgagaatccctagctgccccagcccagtctttctccccggcattcacaaactttgcaagcgtggtccagggccttctccagatctgttccaacttggagtgtgaagggcttgagcatacgggggaagagagtctgcagaagttgggggaaaacttttaaaagataccctcattgtgtcaaagagtgtgccaatctatttttgtatcagcattggaagtgcactttcccctggggcgtgtgggtgtgtgaatgtgcaagtgtctgagagatactgcatcagccctagacccccagagccagtcccgccctttacagagcagcccttagcctggggccatgggtcaggctgaccttcaacaattatttctagatgatttctggataagaattgctctctcggtaccagacagtttgacatcctccacccttagaaaatgactgacattgttttgttactgctcctacccaccaaggggataaagaaggcgagttctgagtgttggatgagtcagtcgcgtggaaggacgtggagcgtggcgctctgtaacttcctgccgtctgccaccccgccacgtgtatttaaccctcgcactttctccactgtggagatggctggggcggcgccccacagtgtgtattcctgtcctctatgttagagtgcatcagaagcacatttactgtgctatctatatctctatataaaagtgttttataaaaacccagaataggagcacgacgcatgattggtgtttgaggcgtttgccagctgggacaaactgcgtttggagctgtggttaagctgactaaggaggcggtggctctttcttaacattcccacgtgcccagggctgttcatgcaagattttaatggtgacttgtcctggcttactgggacagtctgtatgaggcatgtcaccacactgtcgcctcatagctgcaagagagaggcaccagctgaagttcccctgactgaagagagcctgtggccatgtaaaaagagaattaaactcttgttgctttttgtatacctgtatgcgtttgtgtagacgtgtgtctcaccagtcacctttgccctgcattgctgatccccttgcgcacactgattctagtgaggtcacagattcggagcttcacacaccagcccagagaaagggcgatggaaccgaaccgagggtctgcagctttcgttagcagagctgtcagattcttgacagtcttggaggatggagaaattcaagcagcagctggtgagggccaaaacagaatacttggcttcttcagaatcttagattgcactgagtttagtcctaaatattttgctaacaaatttccttggccagaatcagttgtaagacagtgatttgggtggggggggagggaggagggagaggatatgattaatgtggtctctttggctgatcgaaagctagatcaactggtacttagggcacttgctgtttataaagcaaaattgagaaaatattcaaggtgcctccatcgcctgaactacaaaatgcccttggccttcctcacatggggtctgtcaccttgcatctctgataagccatccaccttcctggtcagtgcctacagggggagagcctttctgagaagcaggtcctgtggtatctgagaatggtctagagagctccccactgcccatctgcccccgaatttcctgccaagctctggggagtggggtggggggagggacgtccgatggatgacaggccgccagcccagacgtggggagagaagcctgagtcctttcctgtgtgataaaatcaggctaatttacttggatttggggtgatttgtttggtttttagcatttatgaggtgagcccatgaagttagtggtccattactttttaaagatgcattttcattttaaactgtctcctggcctgtggatttgtggaatggacagttttgtgggttttaatttatttgtgaggagtcggggctgagaaggcattttatcaggaggtctccttttgcacgtccatgacatgagcttttcggaggcaaaggaagtggaggagggtgagagatgcaggtcactgccagaggcacctctgtgacacggaacattccagacacgtcgcagccttgggcttcggcgaggaggaagtctgagcctgtgaagcgagaaggccaggcagtagactggctctgaggttttgccctttgacctcctccacagagggcagcttcagccccttgtaagccctgccccctctcaggactgccctgaggcctctccagtcctccccacactcagagatctgtggggaagctccgcccagccacactccttgggataatactagccggttctgcctgattccttttcccccggagccagcctagggggcccgggactcctctagtgagccttgactgttaggtaagagacaggaagcagacaagccaagaggttgctgcagctgcccccaggaggaaacgggcagcagggagtgtggcccagcccccactgtacccctccaggggcccgagcccttgccagcccaatgacaccttgaagtcaccacttttcctttcttgcccgctaataaaacctatttaaacaggaaattcataccaaatgcaaatgggttttgttttccttggcattttgttgttccgatcacagatttccctgccagggtgtctgtggttatcagctgcaggctcagcttggggcggccgcttcacacaagccactctgtaccacgtgccctaccttagtgacgggagtaaggagcttccttcccctccatgtcattccttcctgttcccttcattccccaacagcaaataaaactgttgaatgctctggctgctga

SEQ ID NO: 313797 - DNA, 3022 bp, Homo sapiens
tggtaatttcagtgaggggccggggtatagttttgggtgacgaggccgtggaccagacatttccaaggagtcttgggtgtgtagccaagaggagccatgagctatggactcctcaagcacgggaagaggaggtgtgtgctgagaacagagaggccctgccctctgtccactagcgagaatccctagctgccccagcccagtctttctccccggcattcacaaactttgcaagcgtggtccagggccttctccagatctgttccaacttggagtgtgaagggcttgagcatacgggggaagagagtctgcagaagttgggggaaaacttttaaaagataccctcattgtgtcaaagagtgtgccaatctatttttgtatcagcattggaagtgcactttcccctggggcgtgtgggtgtgtgaatgtgcaagtgtctgagagatactgcatcagccctagacccccagagccagtcccgccctttacagagcagcccttagcctggggccatgggtcaggctgaccttcaacaattatttctagatgatttctggataagaattgctctctcggtaccagacagtttgacatcctccacccttagaaaatgactgacattgttttgttactgctcctacccaccaaggggataaagaaggcgagttctgagtgttggatgagtcagtcgcgtggaaggacgtggagcgtggcgctctgtaacttcctgccgtctgccaccccgccacgtgtatttaaccctcgcactttctccactgtggagatggctggggcggcgccccacagtgtgtattcctgtcctctatgttagagtgcatcagaagcacatttactgtgctatctatatctctatataaaagtgttttataaaaacccagaataggagcacgacgcatgattggtgtttgaggcgtttgccagctgggacaaactgcgtttggagctgtggttaagctgactaaggaggcggtggctctttcttaacattcccacgtgcccagggctgttcatgcaagattttaatggtgacttgtcctggcttactgggacagtctgtatgaggcatgtcaccacactgtcgcctcatagctgcaagagagaggcaccagctgaagttcccctgactgaagagagcctgtggccatgtaaaaagagaattaaactcttgttgctttttgtatacctgtatgcgtttgtgtagacgtgtgtctcaccagtcacctttgccctgcattgctgatccccttgcgcacactgattctagtgaggtcacagattcggagcttcacacaccagcccagagaaagggcgatggaaccgaaccgagggtctgcagctttcgttagcagagctgtcagattcttgacagtcttggaggatggagaaattcaagcagcagctggtgagggccaaaacagaatacttggcttcttcagaatcttagattgcactgagtttagtcctaaatattttgctaacaaatttccttggccagaatcagttgtaagacagtgatttgggtggggggggagggaggagggagaggatatgattaatgtggtctctttggctgatcgaaagctagatcaactggtacttagggcacttgctgtttataaagcaaaattgagaaaatattcaaggtgcctccatcgcctgaactacaaaatgcccttggccttcctcacatggggtctgtcaccttgcatctctgataagccatccaccttcctggtcagtgcctacagggggagagcctttctgagaagcaggtcctgtggtatctgagaatggtctagagagctccccactgcccatctgcccccgaatttcctgccaagctctggggagtggggtggggggagggacgtccgatggatgacaggccgccagcccagacgtggggagagaagcctgagtcctttcctgtgtgataaaatcaggctaatttacttggatttggggtgatttgtttggtttttagcatttatgaggtgagcccatgaagttagtggtccattactttttaaagatgcattttcattttaaactgtctcctggcctgtggatttgtggaatggacagttttgtgggttttaatttatttgtgaggagtcggggctgagaaggcattttatcaggaggtctccttttgcacgtccatgacatgagcttttcggaggcaaaggaagtggaggagggtgagagatgcaggtcactgccagaggcacctctgtgacacggaacattccagacacgtcgcagccttgggcttcggcgaggaggaagtctgagcctgtgaagcgagaaggccaggcagtagactggctctgaggttttgccctttgacctcctccacagagggcagcttcagccccttgtaagccctgccccctctcaggactgccctgaggcctctccagtcctccccacactcagagatctgtggggaagctccgcccagccacactccttgggataatactagccggttctgcctgattccttttcccccggagccagcctagggggcccgggactcctctagtgagccttgactgttaggtaagagacaggaagcagacaagccaagaggttgctgcagctgcccccaggaggaaacgggcagcagggagtgtggcccagcccccactgtacccctccaggggcccgagcccttgccagcccaatgacaccttgaagtcaccacttttcctttcttgcccgctaataaaacctatttaaacaggaaattcataccaaatgcaaatgggttttgttttccttggcattttgttgttccgatcacagatttccctgccagggtgtctgtggttatcagctgcaggctcagcttggggcggccgcttcacacaagccactctgtaccacgtgccctaccttagtgacgggagtaaggagcttccttcccctccatgtcattccttcctgttcccttcattccccaacagcaaataaaactgttgaatgctctggctgctga

SEQ ID NO: 313798 - DNA, 2232 bp, Homo sapiens
gggtcgacccacgcgtccggtttgaggcgtttgccagctgggacaaacaccaatcatgcgtcgtgctcctattctgggtttttataaaacacttttatatagcgatatagatagcacgacgcatgattggtgtttgaggcgtttgccagctgggacaaactgcgtttggagctgtggttaagctgactaaggaggcggtggctctttcttaacattcccacgtgcccagggctgttcatgcaagattttaatggtgacttgtcctggcttactgggacagtctgtatgaggcatgtcaccacactgtcgcctcatagctgcaagagagaggcaccagctgaagttcccctgactgaagagagcctgtggccatgtaaaaagagaattaaactcttgttgctttttgtatacctgtatgcgtttgtgtagacgtgtgtctcaccagtcacctttgccctgcattgctgatccccttgcgcacactgattctagtgaggtcacagattcggagcttcacacaccagcccagagaaagggcgatggaaccgaaccgagggtctgcagctttcgttagcagagctgtcagattcttgacagtcttggaggatggagaaattcaagcagcagctggtgagggccaaaacagaatacttggcttcttcagaatcttagattgcactgagtttagtcctaaatattttgctaacaaatttccttggccagaatcagttgtaagacagtgatttgggtggggggggagggaggagggagaggatatgattaatgtggtctctttggctgatcgaaagctagatcaactggtacttagggcacttgctgtttataaagcaaaattgagaaaatattcaaggtgcctccatcgcctgaactacaaaatgcccttggccttcctcacatggggtctgtcaccttgcatctctgataagccatccaccttcctggtcagtgcctacagggggagagcctttctgagaagcaggtcctgtggtatctgagaatggtctagagagctccccactgcccatctgcccccgaatttcctgccaagctctggggagtggggtggggggagggacgtccgatggatgacaggccgccagcccagacgtggggagagaagcctgagtcctttcctgtgtgataaaatcaggctaatttacttggatttggggtgatttgtttggtttttagcatttatgaggtgagcccatgaagttagtggtccattactttttaaagatgcattttcattttaaactgtctcctggcctgtggatttgtggaatggacagttttgtgggttttaatttatttgtgaggagtcggggctgagaaggcattttatcaggaggtctccttttgcacgtccatgacatgagcttttcggaggcaaaggaagtggaggagggtgagagatgcaggtcactgccagaggcacctctgtgacacggaacattccagacacgtcgcagccttgggcttcggcgaggaggaagtctgagcctgtgaagcgagaaggccaggcagtagactggctctgaggttttgccctttgacctcctccacagagggcagcttcagccccttgtaagccctgccccctctcaggactgccctgaggcctctccagtcctccccacactcagagatctgtggggaagctccgcccagccacactccttgggataatactagccggttctgcctgattccttttcccccggagccagcctagggggcccgggactcctctagtgagccttgactgttaggtaagagacaggaagcagacaagccaagaggttgctgcagctgcccccaggaggaaacgggcagcagggagtgtggcccagcccccactgtacccctccaggggcccgagcccttgccagcccaatgacaccttgaagtcaccacttttcctttcttgcccgctaataaaacctatttaaacaggaaattcataccaaatgcaaatgggttttgttttccttggcattttgttgttccgatcacagatttccctgccagggtgtctgtggttatcagctgcaggctcagcttggggcggccgcttcacacaagccactctgtaccacgtgccctaccttagtgacgggagtaaggagcttccttcccctccatgtcattccttcctgttcccttcattccccaacagcaaataaaactgttgaatgctctggctgctga

SEQ ID NO: 313799 - DNA, 492 bp, Homo sapiens
cggccgcctttttgggctccgggacccccgggagtgggagcggcagtcggggacgcctcaactcgttcactcagggaatcctgcccatcgccttctccaggccgacttcgcagaactactgctccctggagcagccaggccagggcggcagcaccagcgccttcgagcagctgcagaggtcccgacggcgcctcatctcccagagatcttccttggagaccctggaagatattgaggagaacgcccctctccggagatgtcgaactctctcaggttcacccagaccaaagaattttaagaagattcattttatcaagaacatgcggcaacacgataccaggaatggcagaatagtccttatcagtggcagaagatccttctgtagtatattttcagtgctgccgtatcgcgacagtacccaagtcggttcccctgactgaagagagcctgtggccatgtaaaaagagaattaaactcttgttgctttttgta

SEQ ID NO: 313800 - DNA, 4351 bp, Homo sapiens
cggccgcctttttgggctccgggacccccgggagtgggagcggcagtcggggacgcctcaactcgttcactcagggaatcctgcccatcgccttctccaggccgacttcgcagaactactgctccctggagcagccaggccagggcggcagcaccagcgccttcgagcagctgcagaggtcccgacggcgcctcatctcccagagatcttccttggagaccctggaagatattgaggagaacgcccctctccggagatgtcgaactctctcaggttcacccagaccaaagaattttaagaagattcattttatcaagaacatgcggcaacacgataccaggaatggcagaatagtccttatcagtggcagaagatccttctgtagtatattttcagtgctgccgtatcgcgacagtacccaagtcggggacttgaagttggacggaggaagacaatcaactggtgcagtgagtttgaaagagatcattggtctggaaggtgtggagctgggtgctgatgggaagactgtttcctatacccaatttctgttacccacaaatgcctttggagcccggagaaataccatagactccacctcctctttctcccagttccgtaacctgagccaccgcagcctctccataggccgggcaagcggcacccaggggagcctcgacacaggtagtgacctgggagactttatggactatgacccaaatctcttggatgacccccagtggccttgtggcaaacacaaacgcgttctgatcttcccttcctacatgacaacagtgattgactacgtgaagccctcggatctcaagaaggacatgaacgagaccttcaaggagaagtttcctcacattaagctgacactcagcaaaattaggagtctgaaacgagagatgcggaagcttgcgcaggaggactgtggccttgaggagcccacggtggccatggccttcgtctactttgaaaagctcgccctcaaggggaaactcaacaaacagaaccggaagctgtgtgctggggcatgtgtgctgttagcagccaaaattggaagtgacctcaaaaaacacgaagtcaagcatttaattgacaaactggaagagaagttccggctgaacaggcgagaactgattgcctttgaattcccggtgttagtggccttggaattcgccctccacttgcccgagcacgaagtcatgccccactacagacggctggtccagagttcctagcactggccccgaggacagccaagggccatttcttctcagcttggtggagcagcacttacttactactggaaatgaaaaaaagtagaactcagaataccagacttttcttcctctcgacatagtttggggagaagcagtactagaaactttccaaggagtcttgggtgtgtagccaagaggagccatgagctatggactcctcaagcacgggaagaggaggtgtgtgctgagaacagagaggccctgccctctgtccactagcgagaatccctagctgccccagcccagtctttctccccggcattcacaaactttgcaagcgtggtccagggccttctccagatctgttccaacttggagtgtgaagggcttgagcatacgggggaagagagtctgcagaagttgggggaaaacttttaaaagataccctcattgtgtcaaagagtgtgccaatctatttttgtatcagcattggaagtgcactttcccctggggcgtgtgggtgtgtgaatgtgcaagtgtctgagagatactgcatcagccctagacccccagagccagtcccgccctttacagagcagcccttagcctggggccatgggtcaggctgaccttcaacaattatttctagatgatttctggataagaattgctctctcggtaccagacagtttgacatcctccacccttagaaaatgactgacattgttttgttactgctcctacccaccaaggggataaagaaggcgagttctgagtgttggatgagtcagtcgcgtggaaggacgtggagcgtggcgctctgtaacttcctgccgtctgccaccccgccacgtgtatttaaccctcgcactttctccactgtggagatggctggggcggcgccccacagtgtgtattcctgtcctctatgttagagtgcatcagaagcacatttactgtgctatctatatctctatataaaagtgttttataaaaacccagaataggagcacgacgcatgattggtgtttgaggcgtttgccagctgggacaaactgcgtttggagctgtggttaagctgactaaggaggcggtggctctttcttaacattcccacgtgcccagggctgttcatgcaagattttaatggtgacttgtcctggcttactgggacagtctgtatgaggcatgtcaccacactgtcgcctcatagctgcaagagagaggcaccagctgaagttcccctgactgaagagagcctgtggccatgtaaaaagagaattaaactcttgttgctttttgtatacctgtatgcgtttgtgtagacgtgtgtctcaccagtcacctttgccctgcattgctgatccccttgcgcacactgattctagtgaggtcacagattcggagcttcacacaccagcccagagaaagggcgatggaaccgaaccgagggtctgcagctttcgttagcagagctgtcagattcttgacagtcttggaggatggagaaattcaagcagcagctggtgagggccaaaacagaatacttggcttcttcagaatcttagattgcactgagtttagtcctaaatattttgctaacaaatttccttggccagaatcagttgtaagacagtgatttgggtggggggggagggaggagggagaggatatgattaatgtggtctctttggctgatcgaaagctagatcaactggtacttagggcacttgctgtttataaagcaaaattgagaaaatattcaaggtgcctccatcgcctgaactacaaaatgcccttggccttcctcacatggggtctgtcaccttgcatctctgataagccatccaccttcctggtcagtgcctacagggggagagcctttctgagaagcaggtcctgtggtatctgagaatggtctagagagctccccactgcccatctgcccccgaatttcctgccaagctctggggagtggggtggggggagggacgtccgatggatgacaggccgccagcccagacgtggggagagaagcctgagtcctttcctgtgtgataaaatcaggctaatttacttggatttggggtgatttgtttggtttttagcatttatgaggtgagcccatgaagttagtggtccattactttttaaagatgcattttcattttaaactgtctcctggcctgtggatttgtggaatggacagttttgtgggttttaatttatttgtgaggagtcggggctgagaaggcattttatcaggaggtctccttttgcacgtccatgacatgagcttttcggaggcaaaggaagtggaggagggtgagagatgcaggtcactgccagaggcacctctgtgacacggaacattccagacacgtcgcagccttgggcttcggcgaggaggaagtctgagcctgtgaagcgagaaggccaggcagtagactggctctgaggttttgccctttgacctcctccacagagggcagcttcagccccttgtaagccctgccccctctcaggactgccctgaggcctctccagtcctccccacactcagagatctgtggggaagctccgcccagccacactccttgggataatactagccggttctgcctgattccttttcccccggagccagcctagggggcccgggactcctctagtgagccttgactgttaggtaagagacaggaagcagacaagccaagaggttgctgcagctgcccccaggaggaaacgggcagcagggagtgtggcccagcccccactgtacccctccaggggcccgagcccttgccagcccaatgacaccttgaagtcaccacttttcctttcttgcccgctaataaaacctatttaaacaggaaattcataccaaatgcaaatgggttttgttttccttggcattttgttgttccgatcacagatttccctgccagggtgtctgtggttatcagctgcaggctcagcttggggcggccgcttcacacaagccactctgtaccacgtgccctaccttagtgacgggagtaaggagcttccttcccctccatgtcattccttcctgttcccttcattccccaacagcaaataaaactgttgaatgctctggctgctga

SEQ ID NO: 313801 - DNA, 4249 bp, Homo sapiens
cggccgcctttttgggctccgggacccccgggagtgggagcggcagtcggggacgcctcaactcgttcactcagggaatcctgcccatcgccttctccaggccgacttcgcagaactactgctccctggagcagccaggccagggcggcagcaccagcgccttcgagcagctgcagaggtcccgacggcgcctcatctcccagagatcttccttggagaccctggaagatattgaggagaacgcccctctccggagatgtcgaactctctcaggttcacccagaccaaagaattttaagaagattcattttatcaagaacatgcggcaacacgataccaggaatggcagaatagtccttatcagtggcagaagatccttctgtagtatattttcagtgctgccgtatcgcgacagtacccaagtcggggacttgaagttggacggaggaagacaatcaactggtgcagtgagtttgaaagagatcattggtctggaaggtgtggagctgggtgctgatgggaagactgtttcctatacccaatttctgttacccacaaatgcctttggagcccggagaaataccatagactccacctcctctttctcccagttccgtaacctgagccaccgcagcctctccataggccgggcaagcggcacccaggggagcctcgacacaggtagtgacctgggagactttatggactatgacccaaatctcttggatgacccccagtggccttgtggcaaacacaaacgcgttctgatcttcccttcctacatgacaacagtgattgactacgtgaagccctcggatctcaagaaggacatgaacgagaccttcaaggagaagtttcctcacattaagctgacactcagcaaaattaggagtctgaaacgagagatgcggaagcttgcgcaggaggactgtggccttgaggagcccacggtggccatggccttcgtctactttgaaaagctcgccctcaaggggaaactcaacaaacagaaccggaagctgtgtgctggggcatgtgtgctgttagcagccaaaattggaagtgacctcaaaaaacacgaagtcaagcatttaattgacaaactggaagagaagttccggctgaacaggcgagaactgattgcctttgaattcccggtgttagtggccttggaattcgccctccacttgcccgagcacgaagtcatgccccactacagacggctggtccagagttcctagcactggccccgaggacagccaagggccatttcttctcagcttggtggagcagcacttacttactactggaaatgaaaaaaagtagaactcagaataccagacttttcttcctctcgacatagtttggggagaagcagtactagaaactttccaaggagtcttgggtgtgtagccaagaggacccagtctttctccccggcattcacaaactttgcaagcgtggtccagggccttctccagatctgttccaacttggagtgtgaagggcttgagcatacgggggaagagagtctgcagaagttgggggaaaacttttaaaagataccctcattgtgtcaaagagtgtgccaatctatttttgtatcagcattggaagtgcactttcccctggggcgtgtgggtgtgtgaatgtgcaagtgtctgagagatactgcatcagccctagacccccagagccagtcccgccctttacagagcagcccttagcctggggccatgggtcaggctgaccttcaacaattatttctagatgatttctggataagaattgctctctcggtaccagacagtttgacatcctccacccttagaaaatgactgacattgttttgttactgctcctacccaccaaggggataaagaaggcgagttctgagtgttggatgagtcagtcgcgtggaaggacgtggagcgtggcgctctgtaacttcctgccgtctgccaccccgccacgtgtatttaaccctcgcactttctccactgtggagatggctggggcggcgccccacagtgtgtattcctgtcctctatgttagagtgcatcagaagcacatttactgtgctatctatatctctatataaaagtgttttataaaaacccagaataggagcacgacgcatgattggtgtttgaggcgtttgccagctgggacaaactgcgtttggagctgtggttaagctgactaaggaggcggtggctctttcttaacattcccacgtgcccagggctgttcatgcaagattttaatggtgacttgtcctggcttactgggacagtctgtatgaggcatgtcaccacactgtcgcctcatagctgcaagagagaggcaccagctgaagttcccctgactgaagagagcctgtggccatgtaaaaagagaattaaactcttgttgctttttgtatacctgtatgcgtttgtgtagacgtgtgtctcaccagtcacctttgccctgcattgctgatccccttgcgcacactgattctagtgaggtcacagattcggagcttcacacaccagcccagagaaagggcgatggaaccgaaccgagggtctgcagctttcgttagcagagctgtcagattcttgacagtcttggaggatggagaaattcaagcagcagctggtgagggccaaaacagaatacttggcttcttcagaatcttagattgcactgagtttagtcctaaatattttgctaacaaatttccttggccagaatcagttgtaagacagtgatttgggtggggggggagggaggagggagaggatatgattaatgtggtctctttggctgatcgaaagctagatcaactggtacttagggcacttgctgtttataaagcaaaattgagaaaatattcaaggtgcctccatcgcctgaactacaaaatgcccttggccttcctcacatggggtctgtcaccttgcatctctgataagccatccaccttcctggtcagtgcctacagggggagagcctttctgagaagcaggtcctgtggtatctgagaatggtctagagagctccccactgcccatctgcccccgaatttcctgccaagctctggggagtggggtggggggagggacgtccgatggatgacaggccgccagcccagacgtggggagagaagcctgagtcctttcctgtgtgataaaatcaggctaatttacttggatttggggtgatttgtttggtttttagcatttatgaggtgagcccatgaagttagtggtccattactttttaaagatgcattttcattttaaactgtctcctggcctgtggatttgtggaatggacagttttgtgggttttaatttatttgtgaggagtcggggctgagaaggcattttatcaggaggtctccttttgcacgtccatgacatgagcttttcggaggcaaaggaagtggaggagggtgagagatgcaggtcactgccagaggcacctctgtgacacggaacattccagacacgtcgcagccttgggcttcggcgaggaggaagtctgagcctgtgaagcgagaaggccaggcagtagactggctctgaggttttgccctttgacctcctccacagagggcagcttcagccccttgtaagccctgccccctctcaggactgccctgaggcctctccagtcctccccacactcagagatctgtggggaagctccgcccagccacactccttgggataatactagccggttctgcctgattccttttcccccggagccagcctagggggcccgggactcctctagtgagccttgactgttaggtaagagacaggaagcagacaagccaagaggttgctgcagctgcccccaggaggaaacgggcagcagggagtgtggcccagcccccactgtacccctccaggggcccgagcccttgccagcccaatgacaccttgaagtcaccacttttcctttcttgcccgctaataaaacctatttaaacaggaaattcataccaaatgcaaatgggttttgttttccttggcattttgttgttccgatcacagatttccctgccagggtgtctgtggttatcagctgcaggctcagcttggggcggccgcttcacacaagccactctgtaccacgtgccctaccttagtgacgggagtaaggagcttccttcccctccatgtcattccttcctgttcccttcattccccaacagcaaataaaactgttgaatgctctggctgctga

SEQ ID NO: 313802 - DNA, 740 bp, Homo sapiens
cggccgcctttttgggctccgggacccccgggagtgggagcggcagtcggggacgcctcaactcgttcactcagggaatcctgcccatcgccttctccaggccgacttcgcagaactactgctccctggagcagccaggccagggcggcagcaccagcgccttcgagcagctgcagaggtcccgacggcgcctcatctcccagagatcttccttggagaccctggaagatattgaggagaacgcccctctccggagatgtcgaactctctcaggttcacccagaccaaagaattttaagaagattcattttatcaagaacatgcggcaacacgataccaggaatggcagaatagtccttatcagtggcagaagatccttctgtagtatattttcagtgctgccgtatcgcgacagtacccaagtcggggacttgaagttggacggaggaagacaatcaactggtgcagtgagtttgaaagagatcattggtctggaaggtgtggagctgggtgctgatgggaagactgtttcctatacccaatttctgttacccacaaatgcctttggagcccggagaaataccatagactccacctcctctttctcccagttccgtaacctgagccaccgcagcctctccataggccgggcaagcggcacccaggggagcctcgacacaggtggtgacctgggagactttatggactatggagaggctgcggtggctcaggttacggaa

SEQ ID NO: 313803 - DNA, 4816 bp, Homo sapiens
agtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaagggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgccggcgtctgtaggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaaaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctgggaaatgcagaaatcacgttgctggtggtttttcagctcccttcccttgagatgagtttctggggaaaaaaaagagactggttagtgatgcagttagtatagctttatactctctccactttatagctctaataagtttgtgttagaaaagtttcgacttatttcttaaagcttttttttttttcccatcactctttacatggtggtgatgtccaaaagatacccaaattttaatattccagaagaacaactttagcatcagaaggttcacccagcaccttgcagattttcttaaggaattttgtctcacttttaaaaagaaggggagaagtcagctactctagttctgttgttttgtgtatataattttttaaaaaaaatttgtgtgcttctgctcattactacactggtgtgtccctctgccttttttttttttttaagacagggtctcattctatcggccaggctggagtgcagtggtgcaatcacagctcactgcagccttgtcctcccaggctcaagctatccttgcacctcagcctcccaagtagctgggaccacaggcatgcaccactacgcatgactaattttttaaatatttgagacggggtctccctgtgttacccaggctggtctcaaactcctgggctcaagtgatcctcccatcttggcctcccagagtattgggattacagacatgagccactgcacctgcccagctccccaactccctgccattttttaagagacagtttcgctccatcgcccaggcctgggatgcagtgatgtgatcatagctcactgtaacctcaaactctggggctcaagcagttctcccaccagcctcctttttatttttttgtacagatggggtcttgctatgttgcccaagctggtcttaaactcctggcctcaagcaatccttctgccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccaggtgtgcacagaaaaccgagaatattcaaaattccaaatttttttcttaggagcaagaagaaaatgtggccctaaagggggttagttgaggggtagggggtagtgaggatcttgatttggatctctttttatttaaatgtgaatttcaacttttgacaatcaaagaaaagacttttgttgaaatagctttactgtttctcaagtgttttggagaaaaaaatcaaccctgcaatcactttttggaattgtcttgatttttcggcagttcaagctatatcgaatatagttctgtgtagagaatgtcactgtagttttgagtgtatacatgtgtgggtgctgataattgtgtattttctttgggggtggaaaaggaaaacaattcaagctgagaaaagtattctcaaagatgcatttttataaattttattaaacaattttgttaaaccatt

SEQ ID NO: 313804 - DNA, 405 bp, Homo sapiens
cccaaatggaatccctcaaggcccaggactattgcggaagaggtgggcgcgtaagattgtaagggccgattttgaaagatccagtaagttcagtttctctatgaactaatcattcaagtcaaaggcacactgatgcaaaatcagtatatggacccctgtgtctgattagcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggattccatttggggattccatttggggattccatttggggattccatttggggattccatttggggattccatttgg

SEQ ID NO: 313805 - DNA, 4875 bp, Homo sapiens
agtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaagaggacctggcaagatgcagaaactggcatcctcacagctgttcatacccttgtcccctgggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgccggcgtctgtaggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaaaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctgggaaatgcagaaatcacgttgctggtggtttttcagctcccttcccttgagatgagtttctggggaaaaaaaagagactggttagtgatgcagttagtatagctttatactctctccactttatagctctaataagtttgtgttagaaaagtttcgacttatttcttaaagcttttttttttttcccatcactctttacatggtggtgatgtccaaaagatacccaaattttaatattccagaagaacaactttagcatcagaaggttcacccagcaccttgcagattttcttaaggaattttgtctcacttttaaaaagaaggggagaagtcagctactctagttctgttgttttgtgtatataattttttaaaaaaaatttgtgtgcttctgctcattactacactggtgtgtccctctgccttttttttttttttaagacagggtctcattctatcggccaggctggagtgcagtggtgcaatcacagctcactgcagccttgtcctcccaggctcaagctatccttgcacctcagcctcccaagtagctgggaccacaggcatgcaccactacgcatgactaattttttaaatatttgagacggggtctccctgtgttacccaggctggtctcaaactcctgggctcaagtgatcctcccatcttggcctcccagagtattgggattacagacatgagccactgcacctgcccagctccccaactccctgccattttttaagagacagtttcgctccatcgcccaggcctgggatgcagtgatgtgatcatagctcactgtaacctcaaactctggggctcaagcagttctcccaccagcctcctttttatttttttgtacagatggggtcttgctatgttgcccaagctggtcttaaactcctggcctcaagcaatccttctgccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccaggtgtgcacagaaaaccgagaatattcaaaattccaaatttttttcttaggagcaagaagaaaatgtggccctaaagggggttagttgaggggtagggggtagtgaggatcttgatttggatctctttttatttaaatgtgaatttcaacttttgacaatcaaagaaaagacttttgttgaaatagctttactgtttctcaagtgttttggagaaaaaaatcaaccctgcaatcactttttggaattgtcttgatttttcggcagttcaagctatatcgaatatagttctgtgtagagaatgtcactgtagttttgagtgtatacatgtgtgggtgctgataattgtgtattttctttgggggtggaaaaggaaaacaattcaagctgagaaaagtattctcaaagatgcatttttataaattttattaaacaattttgttaaaccatt

SEQ ID NO: 313806 - DNA, 4660 bp, Homo sapiens
agtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaagggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgccggcgtctgtaggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaaaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctgggaaatgcagaaatcacgttgctggtggtttttcagctcccttcccttgagatgagtttctggggaaaaaaaagagactggttagtgatgcagttagtatagctttatactctctccactttatagctctaataagtttgtgttagaaaagtttcgacttatttcttaaagcttttttttttttcccatcactctttacatggtggtgatgtccaaaagatacccaaattttaatattccagaagaacaactttagcatcagaaggttcacccagcaccttgcagattttcttaaggaattttgtctcacttttaaaaagaaggggagaagtcagctactctagttctgttgttttgtgtatataattttttaaaaaaaatttgtgtgcttctgctcattactacactggtgtgtccctctgccttttttttttttttaagacagggtctcattctatcggccaggctggagtgcagtggtgcaatcacagctcactgcagccttgtcctcccaggctcaagctatccttgcacctcagcctcccaagtagctgggaccacaggcatgcaccactacgcatgactaattttttaaatatttgagacggggtctccctgtgttacccaggctggtctcaaactcctgggctcaagtgatcctcccatcttggcctcccagagtattgggattacagacatgagccactgcacctgcccagctccccaactccctgccattttttaagagacagtttcgctccatcgcccaggcctgggatgcagtgatgtgatcatagctcactgtaacctcaaactctggggctcaagcagttctcccaccagcctcctttttatttttttgtacagatggggtcttgctatgttgcccaagctggtcttaaactcctggcctcaagcaatccttctgccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccaggtgtgcacagaaaaccgagaatattcaaaattccaaatttttttcttaggagcaagaagaaaatgtggccctaaagggggttagttgaggggtagggggtagtgaggatcttgatttggatctctttttatttaaatgtgaatttcaacttttgacaatcaaagaaaagacttttgttgaaatagctttactgtttctcaagtgttttggagaaaaaaatcaaccctgcaatcactttttggaattgtcttgatttttcggcagttcaagctatatcgaatatagttctgtgtagagaatgtcactgtagttttgagtgtatacatgtgtgggtgctgataattgtgtattttctttgggggtggaaaaggaaaacaattcaagctgagaaaagtattctcaaagatgcatttttataaattttattaaacaattttgttaaaccatt

SEQ ID NO: 313807 - DNA, 4120 bp, Homo sapiens
cgagctcggcaccattgaaaccaatgagcattagctctagacaggatcagcattgttgttcactggatttgtggtgacgacaaattgtccaccatcatcattcaatatggtgtatacagcctcccacgctggggtattgggggcatcagcatcagtcactttcagtgtggtgattacgacgttagccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaagggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgccggcgtctgtaggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaaaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctgggaaatgcagaaatcacgttgctggtggtttttcagctcccttcccttgagatgagtttctggggaaaaaaaagagactggttagtgatgcagttagtatagctttatactctctccactttatagctctaataagtttgtgttagaaaagtttcgacttatttcttaaagcttttttttttttcccatcactctttacatggtggtgatgtccaaaagatacccaaattttaatattccagaagaacaactttagcatcagaaggttcacccagcaccttgcagattttcttaaggaattttgtctcacttttaaaaagaaggggagaagtcagctactctagttctgttgttttgtgtatataattttttaaaaaaaatttgtgtgcttctgctcattactacactggtgtgtccctctgccttttttttttttttaagacagggtctcattctatcggccaggctggagtgcagtggtgcaatcacagctcactgcagccttgtcctcccaggctcaagctatccttgcacctcagcctcccaagtagctgggaccacaggcatgcaccactacgcatgactaattttttaaatatttgagacggggtctccctgtgttacccaggctggtctcaaactcctgggctcaagtgatcctcccatcttggcctcccagagtattgggattacagacatgagccactgcacctgcccagctccccaactccctgccattttttaagagacagtttcgctccatcgcccaggcctgggatgcagtgatgtgatcatagctcactgtaacctcaaactctggggctcaagcagttctcccaccagcctcctttttatttttttgtacagatggggtcttgctatgttgcccaagctggtcttaaactcctggcctcaagcaatccttctgccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccaggtgtgcacagaaaaccgagaatattcaaaattccaaatttttttcttaggagcaagaagaaaatgtggccctaaagggggttagttgaggggtagggggtagtgaggatcttgatttggatctctttttatttaaatgtgaatttcaacttttgacaatcaaagaaaagacttttgttgaaatagctttactgtttctcaagtgttttggagaaaaaaatcaaccctgcaatcactttttggaattgtcttgatttttcggcagttcaagctatatcgaatatagttctgtgtagagaatgtcactgtagttttgagtgtatacatgtgtgggtgctgataattgtgtattttctttgggggtggaaaaggaaaacaattcaagctgagaaaagtattctcaaagatgcatttttataaattttattaaacaattttgttaaaccatt

SEQ ID NO: 313808 - DNA, 3751 bp, Homo sapiens
gggctgggctaggccaaaggtggctagtgttcctggtcctgacttggttgtgtcgatctctctgcagagtttccctacgtataccctggtggttcaagctgctgaccttcaaggtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaagggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgccggcgtctgtaggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaaaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctgggaaatgcagaaatcacgttgctggtggtttttcagctcccttcccttgagatgagtttctggggaaaaaaaagagactggttagtgatgcagttagtatagctttatactctctccactttatagctctaataagtttgtgttagaaaagtttcgacttatttcttaaagcttttttttttttcccatcactctttacatggtggtgatgtccaaaagatacccaaattttaatattccagaagaacaactttagcatcagaaggttcacccagcaccttgcagattttcttaaggaattttgtctcacttttaaaaagaaggggagaagtcagctactctagttctgttgttttgtgtatataattttttaaaaaaaatttgtgtgcttctgctcattactacactggtgtgtccctctgccttttttttttttttaagacagggtctcattctatcggccaggctggagtgcagtggtgcaatcacagctcactgcagccttgtcctcccaggctcaagctatccttgcacctcagcctcccaagtagctgggaccacaggcatgcaccactacgcatgactaattttttaaatatttgagacggggtctccctgtgttacccaggctggtctcaaactcctgggctcaagtgatcctcccatcttggcctcccagagtattgggattacagacatgagccactgcacctgcccagctccccaactccctgccattttttaagagacagtttcgctccatcgcccaggcctgggatgcagtgatgtgatcatagctcactgtaacctcaaactctggggctcaagcagttctcccaccagcctcctttttatttttttgtacagatggggtcttgctatgttgcccaagctggtcttaaactcctggcctcaagcaatccttctgccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccaggtgtgcacagaaaaccgagaatattcaaaattccaaatttttttcttaggagcaagaagaaaatgtggccctaaagggggttagttgaggggtagggggtagtgaggatcttgatttggatctctttttatttaaatgtgaatttcaacttttgacaatcaaagaaaagacttttgttgaaatagctttactgtttctcaagtgttttggagaaaaaaatcaaccctgcaatcactttttggaattgtcttgatttttcggcagttcaagctatatcgaatatagttctgtgtagagaatgtcactgtagttttgagtgtatacatgtgtgggtgctgataattgtgtattttctttgggggtggaaaaggaaaacaattcaagctgagaaaagtattctcaaagatgcatttttataaattttattaaacaattttgttaaaccatt

SEQ ID NO: 313809 - DNA, 3241 bp, Homo sapiens
  misc_feature (1)..(1): n is a, c, g, or t
  misc_feature (3)..(3): n is a, c, g, or t
ngnagaagattatgatgcgactgtgagtgcgttcgtagtttgagtttgctaggcagaatagtaatgaggatgtaagcccgtgggcgattatgagaatgactgcgccggtgaagcatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgccggcgtctgtaggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaaaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctgggaaatgcagaaatcacgttgctggtggtttttcagctcccttcccttgagatgagtttctggggaaaaaaaagagactggttagtgatgcagttagtatagctttatactctctccactttatagctctaataagtttgtgttagaaaagtttcgacttatttcttaaagcttttttttttttcccatcactctttacatggtggtgatgtccaaaagatacccaaattttaatattccagaagaacaactttagcatcagaaggttcacccagcaccttgcagattttcttaaggaattttgtctcacttttaaaaagaaggggagaagtcagctactctagttctgttgttttgtgtatataattttttaaaaaaaatttgtgtgcttctgctcattactacactggtgtgtccctctgccttttttttttttttaagacagggtctcattctatcggccaggctggagtgcagtggtgcaatcacagctcactgcagccttgtcctcccaggctcaagctatccttgcacctcagcctcccaagtagctgggaccacaggcatgcaccactacgcatgactaattttttaaatatttgagacggggtctccctgtgttacccaggctggtctcaaactcctgggctcaagtgatcctcccatcttggcctcccagagtattgggattacagacatgagccactgcacctgcccagctccccaactccctgccattttttaagagacagtttcgctccatcgcccaggcctgggatgcagtgatgtgatcatagctcactgtaacctcaaactctggggctcaagcagttctcccaccagcctcctttttatttttttgtacagatggggtcttgctatgttgcccaagctggtcttaaactcctggcctcaagcaatccttctgccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccaggtgtgcacagaaaaccgagaatattcaaaattccaaatttttttcttaggagcaagaagaaaatgtggccctaaagggggttagttgaggggtagggggtagtgaggatcttgatttggatctctttttatttaaatgtgaatttcaacttttgacaatcaaagaaaagacttttgttgaaatagctttactgtttctcaagtgttttggagaaaaaaatcaaccctgcaatcactttttggaattgtcttgatttttcggcagttcaagctatatcgaatatagttctgtgtagagaatgtcactgtagttttgagtgtatacatgtgtgggtgctgataattgtgtattttctttgggggtggaaaaggaaaacaattcaagctgagaaaagtattctcaaagatgcatttttataaattttattaaacaattttgttaaaccatt

SEQ ID NO: 313810 - DNA, 1470 bp, Homo sapiens
ctcttttgtagtgtattttaagggccatatttcattaatgatcacctgtctgtggtgctaatcttcaaaacagaatttgtgtcatattaaaaatgttagtaatctaccatataacttatcaaaacatctcagaaattttatttttttggagagggtctcatcctcaccctgtcacccaagctagacaggctagagtgcagtggggtgatcacagctcactacacccttcacttcccgggctcaagtgatccccttacttcagcctcccgagtagctgggactacaggtgcaagccacaacacccagctaatatttaaatttttttgtagagacaaggtatcaccgtgttgcctaggctggtcttaaactcctggcctcaagcaatccttctgccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccaggtgtgcacagaaaaccgagaatattcaaaattccaaatttttttcttaggagcaagaagaaaatgtggccctaaagggggttagttgaggggtagggggtagtgaggatcttgatttggatctctttttatttaaatgtgaatttcaacttttgacaatcaaagaaaagacttttgttgaaatagctttactgtttctcaagtgttttggagaaaaaaatcaaccctgcaatcactttttggaattgtcttgatttttcggcagttcaagctatatcgaatatagttctgtgtagagaatgtcactgtagttttgagtgtatacatgtgtgggtgctgataattgtgtattttctttgggggtggaaaaggaaaacaattcaagctgagaaaagtattctcaaagatgcatttttataaattttattaaacaattttgttaaaccatt

SEQ ID NO: 313811 - DNA, 1338 bp, Homo sapiens
  misc_feature (20)..(20): n is a, c, g, or t
  misc_feature (23)..(23): n is a, c, g, or t
atgtgtgctctaccttactnttntttgagacaaagtcttgccctgtagcccaggctggatgcagtgcagtggtgtgatatcagctcactgcaaactccacctcccagcttcaagtgattctcctgcctcaacctcctgagtcgctgggattacaggcatgcaccaccacacctggctaatttttgtatttttagtagagacagggtttcaccatgttggccaggctggtcttgaactcttgagctcaaatgatctgcctaccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccaggtgtgcacagaaaaccgagaatattcaaaattccaaatttttttcttaggagcaagaagaaaatgtggccctaaagggggttagttgaggggtagggggtagtgaggatcttgatttggatctctttttatttaaatgtgaatttcaacttttgacaatcaaagaaaagacttttgttgaaatagctttactgtttctcaagtgttttggagaaaaaaatcaaccctgcaatcactttttggaattgtcttgatttttcggcagttcaagctatatcgaatatagttctgtgtagagaatgtcactgtagttttgagtgtatacatgtgtgggtgctgataattgtgtattttctttgggggtggaaaaggaaaacaattcaagctgagaaaagtattctcaaagatgcatttttataaattttattaaacaattttgttaaaccatt

SEQ ID NO: 313812 - DNA, 4421 bp, Homo sapiens
agtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaagggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgccggcgtctgtaggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaaaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctgggaaatgcagaaatcacgttgctggtggtttttcagctcccttcccttgagatgagtttctggggaaaaaaaagagactggttagtgatgcagttagtatagctttatactctctccactttatagctctaataagtttgtgttagaaaagtttcgacttatttcttaaagcttttttttttttcccatcactctttacatggtggtgatgtccaaaagatacccaaattttaatattccagaagaacaactttagcatcagaaggttcacccagcaccttgcagattttcttaaggaattttgtctcacttttaaaaagaaggggagaagtcagctactctagttctgttgttttgtgtatataattttttaaaaaaaatttgtgtgcttctgctcattactacactggtgtgtccctctgccttttttttttttttaagacagggtctcattctatcggccaggctggagtgcagtggtgcaatcacagctcactgcagccttgtcctcccaggctcaagctatccttgcacctcagcctcccaagtagctgggaccacaggcatgcaccactacgcatgactaattttttaaatatttgagacggggtctccctgtgttacccaggctggtctcaaactcctgggctcaagtgatcctcccatcttggcctcccagagtattgggattacagacatgagccactgcacctgcccagctccccaactccctgccattttttaagagacagtttcgctccatcgcccaggcctgggatgcagtgatgtgatcatagctcactgtaacctcaaactctggggctcaagcagttctcccaccagcctcctttttatttttttgtacagatggggtcttgctatgttgcccaagctggtcttaaactcctggcctcaagcaatccttctgccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccagtcgtggcagtacgagtcgtggcaagaaaggtgtcctctagaatcgccgcagcg

SEQ ID NO: 313813 - DNA, 4372 bp, Homo sapiens
agtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaagggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgccggcgtctgtaggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaaaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctgggaaatgcagaaatcacgttgctggtggtttttcagctcccttcccttgagatgagtttctggggaaaaaaaagagactggttagtgatgcagttagtatagctttatactctctccactttatagctctaataagtttgtgttagaaaagtttcgacttatttcttaaagcttttttttttttcccatcactctttacatggtggtgatgtccaaaagatacccaaattttaatattccagaagaacaactttagcatcagaaggttcacccagcaccttgcagattttcttaaggaattttgtctcacttttaaaaagaaggggagaagtcagctactctagttctgttgttttgtgtatataattttttaaaaaaaatttgtgtgcttctgctcattactacactggtgtgtccctctgccttttttttttttttaagacagggtctcattctatcggccaggctggagtgcagtggtgcaatcacagctcactgcagccttgtcctcccaggctcaagctatccttgcacctcagcctcccaagtagctgggaccacaggcatgcaccactacgcatgactaattttttaaatatttgagacggggtctccctgtgttacccaggctggtctcaaactcctgggctcaagtgatcctcccatcttggcctcccagagtattgggattacagacatgagccactgcacctgcccagctccccaactccctgccattttttaagagacagtttcgctccatcgcccaggcctgggatgcagtgatgtgatcatagctcactgtaacctcaaactctggggctcaagcagttctcccaccagcctcctttttatttttttgtacagatggggtcttgctatgttgcccaagctggtcttaaactcctggcctcaagcaatccttctgccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgccagtttctgtagacatcatcaaaagcaggcacttggggattctgggctttgagtacaaaccacgg

SEQ ID NO: 313814 - DNA, 1041 bp, Homo sapiens
cccagaattttcagagatgaggtagacccacctcaatcatcctcagcatcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccaggtgtgcacagaaaaccgagaatattcaaaattccaaatttttttcttaggagcaagaagaaaatgtggccctaaagggggttagttgaggggtagggggtagtgaggatcttgatttggatctctttttatttaaatgtgaatttcaacttttgacaatcaaagaaaagacttttgttgaaatagctttactgtttctcaagtgttttggagaaaaaaatcaaccctgcaatcactttttggaattgtcttgatttttcggcagttcaagctatatcgaatatagttctgtgtagagaatgtcactgtagttttgagtgtatacatgtgtgggtgctgataattgtgtattttctttgggggtggaaaaggaaaacaattcaagctgagaaaagtattctcaaagatgcatttttataaattttattaaacaattttgttaaaccatt

SEQ ID NO: 313815 - DNA, 2534 bp, Homo sapiens
agtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaagggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgccggcgtctgtaggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccaggactttgacttgagccacttgcccctcttcggctaccccttctatggggtgctgcgagtgagcatgcaggccctgtccggacccactctcctggggctcaaccgccagcatctca

SEQ ID NO: 313816 - DNA, 970 bp, Homo sapiens
agtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactgtaagtatctcttagaagcttgttgacaccggggtaacatccacccaggattttttggtcaacccatgctggatccgcagatcagaggctctgaacacatgaggagcttaacttgacacctcttgacctgttgctaaggagaagtgatgggagaacgtg

SEQ ID NO: 313817 - DNA, 411 bp, Homo sapiens
caaacatgctcctcctgcctcaggacctctgtccttactgtttcctctgcctggaacactttcccccagatttgggaaaatgacagtgattgagtttaaaacccatctgaaagttaaggaccatgcttgagttcacatatcactgtctactatgttgtactgtacataccgacttcagggatgtgagtgtcacgtggattgacatcttcaagtgtattgaaggcagctagtggctgtctaactgccccctgtctggtatgaggggtgctctgtgatagctgctgcttctggccttctttatctttggctctcaacacttgctctgtctcccccaccatcccagttctgattctgctgctcttgctgtttcttcggaggagagcggtggtcaaagagcccttactgccccca

SEQ ID NO: 313818 - DNA, 1345 bp, Homo sapiens
agtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcaccat

SEQ ID NO: 313819 - DNA, 4633 bp, Homo sapiens
agtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgccggcgtctgtaggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaaaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctgggaaatgcagaaatcacgttgctggtggtttttcagctcccttcccttgagatgagtttctggggaaaaaaaagagactggttagtgatgcagttagtatagctttatactctctccactttatagctctaataagtttgtgttagaaaagtttcgacttatttcttaaagcttttttttttttcccatcactctttacatggtggtgatgtccaaaagatacccaaattttaatattccagaagaacaactttagcatcagaaggttcacccagcaccttgcagattttcttaaggaattttgtctcacttttaaaaagaaggggagaagtcagctactctagttctgttgttttgtgtatataattttttaaaaaaaatttgtgtgcttctgctcattactacactggtgtgtccctctgccttttttttttttttaagacagggtctcattctatcggccaggctggagtgcagtggtgcaatcacagctcactgcagccttgtcctcccaggctcaagctatccttgcacctcagcctcccaagtagctgggaccacaggcatgcaccactacgcatgactaattttttaaatatttgagacggggtctccctgtgttacccaggctggtctcaaactcctgggctcaagtgatcctcccatcttggcctcccagagtattgggattacagacatgagccactgcacctgcccagctccccaactccctgccattttttaagagacagtttcgctccatcgcccaggcctgggatgcagtgatgtgatcatagctcactgtaacctcaaactctggggctcaagcagttctcccaccagcctcctttttatttttttgtacagatggggtcttgctatgttgcccaagctggtcttaaactcctggcctcaagcaatccttctgccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccaggtgtgcacagaaaaccgagaatattcaaaattccaaatttttttcttaggagcaagaagaaaatgtggccctaaagggggttagttgaggggtagggggtagtgaggatcttgatttggatctctttttatttaaatgtgaatttcaacttttgacaatcaaagaaaagacttttgttgaaatagctttactgtttctcaagtgttttggagaaaaaaatcaaccctgcaatcactttttggaattgtcttgatttttcggcagttcaagctatatcgaatatagttctgtgtagagaatgtcactgtagttttgagtgtatacatgtgtgggtgctgataattgtgtattttctttgggggtggaaaaggaaaacaattcaagctgagaaaagtattctcaaagatgcatttttataaattttattaaacaattttgttaaaccatt

SEQ ID NO: 313820 - DNA, 4972 bp, Homo sapiens
agtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaagggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgccggcgtctgtaggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaaaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctgggaaatgcagaaatcacgttgctggtggtttttcagctcccttcccttgagatgagtttctggggaaaaaaaagagactggttagtgatgcagttagtatagctttatactctctccactttatagctctaataagtttgtgttagaaaagtttcgacttatttcttaaagcttttttttttttcccatcactctttacatggtggtgatgtccaaaagatacccaaattttaatattccagaagaacaactttagcatcagaaggttcacccagcaccttgcagattttcttaaggaattttgtctcacttttaaaaagaaggggagaagtcagctactctagttctgttgttttgtgtatataattttttaaaaaaaatttgtgtgcttctgctcattactacactggtgtgtccctctgccttttttttttttttaagacagggtctcattctatcggccaggctggagtgcagtggtgcaatcacagctcactgcagccttgtcctcccaggctcaagctatccttgcacctcagcctcccaagtagctgggaccacaggcatgcaccactacgcatgactaattttttaaatatttgagacggggtctccctgtgttacccaggctggtctcaaactcctgggctcaagtgatcctcccatcttggcctcccagagtattgggattacagacatgagccactgcacctgcccagctccccaactccctgccattttttaagagacagtttcgctccatcgcccaggcctgggatgcagtgatgtgatcatagctcactgtaacctcaaactctggggctcaagcagttctcccaccagcctcctttttatttttttgtacagatggggtcttgctatgttgcccaagctggtcttaaactcctggcctcaagcaatccttctgccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccaggtgtgcacagaaaaccgagaatattcaaaattccaaatttttttcttaggagcaagaagaaaatgtggccctaaagggggttagttgaggggtagggggtagtgaggatcttgatttggatctctttttatttaaatgtgaatttcaacttttgacaatcaaagaaaagacttttgttgaaatagctttactgtttctcaagtgttttggagaaaaaaatcaaccctgcaatcactttttggaattgtcttgatttttcggcagttcaagctatatcgaatatagttctgtgtagagaatgtcactgtagttttgagtgtatacatgtgtgggtgctgataattgtgtattttctttgggggtggaaaaggaaaacaattcaagctgagaaaagtattctcaaagatgcatttttataaattttattaaacaattttgttaaaccattaaaaaaaacaaaaaacacaaaaaaaaattgtgggggggggcgggctgagaaaggtttttaacccattgggtggggggggggggccgaggtttggtgaccgggcaaaagggtgtcaagggaacgggggagacgggggggggttccccaaaaaaaggg

SEQ ID NO: 313821 - DNA, 3837 bp, Homo sapiens
ctgactctttggtcgcattcagtattgcctcctgctggttcttatccctgttcccttttcttcaagccaggtatgaactcacctatttttgtaaagctggaatctcactgtttcacccaggctgcagtgctgtggtaccagtcatagctcactgtagcctcaaactcctggactcaagtgattctcctgcctcagccttgtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaagggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgccggcgtctgtaggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaaaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctgggaaatgcagaaatcacgttgctggtggtttttcagctcccttcccttgagatgagtttctggggaaaaaaaagagactggttagtgatgcagttagtatagctttatactctctccactttatagctctaataagtttgtgttagaaaagtttcgacttatttcttaaagcttttttttttttcccatcactctttacatggtggtgatgtccaaaagatacccaaattttaatattccagaagaacaactttagcatcagaaggttcacccagcaccttgcagattttcttaaggaattttgtctcacttttaaaaagaaggggagaagtcagctactctagttctgttgttttgtgtatataattttttaaaaaaaatttgtgtgcttctgctcattactacactggtgtgtccctctgccttttttttttttttaagacagggtctcattctatcggccaggctggagtgcagtggtgcaatcacagctcactgcagccttgtcctcccaggctcaagctatccttgcacctcagcctcccaagtagctgggaccacaggcatgcaccactacgcatgactaattttttaaatatttgagacggggtctccctgtgttacccaggctggtctcaaactcctgggctcaagtgatcctcccatcttggcctcccagagtattgggattacagacatgagccactgcacctgcccagctccccaactccctgccattttttaagagacagtttcgctccatcgcccaggcctgggatgcagtgatgtgatcatagctcactgtaacctcaaactctggggctcaagcagttctcccaccagcctcctttttatttttttgtacagatggggtcttgctatgttgcccaagctggtcttaaactcctggcctcaagcaatccttctgccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccaggtgtgcacagaaaaccgagaatattcaaaattccaaatttttttcttaggagcaagaagaaaatgtggccctaaagggggttagttgaggggtagggggtagtgaggatcttgatttggatctctttttatttaaatgtgaatttcaacttttgacaatcaaagaaaagacttttgttgaaatagctttactgtttctcaagtgttttggagaaaaaaatcaaccctgcaatcactttttggaattgtcttgatttttcggcagttcaagctatatcgaatatagttctgtgtagagaatgtcactgtagttttgagtgtatacatgtgtgggtgctgataattgtgtattttctttgggggtggaaaaggaaaacaattcaagctgagaaaagtattctcaaagatgcatttttataaattttattaaacaattttgttaaaccatt

SEQ ID NO: 313822 - DNA, 2825 bp, Homo sapiens
tctttgtaccagaagctggtgcctttcagacctttgcctgtgtcatatgttactgtcccattggctaagcaagtcacacaacaaagccccagatcgatggatgtatacttttctcacaagctggggttgggagggagtgaatatttgccaaacagtgatctaatcatcatgtcctatgaaaattagtaaggcacacagcctatatctggatccacacatgctactcacaatcctttgggccatgtttttttccagtgctatttgggagacttttagcttgaaaactgtcattttgcattaaactggtaaagatcatacagttggcagtgaaggcatcatccaaccataatctataaactgaacatagccctgtgtgtatgactatttctttcctactcttcattgtacttcaacctttttctccaaaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaaaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctgggaaatgcagaaatcacgttgctggtggtttttcagctcccttcccttgagatgagtttctggggaaaaaaaagagactggttagtgatgcagttagtatagctttatactctctccactttatagctctaataagtttgtgttagaaaagtttcgacttatttcttaaagcttttttttttttcccatcactctttacatggtggtgatgtccaaaagatacccaaattttaatattccagaagaacaactttagcatcagaaggttcacccagcaccttgcagattttcttaaggaattttgtctcacttttaaaaagaaggggagaagtcagctactctagttctgttgttttgtgtatataattttttaaaaaaaatttgtgtgcttctgctcattactacactggtgtgtccctctgccttttttttttttttaagacagggtctcattctatcggccaggctggagtgcagtggtgcaatcacagctcactgcagccttgtcctcccaggctcaagctatccttgcacctcagcctcccaagtagctgggaccacaggcatgcaccactacgcatgactaattttttaaatatttgagacggggtctccctgtgttacccaggctggtctcaaactcctgggctcaagtgatcctcccatcttggcctcccagagtattgggattacagacatgagccactgcacctgcccagctccccaactccctgccattttttaagagacagtttcgctccatcgcccaggcctgggatgcagtgatgtgatcatagctcactgtaacctcaaactctggggctcaagcagttctcccaccagcctcctttttatttttttgtacagatggggtcttgctatgttgcccaagctggtcttaaactcctggcctcaagcaatccttctgccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccaggtgtgcacagaaaaccgagaatattcaaaattccaaatttttttcttaggagcaagaagaaaatgtggccctaaagggggttagttgaggggtagggggtagtgaggatcttgatttggatctctttttatttaaatgtgaatttcaacttttgacaatcaaagaaaagacttttgttgaaatagctttactgtttctcaagtgttttggagaaaaaaatcaaccctgcaatcactttttggaattgtcttgatttttcggcagttcaagctatatcgaatatagttctgtgtagagaatgtcactgtagttttgagtgtatacatgtgtgggtgctgataattgtgtattttctttgggggtggaaaaggaaaacaattcaagctgagaaaagtattctcaaagatgcatttttataaattttattaaacaattttgttaaaccatt

SEQ ID NO: 313823 - DNA, 2508 bp, Homo sapiens
agtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaagggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgccggcgtctgtaggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccagtcacgatcgactgtgagccaacggcaccagggggcatggacgcatcgcgcgcgagatcgactctagacgatcttgcatactggcttcag

SEQ ID NO: 313824 - DNA, 1182 bp, Homo sapiens
agtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtatacctgatgggacgatggcggtaccggctgattatg

SEQ ID NO: 313825 - DNA, 557 bp, Homo sapiens
  misc_feature (456)..(456): n is a, c, g, or t
ttcgtgccgattcggcacgagaagagaaggaaaaccctgtctttagcaccctttaaaagaactgtgccccccttctcaaccgtggcagctcccgctggctcctatgccctgccctaaagggctcttgagcctctgggaatgggaggggccaagagaaggaaaaccctgtctttagcaccctttaaaagaactgtgccccccttctcagtgctgcctttgcatgggcctggcccggctcgcattcgtcagtgactccaaccctcctgcttgctgtacttgggatgaaacgaccccacaggtcaggtggagggtggggcgtgggcatcagccaggattgccgttacagtctttttctcaggagctacaaagatctcttcctgttactaaatggtcgcaccccggtgtgcgaaaaactcgtgccgaatccctgcagccgggggattcatattctaaacngccgccacgcgtggactccacttttgtccctttatgaaggttaattcgacttgggtatcatgtcatactgttcctgtttaaattgttaccgtcccaatccc

SEQ ID NO: 313826 - DNA, 655 bp, Homo sapiens
cgggcggaagtagccgtcgcatcgcggatcgcgaaacgccgcggagctgaggcagttccgctggctagtgtgtacgcggcgagcttctcccggcgccgcccgctcggctcccatagcgcccgcgacagcggtccggacgccgcccgaacatggactccgccggccaaggtacctgccgggcccggccccttcgccgcagatgggcccaggctgcccgttgttctccgtctcccggggtcgcgtctgcgactctctgtcctctcggtctcggttcacccaccccgcggcccctcttcagctcccggggccactgacctcgaagcttatgatggtcgtggtgtgttttttgcccgcggcccagaccgcttcctgggctctctccagccgccctcctggtctcccctgggaccgttccgaggtgtggttccctggcgcccgccgttgctcccgtagtttgggttctgtcgctcccagcaggtctcgcttatgccgcccaccccgtgccctggcggggccctcgggttcacgctgtctggccctggacccagtccgaggtgttgagggcggctcccgagcagagaaggggtcttcgcgttcagcagagctccccttgggcagcaactctgctcggagctcagcctgcttaggggttgcc

SEQ ID NO: 313827 - DNA, 2405 bp, Homo sapiens
cgggcggaagtagccgtcgcatcgcggatcgcgaaacgccgcggagctgaggcagttccgctggctagtgtgtacgcggcgagcttctcccggcgccgcccgctcggctcccatagcgcccgcgacagcggtccggacgccgcccgaacatggactccgccggccaagatatcaacctgaattctcctaacaaaggtctgctgtctgactccatgacggatgttcctgtcgacacaggtgtggctgcccggactcctgctgttgagggtctgacagaggctgaggaggaggagctcagggctgagcttaccaaggtggaagaggaaattgtcactctgcgccaggtcctggcagccaaggagaggcactgtggagagctcaagaggaggctgggcctctccaccctgggggagctgaaacagaacctgtccaggagctggcatgacgtgcaggtctctagcgcctatgtgaaaacttctgagaaacttggagagtggaatgagaaagtgacccagtcagacctctacaagaagactcaggaaactctttcacaggcaggacagaagacttcagctgccctgtccacagtgggctctgccatcagcaggaagcttggagacatgagcagctactccatccgccactcaataagtatgccagccatgaggaactctgcgaccttcaagtcgtttgaggaccgagttgggaccataaagtctaaggttgtgggtgacagagagaacggcagtgacaacctcccttcctcagcggggagtggtgacaagcccctgtcggatcccgcacctttctaagcctgtggttgcttcacccgctgcagagcacacgcaacccagcctcagcatcacagccgcagctctgttcagcggagcagccagccagggcggatgagcagagccggccctgaggacagtcctgcccatccacgcggagatgtggctgccgcgtttgcatgaatttgaagaacacaggcttgtacacagatgttttacactcacgtttgtagatgaaacagatcactgtgctgtccttcctaggggtgcaggaagtggacagggcggagggtttgaaagaatattgagccaaagcccaggctccctttgggaatcatgttagcccatcagaatgttgaaggattgaagagttctaagcataaaataagtggcattttctgacttcttcctcctcctccttccctgactcacagaaggaatgcaatcacccagcaagtcctacctgttacgcaattttttatctcaaaatgccgaacgagaaaactgtccattttctgagacccccagaaaggaaactgaccctcagcagctgcctgattgttacgcgaatctagctttaacggaagcaaattcattattttttaaatgcagtggacttttcaaaaagtttaaattaggcaaagcagctttagcctcatagaatattatttctttggactcaagctgaaatacaagccttacattgccttatgctttatttctttctaatttttatatgtatatagatgagggttccttaatggttgtgagcattgtgtggaattttacacctggcctgcgtggcagcctcttccagttgaggtgttttatgtcacgcacactccatcccagtgtacaaaacctgcttctcttctcaaccgtggcagctcccgctggctcctatgccctgccctaaagggctcttgagcctctgggaatgggaggggccaagagaaggaaaaccctgtctttagcaccctttaaaagaactgtgccccccttctcagtgctgcctttgcatgggcctggcccggctcgcattcgtcagtgactccaaccctcctgcttgctgtacttgggatgaaacgaccccacaggtcaggtggagggtggggcgtgggcatcagccaggattgccgttacagtctttttctcaggagctacaaagatctcttcctgttactaaatggtcgcaccccagcagcctctctcgcacaccggggccctgcatgtcagatggcgtggtctgcagggggagctctgtgccttagtggctcttggcaggacactgagggcctgcctgtggtgtgcccggctctgccactcccgggaggggaagggctgctcagctcaaggtgtcctgttcggtagagcaagtgtcctctgacagccgtgtccccggacagttcagacacccttggggatggcactccacacacgacagagatgcaggggccagggaagcccagcgctcggtgcccttcgtccagggttaaaatcggcctgtggggtgtggtgagaaggcaggttgtgcgggtgttgaccgatgtatcttttccttaaagttattataataatgggtaatttgtcaataaagcattcctttgggggaaa

SEQ ID NO: 313828 - DNA, 2345 bp, Homo sapiens
cgggcggaagtagccgtcgcatcgcggatcgcgaaacgccgcggagctgaggcagttccgctggctagtgtgtacgcggcgagcttctcccggcgccgcccgctcggctcccatagcgcccgcgacagcggtccggacgccgcccgaacatggactccgccggccaagatatcaacctgaattctcctaacaaaggtctgctgtctgactccatgacggatgttcctgtcgacacaggtgtggctgcccggactcctgctgttgagggtctgacagaggctgaggaggaggagctcagggctgagcttaccaaggtggaagaggaaattgtcactctgcgccaggtcctggcagccaaggagaggcactgtggagagctcaagaggaggctgggcctctccaccctgggggagctgaaacagaacctgtccaggagctggcatgacgtgcaggtctctagcgcctacaagaagactcaggaaactctttcacaggcaggacagaagacttcagctgccctgtccacagtgggctctgccatcagcaggaagcttggagacatgagcagctactccatccgccactcaataagtatgccagccatgaggaactctgcgaccttcaagtcgtttgaggaccgagttgggaccataaagtctaaggttgtgggtgacagagagaacggcagtgacaacctcccttcctcagcggggagtggtgacaagcccctgtcggatcccgcacctttctaagcctgtggttgcttcacccgctgcagagcacacgcaacccagcctcagcatcacagccgcagctctgttcagcggagcagccagccagggcggatgagcagagccggccctgaggacagtcctgcccatccacgcggagatgtggctgccgcgtttgcatgaatttgaagaacacaggcttgtacacagatgttttacactcacgtttgtagatgaaacagatcactgtgctgtccttcctaggggtgcaggaagtggacagggcggagggtttgaaagaatattgagccaaagcccaggctccctttgggaatcatgttagcccatcagaatgttgaaggattgaagagttctaagcataaaataagtggcattttctgacttcttcctcctcctccttccctgactcacagaaggaatgcaatcacccagcaagtcctacctgttacgcaattttttatctcaaaatgccgaacgagaaaactgtccattttctgagacccccagaaaggaaactgaccctcagcagctgcctgattgttacgcgaatctagctttaacggaagcaaattcattattttttaaatgcagtggacttttcaaaaagtttaaattaggcaaagcagctttagcctcatagaatattatttctttggactcaagctgaaatacaagccttacattgccttatgctttatttctttctaatttttatatgtatatagatgagggttccttaatggttgtgagcattgtgtggaattttacacctggcctgcgtggcagcctcttccagttgaggtgttttatgtcacgcacactccatcccagtgtacaaaacctgcttctcttctcaaccgtggcagctcccgctggctcctatgccctgccctaaagggctcttgagcctctgggaatgggaggggccaagagaaggaaaaccctgtctttagcaccctttaaaagaactgtgccccccttctcagtgctgcctttgcatgggcctggcccggctcgcattcgtcagtgactccaaccctcctgcttgctgtacttgggatgaaacgaccccacaggtcaggtggagggtggggcgtgggcatcagccaggattgccgttacagtctttttctcaggagctacaaagatctcttcctgttactaaatggtcgcaccccagcagcctctctcgcacaccggggccctgcatgtcagatggcgtggtctgcagggggagctctgtgccttagtggctcttggcaggacactgagggcctgcctgtggtgtgcccggctctgccactcccgggaggggaagggctgctcagctcaaggtgtcctgttcggtagagcaagtgtcctctgacagccgtgtccccggacagttcagacacccttggggatggcactccacacacgacagagatgcaggggccagggaagcccagcgctcggtgcccttcgtccagggttaaaatcggcctgtggggtgtggtgagaaggcaggttgtgcgggtgttgaccgatgtatcttttccttaaagttattataataatgggtaatttgtcaataaagcattcctttgggggaaa

SEQ ID NO: 313829 - DNA, 2372 bp, Homo sapiens
cgggcggaagtagccgtcgcatcgcggatcgcgaaacgccgcggagctgaggcagttccgctggctagtgtgtacgcggcgagcttctcccggcgccgcccgctcggctcccatagcgcccgcgacagcggtccggacgccgcccgaacatggactccgccggccaagatatcaacctgaattctcctaacaaaggtctgctgtctgactccatgacggatgttcctgtcgacacaggtgtggctgcccggactcctgctgttgagggtctgacagaggctgaggaggaggagctcagggctgagcttaccaaggtggaagaggaaattgtcactctgcgccaggtcctggcagccaaggagaggcactgtggagagctcaagaggaggctgggcctctccaccctgggggagctgaaacagaacctgtccaggagctggcatgacgtgcaggtctctagcgcctacaagaagactcaggaaactctttcacaggcaggacagaagacttcagctgccctgtccacagtgggctctgccatcagcaggaagcttggagacatgagggctcatccattttcacactcctttagcagctactccatccgccactcaataagtatgccagccatgaggaactctgcgaccttcaagtcgtttgaggaccgagttgggaccataaagtctaaggttgtgggtgacagagagaacggcagtgacaacctcccttcctcagcggggagtggtgacaagcccctgtcggatcccgcacctttctaagcctgtggttgcttcacccgctgcagagcacacgcaacccagcctcagcatcacagccgcagctctgttcagcggagcagccagccagggcggatgagcagagccggccctgaggacagtcctgcccatccacgcggagatgtggctgccgcgtttgcatgaatttgaagaacacaggcttgtacacagatgttttacactcacgtttgtagatgaaacagatcactgtgctgtccttcctaggggtgcaggaagtggacagggcggagggtttgaaagaatattgagccaaagcccaggctccctttgggaatcatgttagcccatcagaatgttgaaggattgaagagttctaagcataaaataagtggcattttctgacttcttcctcctcctccttccctgactcacagaaggaatgcaatcacccagcaagtcctacctgttacgcaattttttatctcaaaatgccgaacgagaaaactgtccattttctgagacccccagaaaggaaactgaccctcagcagctgcctgattgttacgcgaatctagctttaacggaagcaaattcattattttttaaatgcagtggacttttcaaaaagtttaaattaggcaaagcagctttagcctcatagaatattatttctttggactcaagctgaaatacaagccttacattgccttatgctttatttctttctaatttttatatgtatatagatgagggttccttaatggttgtgagcattgtgtggaattttacacctggcctgcgtggcagcctcttccagttgaggtgttttatgtcacgcacactccatcccagtgtacaaaacctgcttctcttctcaaccgtggcagctcccgctggctcctatgccctgccctaaagggctcttgagcctctgggaatgggaggggccaagagaaggaaaaccctgtctttagcaccctttaaaagaactgtgccccccttctcagtgctgcctttgcatgggcctggcccggctcgcattcgtcagtgactccaaccctcctgcttgctgtacttgggatgaaacgaccccacaggtcaggtggagggtggggcgtgggcatcagccaggattgccgttacagtctttttctcaggagctacaaagatctcttcctgttactaaatggtcgcaccccagcagcctctctcgcacaccggggccctgcatgtcagatggcgtggtctgcagggggagctctgtgccttagtggctcttggcaggacactgagggcctgcctgtggtgtgcccggctctgccactcccgggaggggaagggctgctcagctcaaggtgtcctgttcggtagagcaagtgtcctctgacagccgtgtccccggacagttcagacacccttggggatggcactccacacacgacagagatgcaggggccagggaagcccagcgctcggtgcccttcgtccagggttaaaatcggcctgtggggtgtggtgagaaggcaggttgtgcgggtgttgaccgatgtatcttttccttaaagttattataataatgggtaatttgtcaataaagcattcctttgggggaaa

SEQ ID NO: 313830 - DNA, 2432 bp, Homo sapiens
cgggcggaagtagccgtcgcatcgcggatcgcgaaacgccgcggagctgaggcagttccgctggctagtgtgtacgcggcgagcttctcccggcgccgcccgctcggctcccatagcgcccgcgacagcggtccggacgccgcccgaacatggactccgccggccaagatatcaacctgaattctcctaacaaaggtctgctgtctgactccatgacggatgttcctgtcgacacaggtgtggctgcccggactcctgctgttgagggtctgacagaggctgaggaggaggagctcagggctgagcttaccaaggtggaagaggaaattgtcactctgcgccaggtcctggcagccaaggagaggcactgtggagagctcaagaggaggctgggcctctccaccctgggggagctgaaacagaacctgtccaggagctggcatgacgtgcaggtctctagcgcctatgtgaaaacttctgagaaacttggagagtggaatgagaaagtgacccagtcagacctctacaagaagactcaggaaactctttcacaggcaggacagaagacttcagctgccctgtccacagtgggctctgccatcagcaggaagcttggagacatgagggctcatccattttcacactcctttagcagctactccatccgccactcaataagtatgccagccatgaggaactctgcgaccttcaagtcgtttgaggaccgagttgggaccataaagtctaaggttgtgggtgacagagagaacggcagtgacaacctcccttcctcagcggggagtggtgacaagcccctgtcggatcccgcacctttctaagcctgtggttgcttcacccgctgcagagcacacgcaacccagcctcagcatcacagccgcagctctgttcagcggagcagccagccagggcggatgagcagagccggccctgaggacagtcctgcccatccacgcggagatgtggctgccgcgtttgcatgaatttgaagaacacaggcttgtacacagatgttttacactcacgtttgtagatgaaacagatcactgtgctgtccttcctaggggtgcaggaagtggacagggcggagggtttgaaagaatattgagccaaagcccaggctccctttgggaatcatgttagcccatcagaatgttgaaggattgaagagttctaagcataaaataagtggcattttctgacttcttcctcctcctccttccctgactcacagaaggaatgcaatcacccagcaagtcctacctgttacgcaattttttatctcaaaatgccgaacgagaaaactgtccattttctgagacccccagaaaggaaactgaccctcagcagctgcctgattgttacgcgaatctagctttaacggaagcaaattcattattttttaaatgcagtggacttttcaaaaagtttaaattaggcaaagcagctttagcctcatagaatattatttctttggactcaagctgaaatacaagccttacattgccttatgctttatttctttctaatttttatatgtatatagatgagggttccttaatggttgtgagcattgtgtggaattttacacctggcctgcgtggcagcctcttccagttgaggtgttttatgtcacgcacactccatcccagtgtacaaaacctgcttctcttctcaaccgtggcagctcccgctggctcctatgccctgccctaaagggctcttgagcctctgggaatgggaggggccaagagaaggaaaaccctgtctttagcaccctttaaaagaactgtgccccccttctcagtgctgcctttgcatgggcctggcccggctcgcattcgtcagtgactccaaccctcctgcttgctgtacttgggatgaaacgaccccacaggtcaggtggagggtggggcgtgggcatcagccaggattgccgttacagtctttttctcaggagctacaaagatctcttcctgttactaaatggtcgcaccccagcagcctctctcgcacaccggggccctgcatgtcagatggcgtggtctgcagggggagctctgtgccttagtggctcttggcaggacactgagggcctgcctgtggtgtgcccggctctgccactcccgggaggggaagggctgctcagctcaaggtgtcctgttcggtagagcaagtgtcctctgacagccgtgtccccggacagttcagacacccttggggatggcactccacacacgacagagatgcaggggccagggaagcccagcgctcggtgcccttcgtccagggttaaaatcggcctgtggggtgtggtgagaaggcaggttgtgcgggtgttgaccgatgtatcttttccttaaagttattataataatgggtaatttgtcaataaagcattcctttgggggaaa

SEQ ID NO: 313831 - DNA, 2842 bp, Homo sapiens
  misc_feature (2369)..(2370): n is a, c, g, or t
  misc_feature (2372)..(2372): n is a, c, g, or t
cgggcggaagtagccgtcgcatcgcggatcgcgaaacgccgcggagctgaggcagttccgctggctagtgtgtacgcggcgagcttctcccggcgccgcccgctcggctcccatagcgcccgcgacagcggtccggacgccgcccgaacatggactccgccggccaagatatcaacctgaattctcctaacaaaggtctgctgtctgactccatgacggatgttcctgtcgacacaggtgtggctgcccggactcctgctgttgagggtctgacagaggctgaggaggaggagctcagggctgagcttaccaaggtggaagaggaaattgtcactctgcgccaggtcctggcagccaaggagaggcactgtggagagctcaagaggaggctgggcctctccaccctgggggagctgaaacagaacctgtccaggagctggcatgacgtgcaggtctctagcgcctatgtgaaaacttctgagaaacttggagagtggaatgagaaagtgacccagtcagacctctacaagaagactcaggaaactctttcacaggcaggacagaagacttcagctgccctgtccacagtgggctctgccatcagcaggaagcttggagacatgaggaactctgcgaccttcaagtcgtttgaggaccgagttgggaccataaagtctaaggttgtgggtgacagagagaacggcagtgacaacctcccttcctcagcggggagtggtgacaagcccctgtcggatcccgcacctttctaagcctgtggttgcttcacccgctgcagagcacacgcaacccagcctcagcatcacagccgcagctctgttcagcggagcagccagccagggcggatgagcagagccggccctgaggacagtcctgcccatccacgcggagatgtggctgccgcgtttgcatgaatttgaagaacacaggcttgtacacagatgttttacactcacgtttgtagatgaaacagatcactgtgctgtccttcctaggggtgcaggaagtggacagggcggagggtttgaaagaatattgagccaaagcccaggctccctttgggaatcatgttagcccatcagaatgttgaaggattgaagagttctaagcataaaataagtggcattttctgacttcttcctcctcctccttccctgactcacagaaggaatgcaatcacccagcaagtcctacctgttacgcaattttttatctcaaaatgccgaacgagaaaactgtccattttctgagacccccagaaaggaaactgaccctcagcagctgcctgattgttacgcgaatctagctttaacggaagcaaattcattattttttaaatgcagtggacttttcaaaaagtttaaattaggcaaagcagctttagcctcatagaatattatttctttggactcaagctgaaatacaagccttacattgccttatgctttatttctttctaatttttatatgtatatagatgagggttccttaatggttgtgagcattgtgtggaattttacacctggcctgcgtggcagcctcttccagttgaggtgttttatgtcacgcacactccatcccagtgtacaaaacctgcttctcttctcaaccgtggcagctcccgctggctcctatgccctgccctaaagggctcttgagcctctgggaatgggaggggccaagagaaggaaaaccctgtctttagcaccctttaaaagaactgtgccccccttctcagtgctgcctttgcatgggcctggcccggctcgcattcgtcagtgactccaaccctcctgcttgctgtacttgggatgaaacgaccccacaggtcaggtggagggtggggcgtgggcatcagccaggattgccgttacagtctttttctcaggagctacaaagatctcttcctgttactaaatggtcgcaccccagcagcctctctcgcacaccggggccctgcatgtcagatggcgtggtctgcagggggagctctgtgccttagtggctcttggcaggacactgagggcctgcctgtggtgtgcccggctctgccactcccgggaggggaagggctgctcagctcaaggtgtcctgttcggtagagcaagtgtcctctgacagccgtgtccccggacagttcagacacccttggggatggcactccacacacgacagagatgcaggggccagggaagcccagcgctcggtgcccttcgtccagggttaaaatcggcctgtggggtgtggtgagaaggcaggttgtgcgggtgttgaccgatgtatcttttccttaaagttattataataatgggtaatttgtcaataaagcattcctttgggggaaaaaaaannanaaaaaaaaaaaaaaaaaaaaaaaaaaaaaaagtcaagaagaaaaagaaaggggcggggcggcgcgggcaacgaagaattaccctccgggggagggcccgccacataattatggcgccccccagtgtttggttgggtagcacagcggggcgcccatattaaggcggcgcggtattatatgaagagcgagacagagcggggggggcgcgctcagtttaaaaaccaacggggacggttggtgcgggggaaacaaattgggctatccgcggggagttcttgtgggggaagggagagacccccactcctgcgggggggggggagactattgggggccaaacatcactccagagagatattagaacacctgcaggggggaaacattcaacattggaggcttgttgagggtgtcacacccacatctattggctggggcgcgagaaaattttgctcagaagattatttgaaactttag

SEQ ID NO: 313832 - DNA, 2610 bp, Homo sapiens
cgggcggaagtagccgtcgcatcgcggatcgcgaaacgccgcggagctgaggcagttccgctggctagtgtgtacgcggcgagcttctcccggcgccgcccgctcggctcccatagcgcccgcgacagcggtccggacgccgcccgaacatggactccgccggccaagatatcaacctgaattctcctaacaaaggtctgctgtctgactccatgacggatgttcctgtcgacacaggtgtggctgcccggactcctgctgttgagggtctgacagaggctgaggaggaggagctcagggctgagcttaccaaggtggaagaggaaattgtcactctgcgccaggtcctggcagccaaggagaggcactgtggagagctcaagaggaggctgggcctctccaccctgggggagctgaaacagaacctgtccaggagctggcatgacgtgcaggtctctagcgcctatgtgaaaacttctgagaaacttggagagtggaatgagaaagtgacccagtcagacctctacaagaagactcaggaaactctttcacaggcaggacagaagacttcagctgccctgtccacagtgggctctgccatcagcaggaagcttggagacatgaggaactctgcgaccttcaagtcgtttgaggaccgagttgggaccataaagtctaaggttgtgggtgacagagagaacggcagtgacaacctcccttcctcagcggggagtggtgacaagcccctgtcggatcccgcacctttctaagcctgtggttgcttcacccgctgcagagcacacgcaacccagcctcagcatcacagccgcagctctgttcagcggagcagccagccagggcggatgagcagagccggccctgaggacagtcctgcccatccacgcggagatgtggctgccgcgtttgcatgaatttgaagaacacaggcttgtacacagatgttttacactcacgtttgtagatgaaacagatcactgtgctgtccttcctaggggtgcaggaagtggacagggcggagggtttgaaagaatattgagccaaagcccaggctccctttgggaatcatgttagcccatcagaatgttgaaggattgaagagttctaagcataaaataagtggcattttctgacttcttcctcctcctccttccctgactcacagaaggaatgcaatcacccagcaagtcctacctgttacgcaattttttatctcaaaatgccgaacgagaaaactgtccattttctgagacccccagaaaggaaactgaccctcagcagctgcctgattgttacgcgaatctagctttaacggaagcaaattcattattttttaaatgcagtggacttttcaaaaagtttaaattaggcaaagcagctttagcctcatagaatattatttctttggactcaagctgaaatacaagccttacattgccttatgctttatttctttctaatttttatatgtatatagatgagggttccttaatggttgtgagcattgtgtggaattttacacctggcctgcgtggcagcctcttccagttgaggtgttttatgtcacgcacactccatcccagtgtacaaaacctgcttctcttctcaaccgtggcagctcccgctggctcctatgccctgccctaaagggctcttgagcctctgggaatgggaggggccaagagaaggaaaaccctgtctttagcaccctttaaaagaactgtgccccccttctcagtgctgcctttgcatgggcctggcccggctcgcattcgtcagtgactccaaccctcctgcttgctgtacttgggatgaaacgaccccacaggtcaggtggagggtggggcgtgggcatcagccaggattgccgttacagtctttttctcaggagctacaaagatctcttcctgttactaaatggtcgcaccccagcagcctctctcgcacaccggggccctgcatgtcagatggcgtggtctgcagggggagctctgtgccttagtggctcttggcaggacactgagggcctgcctgtggtgtgcccggctctgccactcccgggaggggaagggctgctcagctcaaggtgtcctgttcggtagagcaagtgtcctctgacagccgtgtccccggacagttcagacacccttggggatggcactccacacacgacagagatgcaggggccagggaagcccagcgctcggtgcccttcgtccagggttaaaatcggcctgtggggtgtggtgagaaggcaggttgtgcgggtgttgaccgatgtatcttttccttaaagttattataataatgggtaatttgtcaataaagcattcctttgggggaaaaaaaaaacaagaaacaaaaaaagaggagaccacaaaaaaaataccagaagagccaactagagaacacaagacaagagcgaaagaggacccctaacgaagaccgaaaaaagccaacaagcacgaaaataaaagcacaaggaaaagcgacaggaactcgaagaccaaaacgagggagaaaaggaaacacaaaagagagccaggaaaacaacgcaagggacaagaacaggacgacacacaagaaaaacgg

SEQ ID NO: 313833 - DNA, 2535 bp, Homo sapiens
gagccccctctcgatacttgcaggcaatgaatccgtttttctatagagcccttccatgtttaacgcaaggaaagctcctaggggtgtccctgtaggggatagcagagaggggccgacagccccccaactgcacagacttttcataacctcaatacgagagcccggggtatccctgtaggggacagcagagaggggccgacagccccccaactgcgcagacttttcataacctcagtacgagagcccaggtgtccctgtaggggatagcagagaggggccgacagccccccaactgcacagacttttcataacctcagtacgagagcccggggtatccctgtaggggacagcagagaggggccgacagccccccaactgcgcagacttttcataacctcagtacgagagcccggggtgtccctgtaggggacagcagagaggggccgacagccccccaactgcacagacttttcataacctcagtacgagagcccgggatgtccctgtagggtatgacagagaggggccgacatctccccagctgcacagtcaaggggtttccagttgccttgtgtgacgtctggacctgtaccctgtggttgttgggcatggccgacctcacttttgacctggggagtctccggaatgacctggctgtctcacagttttgccatgagatcttgggatgttgttagggaccctttggaggctggccctaaccctgaggcccttccgagttaggagagcagcacaaccctctcctcttgacaccgacactcttccctctctctttaaaggaactctgcgaccttcaagtcgtttgaggaccgagttgggaccataaagtctaaggttgtgggtgacagagagaacggcagtgacaacctcccttcctcagcggggagtggtgacaagcccctgtcggatcccgcacctttctaagcctgtggttgcttcacccgctgcagagcacacgcaacccagcctcagcatcacagccgcagctctgttcagcggagcagccagccagggcggatgagcagagccggccctgaggacagtcctgcccatccacgcggagatgtggctgccgcgtttgcatgaatttgaagaacacaggcttgtacacagatgttttacactcacgtttgtagatgaaacagatcactgtgctgtccttcctaggggtgcaggaagtggacagggcggagggtttgaaagaatattgagccaaagcccaggctccctttgggaatcatgttagcccatcagaatgttgaaggattgaagagttctaagcataaaataagtggcattttctgacttcttcctcctcctccttccctgactcacagaaggaatgcaatcacccagcaagtcctacctgttacgcaattttttatctcaaaatgccgaacgagaaaactgtccattttctgagacccccagaaaggaaactgaccctcagcagctgcctgattgttacgcgaatctagctttaacggaagcaaattcattattttttaaatgcagtggacttttcaaaaagtttaaattaggcaaagcagctttagcctcatagaatattatttctttggactcaagctgaaatacaagccttacattgccttatgctttatttctttctaatttttatatgtatatagatgagggttccttaatggttgtgagcattgtgtggaattttacacctggcctgcgtggcagcctcttccagttgaggtgttttatgtcacgcacactccatcccagtgtacaaaacctgcttctcttctcaaccgtggcagctcccgctggctcctatgccctgccctaaagggctcttgagcctctgggaatgggaggggccaagagaaggaaaaccctgtctttagcaccctttaaaagaactgtgccccccttctcagtgctgcctttgcatgggcctggcccggctcgcattcgtcagtgactccaaccctcctgcttgctgtacttgggatgaaacgaccccacaggtcaggtggagggtggggcgtgggcatcagccaggattgccgttacagtctttttctcaggagctacaaagatctcttcctgttactaaatggtcgcaccccagcagcctctctcgcacaccggggccctgcatgtcagatggcgtggtctgcagggggagctctgtgccttagtggctcttggcaggacactgagggcctgcctgtggtgtgcccggctctgccactcccgggaggggaagggctgctcagctcaaggtgtcctgttcggtagagcaagtgtcctctgacagccgtgtccccggacagttcagacacccttggggatggcactccacacacgacagagatgcaggggccagggaagcccagcgctcggtgcccttcgtccagggttaaaatcggcctgtggggtgtggtgagaaggcaggttgtgcgggtgttgaccgatgtatcttttccttaaagttattataataatgggtaatttgtcaataaagcattcctttgggggaaa

SEQ ID NO: 313834 - DNA, 2264 bp, Homo sapiens
cgggcggaagtagccgtcgcatcgcggatcgcgaaacgccgcggagctgaggcagttccgctggctagtgtgtacgcggcgagcttctcccggcgccgcccgctcggctcccatagcgcccgcgacagcggtccggacgccgcccgaacatggactccgccggccaagatatcaacctgaattctcctaacaaaggtctgctgtctgactccatgacggatgttcctgtcgacacaggtgtggctgcccggactcctgctgttgagggtctgacagaggctgaggaggaggagctcagggctgagcttaccaaggtggaagaggaaattgtcactctgcgccaggtcctggcagccaaggagaggcactgtggagagctcaagaggaggctgggcctctccaccctgggggagctgaaacagaacctgtccaggagctggcatgacgtgcaggtctctagcgcctatgtgaaaacttctgagaaacttggagagtggaatgagaaagtgacccagtcagacctctacaagaagactcaggaaactctttcacaggcaggacagaagacttcagctgccctgtccacagtgggctctgccatcagcaggaagcttggagacatgaggaactctgcgaccttcaagtcgtttgaggaccgagttgggaccataaagtctaaggttgtgggtgacagagagaacggcagtgacaacctcccttcctcagcggggagtggtgacaagcccctgtcggatcccgcacctttctaagcctgtggttgcttcacccgctgcagagcacacgcaacccagcctcagcatcacagccgcagctctgttcagcggagcagccagccagggcggatgagcagagccggccctgaggacagtcctgcccatccacgcggagatgtggctgccgcgtttgcatgaatttgaagaacacaggcttgtacacagatgttttacactcacgtttgtagatgaaacagatcactgtgctgtccttcctaggggtgcaggaagtggacagggcggagggtttgaaagaatattgagccaaagcccaggctccctttgggaatcatgttagcccatcagaatgttgaaggattgaagagttctaagcataaaataagtggcattttctgacttcttcctcctcctccttccctgactcacagaaggaatgcaatcacccagcaagtcctacctgttacgcaattttttatctcaaaatgccgaacgagaaaactgtccattttctgagacccccagaaaggaaactgaccctcagcagctgcctgattgttacgcgaatctagctttaacggaagcaaattcattattttttaaatgcagtggacttttcaaaaagtttaaattaggcaaagcagctttagcctcatagaatattatttctttggactcaagctgaaatacaagccttacattgccttatgctttatttctttctaatttttatatgtatatagatgagggttccttaatggttgtgagcattgtgtggaattttacacctggcctgcgtggcagcctcttccagttgaggtgttttatgtcacgcacactccatcccagtgtacaaaacctgcttctcttctcaaccgtggcagctcccgctggctcctatgccctgccctaaagggctcttgagcctctgggaatgggaggggccaagagaaggaaaaccctgtctttagcaccctttaaaagaactgtgccccccttctcagtgctgcctttgcatgggcctggcccggctcgcattcgtcagtgactccaaccctcctgcttgctgtacttgggatgaaacgaccccacaggtcaggtggagggtggggcgtgggcatcagccaggattgccgttacagtctttttctcaggactctgtgccttagtggctcttggcaggacactgagggcctgcctgtggtgtgcccggctctgccactcccgggaggggaagggctgctcagctcaaggtgtcctgttcggtagagcaagtgtcctctgacagccgtgtccccggacagttcagacacccttggggatggcactccacacacgacagagatgcaggggccagggaagcccagcgctcggtgcccttcgtccagggttaaaatcggcctgtggggtgtggtgagaaggcaggttgtgcgggtgttgaccgatgtatcttttccttaaagttattataataatgggtaatttgtcaataaagcattcctttgggggaaa

SEQ ID NO: 313835 - DNA, 1635 bp, Homo sapiens
cgggcggaagtagccgtcgcatcgcggatcgcgaaacgccgcggagctgaggcagttccgctggctagtgtgtacgcggcgagcttctcccggcgccgcccgctcggctcccatagcgcccgcgacagcggtccggacgccgcccgaacatggactccgccggccaagatatcaacctgaattctcctaacaaaggtctgctgtctgactccatgacggatgttcctgtcgacacaggtgtggctgcccggactcctgctgttgagggtctgacagaggctgaggaggaggagctcagggctgagcttaccaaggtggaagaggaaattgtcactctgcgccaggtcctggcagccaaggagaggcactgtggagagctcaagaggaggctgggcctctccaccctgggggagctgaaacagaacctgtccaggagctggcatgacgtgcaggtctctagcgcctatgtgaaaacttctgagaaacttggagagtggaatgagaaagtgacccagtcagacctctacaagaagactcaggaaactctttcacaggcaggacagaagacttcagctgccctgtccacagtgggctctgccatcagcaggaagcttggagacatgaggaactctgcgaccttcaagtcgtttgaggaccgagttgggaccataaagtctaaggttgtgggtgacagagagaacggcagtgacaacctcccttcctcagcggggagtggtgacaagcccctgtcggatcccgcacctttctaagcctgtggttgcttcacccgctgcagagcacacgcaacccagcctcagcatcacagccgcagctctgttcagcggagcagccagccagggcggatgagcagagccggccctgaggacagtcctgcccatccacgcggagatgtggctgccgcgtttgcatgaatttgaagaacacaggcttgtacacagatgttttacactcacgtttgtagatgaaacagatcactgtgctgtccttcctaggggtgcaggaagtggacagggcggagggtttgaaagaatattgagccaaagcccaggctccctttgggaatcatgttagcccatcagaatgttgaaggattgaagagttctaagcataaaataagtggcattttctgacttcttcctcctcctccttccctgactcacagaaggaatgcaatcacccagcaagtcctacctgttacgcaattttttatctcaaaatgccgaacgagaaaactgtccattttctgagacccccagaaaggaaactgaccctcagcagctgcctgattgttacgcgaatctagctttaacggaagcaaattcattattttttaaatgcagtggacttttcaaaaagtttaaattaggcaaagcagctttagcctcatagaatattatttctttggactcaagctgaaatacaagccttacattgccttatgctttatttctttctaatttttatatgtatatagatgagggttcttgggcagacgataccgctgtccattttctgagtacccccagaaaggaaaaatgagcctcaagcaagctgcctgattgtttacgcgaaattctaagcttttaaaccggaaagccaaaatttgccatttta

SEQ ID NO: 313836 - DNA, 815 bp, Homo sapiens
ttcgtgccgattcggcacgagaagagaaggaaaaccctgtctttagcaccctttaaaagaactgtgccccccttctcaaccgtggcagctcccgctggctcctatgccctgccctaaagggctcttgagcctctgggaatgggaggggccaagagaaggaaaaccctgtctttagcaccctttaaaagaactgtgccccccttctcagtgctgcctttgcatgggcctggcccggctcgcattcgtcagtgactccaaccctcctgcttgctgtacttgggatgaaacgaccccacaggtcaggtggagggtggggcgtgggcatcagccaggattgccgttacagtctttttctcaggagctacaaagatctcttcctgttactaaatggtcgcaccccagcagcctctctcgcacaccggggccctgcatgtcagatggcgtggtctgcagggggagctctgtgccttagtggctcttggcaggacactgagggcctgcctgtggtgtgcccggctctgccactcccgggaggggaagggctgctcagctcaaggtgtcctgttcggtagagcaagtgtcctctgacagccgtgtccccggacagttcagacacccttggggatggcactccacacacgacagagatgcaggggccagggaagcccagcgctcggtgcccttcgtccagggttaaaatcggcctgtggggtgtggtgagaaggcaggttgtgcgggtgttgaccgatgtatcttttccttaaagttattataataatgggtaatttgtcaataaagcattcctttgggggaaa

SEQ ID NO: 313837 - DNA, 711 bp, Homo sapiens
cgggcggaagtagccgtcgcatcgcggatcgcgaaacgccgcggagctgaggcagttccgctggctagtgtgtacgcggcgagcttctcccggcgccgcccgctcggctcccatagcgcccgcgacagcggtccggacgccgcccgaacatggactccgccggccaagatatcaacctgaattctcctaacaaaggtctgctgtctgactccatgacggatgttcctgtcgacacaggtgtggctgcccggactcctgctgttgagggtctgacagaggctgaggaggaggagctcagggctgagcttaccaaggtggaagaggaaattgtcactctgcgccaggtcctggcagccaaggagaggcactgtggagagctcaagaggaggctgggcctctccaccctgggggagctgaaacagaacctgtccaggagctggcatgacgtgcaggtctctagcgcctatgtgaaaacttctgagaaacttggagagtggaatgagaaagtgacccagtcagacctctacaagaagactcaggaaactctttcacaggcaggacagaagacttcagctgccctgtccacagtgggctctgccatcagcaggaagcttggagacatgaggaactctgcgaccttcaagtcgtttgaggaccgagttgggaccataaaggtaattgtacctggactgtttgatggtcttggcaagg

SEQ ID NO: 313838 - DNA, 315 bp, Homo sapiens
agctggtccctctctgtcttccctggaacttcacctgcagtttgatgcctgagttaaaattgttcttctaaataattcactgtagactttctgtttttagctatgtgaaaacttctgagaaacttggagagtggaatgagaaagtgacccagtcagacctgtgagtgcctgtatcatcagcacctcctccttcctcctctccgcctcctgacactcagtcggggaagggggctgtgcacacttggcacaaagcttgttttggtatttgctggctattttttcttcctataacttttcttctctcaggtaaactat

SEQ ID NO: 313839 - DNA, 2363 bp, Homo sapiens
cgggcggaagtagccgtcgcatcgcggatcgcgaaacgccgcggagctgaggcagttccgctggctagtgtgtacgcggcgagcttctcccggcgccgcccgctcggctcccatagcgcccgcgacagcggtccggacgccgcccgaacatggactccgccggccaagatatcaacctgaattctcctaacaaaggtctgctgtctgactccatgacggatgttcctgtcgacacaggtgtggctgcccggactcctgctgttgagggtctgacagaggctgaggaggaggagctcagggctgagcttaccaaggtggaagaggaaattgtcactctgcgccaggtcctggcagccaaggagaggcactgtggagagctcaagaggaggctgggcctctccaccctgggggagctgaaacagaacctgtccaggagctggcatgacgtgcaggtctctagcgcctatgtgaaaacttctgagaaacttggagagtggaatgagaaagtgacccagtcagacctctacaagaagactcaggaaactctttcacaggcaggacagaagacttcagctgccctgtccacagtgggctctgccatcagcaggaagcttggagacatgaggaactctgcgaccttcaagtcgtttgaggaccgagttgggaccataaagtctaaggttgtgggtgacagagagaacggcagtgacaacctcccttcctcagcggggagtggtgacaagcccctgtcggatcccgcacctttctaagcctgtggttgcttcacccgctgcagagcacacgcaacccagcctcagcatcacagccgcagctctgttcagcggagcagccagccagggcggatgagcagagccggccctgaggacagtcctgcccatccacgcggagatgtggctgccgcgtttgcatgaatttgaagaacacaggcttgtacacagatgttttacactcacgtttgtagatgaaacagatcactgtgctgtccttcctaggggtgcaggaagtggacagggcggagggtttgaaagaatattgagccaaagcccaggctccctttgggaatcatgttagcccatcagaatgttgaaggattgaagagttctaagcataaaataagtggcattttctgacttcttcctcctcctccttccctgactcacagaaggaatgcaatcacccagcaagtcctacctgttacgcaattttttatctcaaaatgccgaacgagaaaactgtccattttctgagacccccagaaaggaaactgaccctcagcagctgcctgattgttacgcgaatctagctttaacggaagcaaattcattattttttaaatgcagtggacttttcaaaaagtttaaattaggcaaagcagctttagcctcatagaatattatttctttggactcaagctgaaatacaagccttacattgccttatgctttatttctttctaatttttatatgtatatagatgagggttccttaatggttgtgagcattgtgtggaattttacacctggcctgcgtggcagcctcttccagttgaggtgttttatgtcacgcacactccatcccagtgtacaaaacctgcttctcttctcaaccgtggcagctcccgctggctcctatgccctgccctaaagggctcttgagcctctgggaatgggaggggccaagagaaggaaaaccctgtctttagcaccctttaaaagaactgtgccccccttctcagtgctgcctttgcatgggcctggcccggctcgcattcgtcagtgactccaaccctcctgcttgctgtacttgggatgaaacgaccccacaggtcaggtggagggtggggcgtgggcatcagccaggattgccgttacagtctttttctcaggagctacaaagatctcttcctgttactaaatggtcgcaccccagcagcctctctcgcacaccggggccctgcatgtcagatggcgtggtctgcagggggagctctgtgccttagtggctcttggcaggacactgagggcctgcctgtggtgtgcccggctctgccactcccgggaggggaagggctgctcagctcaaggtgtcctgttcggtagagcaagtgtcctctgacagccgtgtccccggacagttcagacacccttggggatggcactccacacacgacagagatgcaggggccagggaagcccagcgctcggtgcccttcgtccagggttaaaatcggcctgtggggtgtggtgagaaggcaggttgtgcgggtgttgaccgatgtatcttttccttaaagttattataataatgggtaatttgtcaataaagcattcctttgggggaaa

SEQ ID NO: 313840 - DNA, 2303 bp, Homo sapiens
cgggcggaagtagccgtcgcatcgcggatcgcgaaacgccgcggagctgaggcagttccgctggctagtgtgtacgcggcgagcttctcccggcgccgcccgctcggctcccatagcgcccgcgacagcggtccggacgccgcccgaacatggactccgccggccaagatatcaacctgaattctcctaacaaaggtctgctgtctgactccatgacggatgttcctgtcgacacaggtgtggctgcccggactcctgctgttgagggtctgacagaggctgaggaggaggagctcagggctgagcttaccaaggtggaagaggaaattgtcactctgcgccaggtcctggcagccaaggagaggcactgtggagagctcaagaggaggctgggcctctccaccctgggggagctgaaacagaacctgtccaggagctggcatgacgtgcaggtctctagcgcctacaagaagactcaggaaactctttcacaggcaggacagaagacttcagctgccctgtccacagtgggctctgccatcagcaggaagcttggagacatgaggaactctgcgaccttcaagtcgtttgaggaccgagttgggaccataaagtctaaggttgtgggtgacagagagaacggcagtgacaacctcccttcctcagcggggagtggtgacaagcccctgtcggatcccgcacctttctaagcctgtggttgcttcacccgctgcagagcacacgcaacccagcctcagcatcacagccgcagctctgttcagcggagcagccagccagggcggatgagcagagccggccctgaggacagtcctgcccatccacgcggagatgtggctgccgcgtttgcatgaatttgaagaacacaggcttgtacacagatgttttacactcacgtttgtagatgaaacagatcactgtgctgtccttcctaggggtgcaggaagtggacagggcggagggtttgaaagaatattgagccaaagcccaggctccctttgggaatcatgttagcccatcagaatgttgaaggattgaagagttctaagcataaaataagtggcattttctgacttcttcctcctcctccttccctgactcacagaaggaatgcaatcacccagcaagtcctacctgttacgcaattttttatctcaaaatgccgaacgagaaaactgtccattttctgagacccccagaaaggaaactgaccctcagcagctgcctgattgttacgcgaatctagctttaacggaagcaaattcattattttttaaatgcagtggacttttcaaaaagtttaaattaggcaaagcagctttagcctcatagaatattatttctttggactcaagctgaaatacaagccttacattgccttatgctttatttctttctaatttttatatgtatatagatgagggttccttaatggttgtgagcattgtgtggaattttacacctggcctgcgtggcagcctcttccagttgaggtgttttatgtcacgcacactccatcccagtgtacaaaacctgcttctcttctcaaccgtggcagctcccgctggctcctatgccctgccctaaagggctcttgagcctctgggaatgggaggggccaagagaaggaaaaccctgtctttagcaccctttaaaagaactgtgccccccttctcagtgctgcctttgcatgggcctggcccggctcgcattcgtcagtgactccaaccctcctgcttgctgtacttgggatgaaacgaccccacaggtcaggtggagggtggggcgtgggcatcagccaggattgccgttacagtctttttctcaggagctacaaagatctcttcctgttactaaatggtcgcaccccagcagcctctctcgcacaccggggccctgcatgtcagatggcgtggtctgcagggggagctctgtgccttagtggctcttggcaggacactgagggcctgcctgtggtgtgcccggctctgccactcccgggaggggaagggctgctcagctcaaggtgtcctgttcggtagagcaagtgtcctctgacagccgtgtccccggacagttcagacacccttggggatggcactccacacacgacagagatgcaggggccagggaagcccagcgctcggtgcccttcgtccagggttaaaatcggcctgtggggtgtggtgagaaggcaggttgtgcgggtgttgaccgatgtatcttttccttaaagttattataataatgggtaatttgtcaataaagcattcctttgggggaaa

SEQ ID NO: 313841 - DNA, 2606 bp, Homo sapiens
  misc_feature (2381)..(2382): n is a, c, g, or t
  misc_feature (2389)..(2389): n is a, c, g, or t
cgggcggaagtagccgtcgcatcgcggatcgcgaaacgccgcggagctgaggcagttccgctggctagtgtgtacgcggcgagcttctcccggcgccgcccgctcggctcccatagcgcccgcgacagcggtccggacgccgcccgaacatggactccgccggccaagatatcaacctgaattctcctaacaaaggtctgctgtctgactccatgacggatgttcctgtcgacacaggtgtggctgcccggactcctgctgttgagggtctgacagaggctgaggaggaggagctcagggctgagcttaccaaggtggaagaggaaattgtcactctgcgccaggtcctggcagccaaggagaggcactgtggagagctcaagaggaggctgggcctctccaccctgggggagctgaaacagaacctgtccaggagctggcatgacgtgcaggtctctagcgcctatgtgaaaacttctgagaaacttggagagtggaatgagaaagtgacccagtcagacctctacaagaagactcaggaaactctttcacaggcaggacagaagacttcagctgccctgtccacagtgggctctgccatcagcaggaagcttggagacatgaggaactctgcgaccttcaagtcgtttgaggaccgagttgggaccataaagtctaaggttgtgggtgacagagagaacggcagtgacaacctcccttcctcagcggggagtggtgacaagcccctgtcggatcccgcacctttctaagcctgtggttgcttcacccgctgcagagcacacgcaacccagcctcagcatcacagccgcagctctgttcagcggagcagccagccagggcggatgagcagagccggccctgaggacagtcctgcccatccacgcggagatgtggctgccgcgtttgcatgaatttgaagaacacaggcttgtacacagatgttttacactcacgtttgtagatgaaacagatcactgtgctgtccttcctaggggtgcaggaagtggacagggcggagggtttgaaagaatattgagccaaagcccaggctccctttgggaatcatgttagcccatcagaatgttgaaggattgaagagttctaagcataaaataagtggcattttctgacttcttcctcctcctccttccctgactcacagaaggaatgcaatcacccagcaagtcctacctgttacgcaattttttatctcaaaatgccgaacgagaaaactgtccattttctgagacccccagaaaggaaactgaccctcagcagctgcctgattgttacgcgaatctagctttaacggaagcaaattcattattttttaaatgcagtggacttttcaaaaagtttaaattaggcaaagcagctttagcctcatagaatattatttctttggactcaagctgaaatacaagccttacattgccttatgctttatttctttctaatttttatatgtatatagatgagggttccttaatggttgtgagcattgtgtggaattttacacctggcctgcgtggcagcctcttccagttgaggtgttttatgtcacgcacactccatcccagtgtacaaaacctgcttctcttctcaaccgtggcagctcccgctggctcctatgccctgccctaaagggctcttgagcctctgggaatgggaggggccaagagaaggaaaaccctgtctttagcaccctttaaaagaactgtgccccccttctcagtgctgcctttgcatgggcctggcccggctcgcattcgtcagtgactccaaccctcctgcttgctgtacttgggatgaaacgaccccacaggtcaggtggagggtggggcgtgggcatcagccaggattgccgttacagtctttttctcaggagctacaaagatctcttcctgttactaaatggtcgcaccccagcagcctctctcgcacaccggggccctgcatgtcagatggcgtggtctgcagggggagctctgtgccttagtggctcttggcaggacactgagggcctgcctgtggtgtgcccggctctgccactcccgggaggggaagggctgctcagctcaaggtgtcctgttcggtagagcaagtgtcctctgacagccgtgtccccggacagttcagacacccttggggatggcactccacacacgacagagatgcaggggccagggaagcccagcgctcggtgcccttcgtccagggttaaaatcggcctgtggggtgtggtgagaaggcaggttgtgcgggtgttgaccgatgtatcttttccttaaagttattataataatgggtaatttgtcaataaagcattcctttgggggaaacaacaaaacaacacaaanncaacaanaaaaacaaaaaacgcgcgcctttgcgggggcgaacaacgtactaacgccaggccatagtgtccagcccctttttaacgggaaccgcgcccatgggaggaaacgaaccggcgttcagagcaacgaacgagagaaacagaaagagaccactaaaaggaaaacacaaccacacaaaatgaaaaaagcgaaccccccacgcaaaaaacacacgtatgcccc

SEQ ID NO: 313842 - DNA, 2811 bp, Homo sapiens
cgggcggaagtagccgtcgcatcgcggatcgcgaaacgccgcggagctgaggcagttccgctggctagtgtgtacgcggcgagcttctcccggcgccgcccgctcggctcccatagcgcccgcgacagcggtccggacgccgcccgaacatggactccgccggccaagatatcaacctgaattctcctaacaaaggtctgctgtctgactccatgacggatgttcctgtcgacacaggtgtggctgcccggactcctgctgttgagggtctgacagaggctgaggaggaggagctcagggctgagcttaccaaggtggaagaggaaattgtcactctgcgccaggtcctggcagccaaggagaggcactgtggagagctcaagaggaggctgggcctctccaccctgggggagctgaaacagaacctgtccaggagctggcatgacgtgcaggtctctagcgcctatgtgaaaacttctgagaaacttggagagtggaatgagaaagtgacccagtcagacctctacaagaagactcaggaaactctttcacaggcaggacagaagacttcagctgccctgtccacagtgggctctgccatcagcaggaagcttggagacatgaggaactctgcgaccttcaagtcgtttgaggaccgagttgggaccataaagtctaaggttgtgggtgacagagagaacggcagtgacaacctcccttcctcagcggggagtggtgacaagcccctgtcggatcccgcacctttctaagcctgtggttgcttcacccgctgcagagcacacgcaacccagcctcagcatcacagccgcagctctgttcagcggagcagccagccagggcggatgagcagagccggccctgaggacagtcctgcccatccacgcggagatgtggctgccgcgtttgcatgaatttgaagaacacaggcttgtacacagatgttttacactcacgtttgtagatgaaacagatcactgtgctgtccttcctaggggtgcaggaagtggacagggcggagggtttgaaagaatattgagccaaagcccaggctccctttgggaatcatgttagcccatcagaatgttgaaggattgaagagttctaagcataaaataagtggcattttctgacttcttcctcctcctccttccctgactcacagaaggaatgcaatcacccagcaagtcctacctgttacgcaattttttatctcaaaatgccgaacgagaaaactgtccattttctgagacccccagaaaggaaactgaccctcagcagctgcctgattgttacgcgaatctagctttaacggaagcaaattcattattttttaaatgcagtggacttttcaaaaagtttaaattaggcaaagcagctttagcctcatagaatattatttctttggactcaagctgaaatacaagccttacattgccttatgctttatttctttctaatttttatatgtatatagatgagggttccttaatggttgtgagcattgtgtggaattttacacctggcctgcgtggcagcctcttccagttgaggtgttttatgtcacgcacactccatcccagtgtacaaaacctgcttctcttctcaaccgtggcagctcccgctggctcctatgccctgccctaaagggctcttgagcctctgggaatgggaggggccaagagaaggaaaaccctgtctttagcaccctttaaaagaactgtgccccccttctcagtgctgcctttgcatgggcctggcccggctcgcattcgtcagtgactccaaccctcctgcttgctgtacttgggatgaaacgaccccacaggtcaggtggagggtggggcgtgggcatcagccaggattgccgttacagtctttttctcaggagctacaaagatctcttcctgttactaaatggtcgcaccccagcagcctctctcgcacaccggggccctgcatgtcagatggcgtggtctgcagggggagctctgtgccttagtggctcttggcaggacactgagggcctgcctgtggtgtgcccggctctgccactcccgggaggggaagggctgctcagctcaaggtgtcctgttcggtagagcaagtgtcctctgacagccgtgtccccggacagttcagacacccttggggatggcactccacacacgacagagatgcaggggccagggaagcccagcgctcggtgcccttcgtccagggttaaaatcggcctgtggggtgtggtgagaaggcaggttgtgcgggtgttgaccgatgtatcttttccttaaagttattataataatgggtaatttgtcaataaagcattcctttgggggaaaatacagcagagaaacacgggggcggtcggaattaaattggccaaagttcatgagtgaaagacatggtgttgcacggtccatttgtagcggcaaagggaaatcacacgaagcgatagtaagggccctctgggacagtggtccccccgcgggaaaaggcgcccagtggaacccgggcaaatgtgtggcagaccggaagaaaaccggcacaaccggtgggagaaacaggcgcgccggggtatccaagaacgggggaacaccgggccatccgcgactgatgcgtgacgtgggaacacacacgggggtggagcgaagagcaagcagccacacacaaggacgcggcacgcgagtaagcataagccgacgcaggcggcaccaccgagcaacattgcgtgagtgctgcgacagcgacagaaggaacaaccgcccgaatggtgagaggacgatcgcc

SEQ ID NO: 313843 - DNA, 2465 bp, Homo sapiens
cgggcggaagtagccgtcgcatcgcggatcgcgaaacgccgcggagctgaggcagttccgctggctagtgtgtacgcggcgagcttctcccggcgccgcccgctcggctcccatagcgcccgcgacagcggtccggacgccgcccgaacatggactccgccggccaagatatcaacctgaattctcctaacaaaggtctgctgtctgactccatgacggatgttcctgtcgacacaggtgtggctgcccggactcctgctgttgagggtctgacagaggctgaggaggaggagctcagggctgagcttaccaaggtggaagaggaaattgtcactctgcgccaggtcctggcagccaaggagaggcactgtggagagctcaagaggaggctgggcctctccaccctgggggagctgaaacagaacctgtccaggagctggcatgacgtgcaggtctctagcgcctatgtgaaaacttctgagaaacttggagagtggaatgagaaagtgacccagtcagacctctacaagaagactcaggaaactctttcacaggcaggacagaagacttcagctgccctgtccacagtgggctctgccatcagcaggaagcttggagacatgaggaactctgcgaccttcaagtcgtttgaggaccgagttgggaccataaagtctaaggttgtgggtgacagagagaacggcagtgacaacctcccttcctcagcggggagtggtgacaagcccctgtcggatcccgcacctttctaagcctgtggttgcttcacccgctgcagagcacacgcaacccagcctcagcatcacagccgcagctctgttcagcggagcagccagccagggcggatgagcagagccggccctgaggacagtcctgcccatccacgcggagatgtggctgccgcgtttgcatgaatttgaagaacacaggcttgtacacagatgttttacactcacgtttgtagatgaaacagatcactgtgctgtccttcctaggggtgcaggaagtggacagggcggagggtttgaaagaatattgagccaaagcccaggctccctttgggaatcatgttagcccatcagaatgttgaaggattgaagagttctaagcataaaataagtggcattttctgacttcttcctcctcctccttccctgactcacagaaggaatgcaatcacccagcaagtcctacctgttacgcaattttttatctcaaaatgccgaacgagaaaactgtccattttctgagacccccagaaaggaaactgaccctcagcagctgcctgattgttacgcgaatctagctttaacggaagcaaattcattattttttaaatgcagtggacttttcaaaaagtttaaattaggcaaagcagctttagcctcatagaatattatttctttggactcaagctgaaatacaagccttacattgccttatgctttatttctttctaatttttatatgtatatagatgagggttccttaatggttgtgagcattgtgtggaattttacacctggcctgcgtggcagcctcttccagttgaggtgttttatgtcacgcacactccatcccagtgtacaaaacctgcttctcttctcaaccgtggcagctcccgctggctcctatgccctgccctaaagggctcttgagcctctgggaatgggaggggccaagagaaggaaaaccctgtctttagcaccctttaaaagaactgtgccccccttctcagtgctgcctttgcatgggcctggcccggctcgcattcgtcagtgactccaaccctcctgcttgctgtacttgggatgaaacgaccccacaggtcaggtggagggtggggcgtgggcatcagccaggattgccgttacagtctttttctcaggagctacaaagatctcttcctgttactaaatggtcgcaccccagcagcctctctcgcacaccggggccctgcatgtcagatggcgtggtctgcagggggagctctgtgccttagtggctcttggcaggacactgagggcctgcctgtggtgtgcccggctctgccactcccgggaggggaagggctgctcagctcaaggtgtcctgttcggtagagcaagtgtcctctgacagccgtgtccccggacagttcagacacccttggggatggcactccacacacgacagagatgcaggggccagggaagcccagcgctcggtgcccttcgtccagggttaaaatcggcctgtggggtgtggtgagaaggcaggttgtgcgggtgttgaccgatgtatcttttccttaaagttattataataatgggtaatttgtcaataaagcattcctttgggggaaacaccaccgccacccacaaaagaggaaacacaagacgaaaaacagacaaacgcttatttacaaacacaaaaaaaagggggggcgcgcggcaggaaattaaaag

SEQ ID NO: 313844 - DNA, 2089 bp, Homo sapiens
tactactactaaattcgcggccgcgtcgaccaaaagcccaagcctggtctcctcacagcttcctatggcagtgctctccccgctcccagtgctatgcgctgggcaacttggggtgccccccgtgaggccaagggaggaccctggggtcgagtttcctttgggggcattgtgtggaggggcaggcagctcgctccaactgctgggagtgggggaatcccagctctgcccatccctgccaagttggggttgtgtgtggatcttggtgttaactcttgcttccttctctgcttctgccatgcttccaagcagcagctactccatccgccactcaataagtatgccagccatgaggaactctgcgaccttcaagtcgtttgaggaccgagttgggaccataaagtctaaggttgtgggtgacagagagaacggcagtgacaacctcccttcctcagcggggagtggtgacaagcccctgtcggatcccgcacctttctaagcctgtggttgcttcacccgctgcagagcacacgcaacccagcctcagcatcacagccgcagctctgttcagcggagcagccagccagggcggatgagcagagccggccctgaggacagtcctgcccatccacgcggagatgtggctgccgcgtttgcatgaatttgaagaacacaggcttgtacacagatgttttacactcacgtttgtagatgaaacagatcactgtgctgtccttcctaggggtgcaggaagtggacagggcggagggtttgaaagaatattgagccaaagcccaggctccctttgggaatcatgttagcccatcagaatgttgaaggattgaagagttctaagcataaaataagtggcattttctgacttcttcctcctcctccttccctgactcacagaaggaatgcaatcacccagcaagtcctacctgttacgcaattttttatctcaaaatgccgaacgagaaaactgtccattttctgagacccccagaaaggaaactgaccctcagcagctgcctgattgttacgcgaatctagctttaacggaagcaaattcattattttttaaatgcagtggacttttcaaaaagtttaaattaggcaaagcagctttagcctcatagaatattatttctttggactcaagctgaaatacaagccttacattgccttatgctttatttctttctaatttttatatgtatatagatgagggttccttaatggttgtgagcattgtgtggaattttacacctggcctgcgtggcagcctcttccagttgaggtgttttatgtcacgcacactccatcccagtgtacaaaacctgcttctcttctcaaccgtggcagctcccgctggctcctatgccctgccctaaagggctcttgagcctctgggaatgggaggggccaagagaaggaaaaccctgtctttagcaccctttaaaagaactgtgccccccttctcagtgctgcctttgcatgggcctggcccggctcgcattcgtcagtgactccaaccctcctgcttgctgtacttgggatgaaacgaccccacaggtcaggtggagggtggggcgtgggcatcagccaggattgccgttacagtctttttctcaggagctacaaagatctcttcctgttactaaatggtcgcaccccagcagcctctctcgcacaccggggccctgcatgtcagatggcgtggtctgcagggggagctctgtgccttagtggctcttggcaggacactgagggcctgcctgtggtgtgcccggctctgccactcccgggaggggaagggctgctcagctcaaggtgtcctgttcggtagagcaagtgtcctctgacagccgtgtccccggacagttcagacacccttggggatggcactccacacacgacagagatgcaggggccagggaagcccagcgctcggtgcccttcgtccagggttaaaatcggcctgtggggtgtggtgagaaggcaggttgtgcgggtgttgaccgatgtatcttttccttaaagttattataataatgggtaatttgtcaataaagcattcctttgggggaaa

SEQ ID NO: 313845 - DNA, 2316 bp, Homo sapiens
cgggcggaagtagccgtcgcatcgcggatcgcgaaacgccgcggagctgaggcagttccgctggctagtgtgtacgcggcgagcttctcccggcgccgcccgctcggctcccatagcgcccgcgacagcggtccggacgccgcccgaacatggactccgccggccaagatatcaacctgaattctcctaacaaaggtctgctgtctgactccatgacggatgttcctgtcgacacaggtgtggctgcccggactcctgctgttgagggtctgacagaggctgaggaggaggagctcagggctgagcttaccaaggtggaagaggaaattgtcactctgcgccaggtcctggcagccaaggagaggcactgtggagagctcaagaggaggctgggcctctccaccctgggggagctgaaacagaacctgtccaggagctggcatgacgtgcaggtctctagcgcctatgtgaaaacttctgagaaacttggagagtggaatgagaaagtgacccagtcagacctctacaagaagactcaggaaactctttcacaggcaggacagaagacttcagctgccctgtccacagtgggctctgccatcagcaggaagcttggagacatgaggaactctgcgaccttcaagtcgtttgaggaccgagttgggaccataaagtctaaggttgtgggtgacagagagaacggcagtgacaacctcccttcctcagcggggagtggtgacaagcccctgtcggatcccgcacctttctaagcctgtggttgcttcacccgctgcagagcacacgcaacccagcctcagcatcacagccgcagctctgttcagcggagcagccagccagggcggatgagcagagccggccctgaggacagtcctgcccatccacgcggagatgtggctgccgcgtttgcatgaatttgaagaacacaggcttgtacacagatgttttacactcacgtttgtagatgaaacagatcactgtgctgtccttcctaggggtgcaggaagtggacagggcggagggtttgaaagaatattgagccaaagcccaggctccctttgggaatcatgttagcccatcagaatgttgaaggattgaagagttctaagcataaaataagtggcattttctgacttcttcctcctcctccttccctgactcacagaaggaatgcaatcacccagcaagtcctacctgttacgcaattttttatctcaaaatgccgaacgagaaaactgtccattttctgagacccccagaaaggaaactgaccctcagcagctgcctgattgttacgcgaatctagctttaacggaagcaaattcattattttttaaatgcagtggacttttcaaaaagtttaaattaggcaaagcagctttagcctcatagaatattatttctttggactcaagctgaaatacaagccttacattgccttatgctttatttctttctaatttttatatgtatatagatgagggttccttaatggttgtgagcattgtgtggaattttacacctggcctgcgtggcagcctcttccagttgaggtgttttatgtcacgcacactccatcccagtgtacaaaacctgcttctcttctcaaccgtggcagctcccgctggctcctatgccctgccctaaagggctcttgagcctctgggaatgggaggggccaagagaaggaaaaccctgtctttagcaccctttaaaagaactgtgccccccttctcagtgctgcctttgcatgggcctggcccggctcgcattcgtcagtgactccaaccctcctgcttgctgtacttgggatgaaacgaccccacaggtcaggtggagggtggggcgtgggcatcagccaggattgccgttacagtctttttctcaggagctacaaagatctcttcctgttactaaatggtcgcaccccagcagcctctctcgcacaccggggccctgcatgtcagatggcgtggtctgcagggggagctctgtgccttagtggctcttggcaggacactgagggcctgcctgtggtgtgcccggctctgccactcccgggaggggaagggctgctcagctcaaggtgtcctgttcggtagagcaagtgtcctctgacagccgtgtccccggacagttcagacacccttggggatggcactccacacacgacagagatgcaggggccaggattgccgttacagtctgtttctcaggagctacaaagatctcttcctgttactaaatagtcgcaccccagcagcctctctcgcacaccgggcactgcatgtcagatgg

SEQ ID NO: 313846 - DNA, 1975 bp, Homo sapiens
cgggcggaagtagccgtcgcatcgcggatcgcgaaacgccgcggagctgaggcagttccgctggctagtgtgtacgcggcgagcttctcccggcgccgcccgctcggctcccatagcgcccgcgacagcggtccggacgccgcccgaacatggactccgccggccaagatatcaacctgaattctcctaacaaaggtctgctgtctgactccatgacggatgttcctgtcgacacaggtgtggctgcccggactcctgctgttgagggtctgacagaggctgaggaggaggagctcagggctgagcttaccaaggtggaagaggaaattgtcactctgcgccaggtcctggcagccaaggagaggcactgtggagagctcaagaggaggctgggcctctccaccctgggggagctgaaacagaacctgtccaggagctggcatgacgtgcaggtctctagcgcctatgtgaaaacttctgagaaacttggagagtggaatgagaaagtgacccagtcagacctctacaagaagactcaggaaactctttcacaggcaggacagaagacttcagctgccctgtccacagtgggctctgccatcagcaggaagcttggagacatgaggaactctgcgaccttcaagtcgtttgaggaccgagttgggaccataaagtctaaggttgtgggtgacagagagaacggcagtgacaacctcccttcctcagcggggagtggtgacaagcccctgtcggatcccgcacctttctaagcctgtggttgcttcacccgctgcagagcacacgcaacccagcctcagcatcacagccgcagctctgttcagcggagcagccagccagggcggatgagcagagccggccctgaggacagtcctgcccatccacgcggagatgtggctgccgcgtttgcatgaatttgaagaacacaggcttgtacacagatgttttacactcacgtttgtagatgaaacagatcactgtgctgtccttcctaggggtgcaggaagtggacagggcggagggtttgaaagaatattgagccaaagcccaggctccctttgggaatcatgttagcccatcagaatgttgaaggattgaagagttctaagcataaaataagtggcattttctgacttcttcctcctcctccttccctgactcacagaaggaatgcaatcacccagcaagtcctacctgttacgcaattttttatctcaaaatgccgaacgagaaaactgtccattttctgagacccccagaaaggaaactgaccctcagcagctgcctgattgttacgcgaatctagctttaacggaagcaaattcattattttttaaatgcagtggacttttcaaaaagtttaaattaggcaaagcagctttagcctcatagaatattatttctttggactcaagctgaaatacaagccttacattgccttatgctttatttctttctaatttttatatgtatatagatgagggttccttaatggttgtgagcattgtgtggaattttacacctggcctgcgtggcagcctcttccagttgaggtgttttatgtcacgcacactccatcccagtgtacaaaacctgcttctcttctcaaccgtggcagctcccgctggctcctatgccctgccctaaagggctcttgagcctctgggaatgggaggggccaagagaaggaaaaccctgtctttagcaccctttaaaagaactgtgccccccttctcagtgctgcctttgcatgggcctggcccggctcgcattcgtcagtgactccaaccctcctgcttgctgtacttgggatgaaacgaccccttcgtccagggttaaaatcggcctgtggggtgtggtgagaaggcaggttgtgcgggtgttgaccgatgtatcttttccttaaagttattataataatgggtaatttgtcaataaagcattcctttgggggaaa

SEQ ID NO: 313847 - DNA, 822 bp, Homo sapiens
cgggcggaagtagccgtcgcatcgcggatcgcgaaacgccgcggagctgaggcagttccgctggctagtgtgtacgcggcgagcttctcccggcgccgcccgctcggctcccatagcgcccgcgacagcggtccggacgccgcccgaacatggactccgccggccaagatatcaacctgaattctcctaacaaaggtctgctgtctgactccatgacggatgttcctgtcgacacaggtgtggctgcccggactcctgctgttgagggtctgacagaggctgaggaggaggagctcagggctgagcttaccaaggtggaagaggaaattgtcactctgcgccaggtcctggcagccaaggagaggcactgtggagagctcaagaggaggctgggcctctccaccctgggggagctgaaacagaacctgtccaggagctggcatgacgtgcaggtctctagcgcctatgtgaaaacttctgagaaacttggagagtggaatgagaaagtgacccagtcagacctctacaagaagactcaggaaactctttcacaggcaggacagaagacttcagctgccctgtccacagtgggctctgccatcagcaggaagcttggagacatgagaactcttcgacacatcaagtccattgacaaccgagcaggcaccatgatctattagatgtggatgctcacatgagagcacctatgtgacaacctcccgtgccacagcgaggattggatacaaacactcactcagatccgacatctacaaaaacactcaggtagtcatccacagcagaccacacacaacccagacacag

SEQ ID NO: 313848 - DNA, 4645 bp, Homo sapiens
ttgttggctggtgtgtgggtgtcaaactgagccagacgcggcggtggcggcggctccgcgggctacggtcgctcccgcctctcgagcgctgccggtggccgcagcggcgcacccacgccggcccggaggagcagagtgttcatttctgtgtcgggcacagtgctaagtgctgggtgctcactggtgatgaggcagatgaaggttaccaaacttgtggacaggagcctcatatcagagacgtggacctcactgtagcctggtcatggcttccagcttttcgaatctgaggctccaaaggaggaaatgaccattcagggatcttactccagcttgattacggagactgaaccttcatagggtgcgcacttaccaaggacaggaaggtttctctgtttgaagggctttaaacttataacaaagaaaataaaaatgacgacttcgtctatcagacggcagatgaaaaacatcgtgaacaattactcagaggcagaaatcaaagtccgggaagccacctccaatgacccgtggggcccgtccagttctctgatgaccgagattgccgacctgacctacaacgtggtggccttctcggagatcatgagcatggtgtggaagcggctgaatgaccatggcaagaactggcggcatgtgtacaaggcgctgaccctgctggactacctcatcaagacaggctccgaacgtgtggcccagcagtgccgggagaacatcttcgccatccagaccctgaaggacttccagtacattgaccgagatggcaaggaccagggcatcaatgtgcgtgagaagtcaaagcaactggtggctctcctcaaggacgaggaacggttgaaggctgagagggcccaggctctcaaaaccaaagagcgcatggcccaggttgccactggcatgggcagcaaccagatcacctttgggcgaggctccagccagcccaacctctccaccagccactcggagcaggagtatggcaaggccgggggctccccggcctcctaccatggctccacctccccgcgagtgtcctccgagctggagcaagcccggccccagactagtggagaagaggagcttcagctgcagctggcacttgccatgagcagagaagtggctgagcaggaagaacgcctcaggcggggtgatgacctcagattacagatggccctggaagaaagccgaagggacacagttaaaattccaaaaaagaaagagcatggctctctcccacagcagactacgctgttggatttaatggatgctctccccagctcgggccccgcggcccagaaagcagagccctggggcccgtcagcctccactaaccagaccaacccctggggcgggccagcggctcctgcgagtacttcagacccctggccatcgtttggtaccaagccagctgcctccattgacccatggggggtgcccactggagccaccgcacaatctgtccccaagaactcggacccctgggcagcttcacagcagcctgcctccagtgctgggaaaagagcttctgacgcgtggggcgcagtctccaccaccaagcccgtgtctgtctctgggtcctttgagctcttcagtaatctgaatggtacaattaaagatgacttttctgaatttgacaaccttcggacttcaaaaaaaacagccgaatctgtgacctctctgccatcccaaaacaatggaactaccagccctgacccctttgagtctcaacccctgactgtcgcctcaagcaagcccagcagtgcccggaaaacacctgagtccttcctgggccccaacgcggccctggtgaacctggactcactggtgaccaggcctgccccaccagcccagtccctcaaccctttcctggcaccaggtgctcccgccacctcggcccctgttaaccctttccaggtgaaccagccccagccgctgacactgaaccagcttcgggggagcccagtcctggggaccagcacatcctttgggcctggcccaggagtggagtccatggctgtggcctcgatgacctccgcggccccacagccagctctgggggccactggttcctctctgacaccactgggccctgcaatgatgaacatggtgggcagtgtgggtatacccccatcagcagcccaggccactggcacaaccaaccctttccttctctagtgcctgggcctgggacccacccagagcacctgtgctggaggatgccgagcagggactctcgtctgtgggacgggatccaagagtttggggattaggggtattagggcttttcagctccagcttcctgatgaaagggctgtctttacagccccaaccctcagaccctcgccttccaaggcaggcccctcagcctggcctgctctcaccacctcctccaaagcactgaggtcctggcagggctcctctgaggccttggacgaggacgtggagtcatcagtgttgcccttgcccctaacctcagcccgagggtctccaggatgttgcctggcccaggacttgggacagtggccttgtctttgtcctccccaccccccagccctagggacaccccaggcagtcctgggtgtggacacgatgaagcaccggctccataagacaccttttggggaagtggttgtgcatattttatttttctttgactcgtgtgagttcaaagtaaacaccaccaccgtggacaactcttgaattaaatccactagagcgagctttaaaactaatctgagcataacccccaacgtggctctatgcttgtgtacctttgcacatattttgtttagtacagtttcatatttgagtttgcagaattatctaatagtctttttttggctaatatttttataacgtggttcttatttaactgtctagttttgatagaatttaccaggtctggctgaatgaagatgttggcacgtgtcattttagtggtttaaatcctcttatttatggttttaactctaagaaaattttaaaaggaagagatgtttggatgacaaaaaaatgccttattgaaaaactaaagcaaattctttataggaagaaaatatgggaatttgattacacatagatgatgatgtttatttaaaaaaaaaacaacagcaacaaaaaatcctagcctccagttgccttttcctttctttagctcctgtttttggtgaattactaaactgattgactttcagcctttttggctagatcctgagaggctatttttcttacgaatataccaacatcctgaaagttaaagaaaaaaatctaatgtatgaatgtgactcaccaatttttatcaactaattccttttttttattaaaggcatgcagggattaacaggacttctgtttacaatggaaatctgaaatggaagaaacatctttaaccttgtgtgtctgtgatctcctctgtcttaatccacgctcaggctaaagatggggataatgtggaaatggcagttgtcccgagggcgtggggtggggggtgcttctgtgcccacgggtccctgggcaacagtccctaggctaagacaggggtggggggctaagggaccagggctggccctgatccacctacctgctaactccagatattatttttaagttggagacctaaaaataattctcttgtattttggagatgaagaaaaaagtcattcacctgggagggatttttaacaaacatgcactaatattacctccctcttccaaactcctactgtcctcacctcacccaccactgtaaaagtattacgtcgtgcattaaagaccagaaaagacttgcttttacccagggaggggacattcccccaatcctgtgtctgggcagcttgcctggtggatgtttctggccctttttccaccatgggaatttctcacctctagctctaagggcagctgaccacctgccagcccctctctggttccagaagattacccttcgcaccggcacaggagagatcttaaatggtctctgggctgctgggacatgcaggctctgagtggggactgcacccactcatgctgttcctgaggctgccctctccagtcccaggagccgtgtctagagttcctgaccagccaccttctgccagaactgcaggcctgcggctgggtcttaggctcccgctgccatttgggtaagccggtggctggtctcgtctgccgggggaagggtggggaggtgcaatgggatgggaggcaggatgcttgcccagaaaggtgctttccttcagacggtgcagggcctgggccagccttacaggtcagtagactagactcgactacttggggtcagtgattcttttgtaacgagtctttcatgatgtgactttgaggccccaacatgacagccactgggccaccgggacccaagaagacagccccctgccccatcttctggcacaggccatcccgagtgcatgtccctgttgcccactgcactgatcatgaagccaccggccactgccacgcatgttgcacctgtgccatcgtgctccctcctgatgggcaccgtggtggaggaagtcacccagctgtttctcagtcccagaggccggtggctggttttgaacttgtgttgactgttgatacttatttactgtataaatataatttatcatttgtaccatga

SEQ ID NO: 313849 - DNA, 4774 bp, Homo sapiens
ttgttggctggtgtgtgggtgtcaaactgagccagacgcggcggtggcggcggctccgcgggctacggtcgctcccgcctctcgagcgctgccggtggccgcagcggcgcacccacgccggcccggaggagcaggaggagcagagggtctcactctatcgcccaggctggagtgcagtggcgcaatcttggctcactacaacctccacctctcgggctcaagcagttctcgtgcctcagcctcctgagtaagctgggattacgagtgttcatttctgtgtcgggcacagtgctaagtgctgggtgctcactggtgatgaggcagatgaaggttaccaaacttgtggacaggagcctcatatcagagacgtggacctcactgtagcctggtcatggcttccagcttttcgaatctgaggctccaaaggaggaaatgaccattcagggatcttactccagcttgattacggagactgaaccttcatagggtgcgcacttaccaaggacaggaaggtttctctgtttgaagggctttaaacttataacaaagaaaataaaaatgacgacttcgtctatcagacggcagatgaaaaacatcgtgaacaattactcagaggcagaaatcaaagtccgggaagccacctccaatgacccgtggggcccgtccagttctctgatgaccgagattgccgacctgacctacaacgtggtggccttctcggagatcatgagcatggtgtggaagcggctgaatgaccatggcaagaactggcggcatgtgtacaaggcgctgaccctgctggactacctcatcaagacaggctccgaacgtgtggcccagcagtgccgggagaacatcttcgccatccagaccctgaaggacttccagtacattgaccgagatggcaaggaccagggcatcaatgtgcgtgagaagtcaaagcaactggtggctctcctcaaggacgaggaacggttgaaggctgagagggcccaggctctcaaaaccaaagagcgcatggcccaggttgccactggcatgggcagcaaccagatcacctttgggcgaggctccagccagcccaacctctccaccagccactcggagcaggagtatggcaaggccgggggctccccggcctcctaccatggctccacctccccgcgagtgtcctccgagctggagcaagcccggccccagactagtggagaagaggagcttcagctgcagctggcacttgccatgagcagagaagtggctgagcaggaagaacgcctcaggcggggtgatgacctcagattacagatggccctggaagaaagccgaagggacacagttaaaattccaaaaaagaaagagcatggctctctcccacagcagactacgctgttggatttaatggatgctctccccagctcgggccccgcggcccagaaagcagagccctggggcccgtcagcctccactaaccagaccaacccctggggcgggccagcggctcctgcgagtacttcagacccctggccatcgtttggtaccaagccagctgcctccattgacccatggggggtgcccactggagccaccgcacaatctgtccccaagaactcggacccctgggcagcttcacagcagcctgcctccagtgctgggaaaagagcttctgacgcgtggggcgcagtctccaccaccaagcccgtgtctgtctctgggtcctttgagctcttcagtaatctgaatggtacaattaaagatgacttttctgaatttgacaaccttcggacttcaaaaaaaacagccgaatctgtgacctctctgccatcccaaaacaatggaactaccagccctgacccctttgagtctcaacccctgactgtcgcctcaagcaagcccagcagtgcccggaaaacacctgagtccttcctgggccccaacgcggccctggtgaacctggactcactggtgaccaggcctgccccaccagcccagtccctcaaccctttcctggcaccaggtgctcccgccacctcggcccctgttaaccctttccaggtgaaccagccccagccgctgacactgaaccagcttcgggggagcccagtcctggggaccagcacatcctttgggcctggcccaggagtggagtccatggctgtggcctcgatgacctccgcggccccacagccagctctgggggccactggttcctctctgacaccactgggccctgcaatgatgaacatggtgggcagtgtgggtatacccccatcagcagcccaggccactggcacaaccaaccctttccttctctagtgcctgggcctgggacccacccagagcacctgtgctggaggatgccgagcagggactctcgtctgtgggacgggatccaagagtttggggattaggggtattagggcttttcagctccagcttcctgatgaaagggctgtctttacagccccaaccctcagaccctcgccttccaaggcaggcccctcagcctggcctgctctcaccacctcctccaaagcactgaggtcctggcagggctcctctgaggccttggacgaggacgtggagtcatcagtgttgcccttgcccctaacctcagcccgagggtctccaggatgttgcctggcccaggacttgggacagtggccttgtctttgtcctccccaccccccagccctagggacaccccaggcagtcctgggtgtggacacgatgaagcaccggctccataagacaccttttggggaagtggttgtgcatattttatttttctttgactcgtgtgagttcaaagtaaacaccaccaccgtggacaactcttgaattaaatccactagagcgagctttaaaactaatctgagcataacccccaacgtggctctatgcttgtgtacctttgcacatattttgtttagtacagtttcatatttgagtttgcagaattatctaatagtctttttttggctaatatttttataacgtggttcttatttaactgtctagttttgatagaatttaccaggtctggctgaatgaagatgttggcacgtgtcattttagtggtttaaatcctcttatttatggttttaactctaagaaaattttaaaaggaagagatgtttggatgacaaaaaaatgccttattgaaaaactaaagcaaattctttataggaagaaaatatgggaatttgattacacatagatgatgatgtttatttaaaaaaaaaacaacagcaacaaaaaatcctagcctccagttgccttttcctttctttagctcctgtttttggtgaattactaaactgattgactttcagcctttttggctagatcctgagaggctatttttcttacgaatataccaacatcctgaaagttaaagaaaaaaatctaatgtatgaatgtgactcaccaatttttatcaactaattccttttttttattaaaggcatgcagggattaacaggacttctgtttacaatggaaatctgaaatggaagaaacatctttaaccttgtgtgtctgtgatctcctctgtcttaatccacgctcaggctaaagatggggataatgtggaaatggcagttgtcccgagggcgtggggtggggggtgcttctgtgcccacgggtccctgggcaacagtccctaggctaagacaggggtggggggctaagggaccagggctggccctgatccacctacctgctaactccagatattatttttaagttggagacctaaaaataattctcttgtattttggagatgaagaaaaaagtcattcacctgggagggatttttaacaaacatgcactaatattacctccctcttccaaactcctactgtcctcacctcacccaccactgtaaaagtattacgtcgtgcattaaagaccagaaaagacttgcttttacccagggaggggacattcccccaatcctgtgtctgggcagcttgcctggtggatgtttctggccctttttccaccatgggaatttctcacctctagctctaagggcagctgaccacctgccagcccctctctggttccagaagattacccttcgcaccggcacaggagagatcttaaatggtctctgggctgctgggacatgcaggctctgagtggggactgcacccactcatgctgttcctgaggctgccctctccagtcccaggagccgtgtctagagttcctgaccagccaccttctgccagaactgcaggcctgcggctgggtcttaggctcccgctgccatttgggtaagccggtggctggtctcgtctgccgggggaagggtggggaggtgcaatgggatgggaggcaggatgcttgcccagaaaggtgctttccttcagacggtgcagggcctgggccagccttacaggtcagtagactagactcgactacttggggtcagtgattcttttgtaacgagtctttcatgatgtgactttgaggccccaacatgacagccactgggccaccgggacccaagaagacagccccctgccccatcttctggcacaggccatcccgagtgcatgtccctgttgcccactgcactgatcatgaagccaccggccactgccacgcatgttgcacctgtgccatcgtgctccctcctgatgggcaccgtggtggaggaagtcacccagctgtttctcagtcccagaggccggtggctggttttgaacttgtgttgactgttgatacttatttactgtataaatataatttatcatttgtaccatga

SEQ ID NO: 313850 - DNA, 4551 bp, Homo sapiens
ttgttggctggtgtgtgggtgtcaaactgagccagacgcggcggtggcggcggctccgcgggctacggtcgctcccgcctctcgagcgctgccggtggccgcagcggcgcacccacgccggcccggaggagcagagtgttcatttctgtgtcgggcacagtgctaagtgctgggtgctcactggtgatgaggcagatgaaggttaccaaacttgtggacaggagcctcatatcagagacgtggacctcactgtagcctggtcatggcttccagcttttcgaatctgaggctccaaaggaggaaatgaccattcagggatcttactccagcttgattacggagactgaaccttcatagggtgcgcacttaccaaggacaggaaggtttctctgtttgaagggctttaaacttataacaaagaaaataaaaatgacgacttcgtctatcagacggcagatgaaaaacatcgtgaacaattactcagaggcagaaatcaaagtccgggaagccacctccaatgacccgtggggcccgtccagttctctgatgaccgagattgccgacctgacctacaacgtggtggccttctcggagatcatgagcatggtgtggaagcggctgaatgaccatggcaagaactggcggcatgtgtacaaggcgctgaccctgctggactacctcatcaagacaggctccgaacgtgtggcccagcagtgccgggagaacatcttcgccatccagaccctgaaggacttccagtacattgaccgagatggcaaggaccagggcatcaatgtgcgtgagaagtcaaagcaactggtggctctcctcaaggacgaggaacggttgaaggctgagagggcccaggctctcaaaaccaaagagcgcatggcccaggttgccactggcatgggcagcaaccagatcacctttgggcgaggctccagccagcccaacctctccaccagccactcggagcaggagtatggcaaggccgggggctccccggcctcctaccatggctccacctccccgcgagtgtcctccgagctggagcaagcccggccccagactagtggagaagaggagcttcagctgcagctggcacttgccatgagcagagaagtggctgagcaggaagaacgcctcaggcggggtgatgacctcagattacagatggccctggaagaaagccgaagggacacagttaaaattccaaaaaagaaagagcatggctctctcccacagcagactacgctgttggatttaatggatgctctccccagctcgggccccgcggcccagaaagcagagccctggggcccgtcagcctccactaaccagaccaacccctggggcgggccagcggctcctgcgagtacttcagacccctggccatcgtttggtaccaagccagctgcctccattgacccatggggggtgcccactggagccaccgcacaatctgtccccaagaactcggacccctgggcagcttcacagcagcctgcctccagtgctgggaaaagagcttctgacgcgtggggcgcagtctccaccaccaagcccgtgtctgtctctgggtcctttgagctcttcagtaatctgaatggtacaattaaagatgacttttctgaatttgacaaccttcggacttcaaaaaaaacagccgaatctgtgacctctctgccatcccaaaacaatggaactaccagccctgacccctttgagtctcaacccctgactgtcgcctcaagcaagcccagcagtgcccggaaaacacctgagtccttcctgggccccaacgcggccctggtgaacctggactcactggtgaccaggcctgccccaccagcccagtccctcaaccctttcctggcaccaggtgctcccgccacctcggcccctgttaaccctttccaggtgaaccagccccagccgctgacactgaaccagcttcgggggagcccagtcctggggaccagcacatcctttgggcctggcccaggagtggagtccatggctgtggcctcgatgacctccgcggccccacagccagctctgggggccactggttcctctctgacaccactgggccctgcaatgatgaacatggtgggcagtgtgggtatacccccatcagcagcccaggccactggcacaaccaaccctttccttctctagtgcctgggcctgggacccacccagagcacctgtgctggaggatgccgagcagggactctcgtctgtgggacgggatccaagagtttggggattaggggtattagggcttttcagctccagcttcctgatgaaagggctgtctttacagccccaaccctcagaccctcgccttccaaggcaggcccctcagcctggcctgctctcaccacctcctccaaagcactgaggtcctggcagggctcctctgaggccttggacgaggacgtggagtcatcagtgttgcccttgcccctaacctcagcccgagggtctccaggatgttgcctggcccaggacttgggacagtggccttgtctttgtcctccccaccccccagccctagggacaccccaggcagtcctgggtgtggacacgatgaagcaccggctccataagacaccttttggggaagtggttgtgcatattttatttttctttgactcgtgtgagttcaaagtaaacaccaccaccgtggacaactcttgaattaaatccactagagcgagctttaaaactaatctgagcataacccccaacgtggctctatgcttgtgtacctttgcacatattttgtttagtacagtttcatatttgagtttgcagaattatctaatagtctttttttggctaatatttttataacgtggttcttatttaactgtctagttttgatagaatttaccaggtctggctgaatgaagatgttggcacgtgtcattttagtggtttaaatcctcttatttatggttttaactctaagaaaattttaaaaggaagagatgtttggatgacaaaaaaatgccttattgaaaaactaaagcaaattctttataggaagaaaatatgggaatttgattacacatagatgatgatgtttatttaaaaaaaaaacaacagcaacaaaaaatcctagcctccagttgccttttcctttctttagctcctgtttttggtgaattactaaactgattgactttcagcctttttggctagatcctgagaggctatttttcttacgaatataccaacatcctgaaagttaaagaaaaaaatctaatgtatgaatgtgactcaccaatttttatcaactaattccttttttttattaaaggcatgcagggattaacaggacttctgtttacaatggaaatctgaaatggaagaaacatctttaaccttgtgtgtctgtgatctcctctgtcttaatccacgctcaggctaaagatggggataatgtggaaatggcagttgtcccgagggcgtggggtggggggtgcttctgtgcccacgggtccctgggcaacagtccctaggctaagacaggggtggggggctaagggaccagggctggccctgatccacctacctgctaactccagatattatttttaagttggagacctaaaaataattctcttgtattttggagatgaagaaaaaagtcattcacctgggagggatttttaacaaacatgcactaatattacctccctcttccaaactcctactgtcctcacctcacccaccactgtaaaagtattacgtcgtgcattaaagaccagaaaagacttgcttttacccagggaggggacattcccccaatcctgtgtctgggcagcttgcctggtggatgtttctggccctttttccaccatgggaatttctcacctctagctctaagggcagctgaccacctgccagcccctctctggttccagaagattacccttcgcaccggcacaggagagatcttaaatggtctctgggctgctgggacatgcaggctctgagtggggactgcacccactcatgctgttcctgaggctgccctctccagtcccaggagccgtgtctagagttcctgaccagccaccttctgccagaactgcaggcctgcggctgggtcttaggctcccgtgctttccttcagacggtgcagggcctgggccagccttacaggtcagtagactagactcgactacttggggtcagtgattcttttgtaacgagtctttcatgatgtgactttgaggccccaacatgacagccactgggccaccgggacccaagaagacagccccctgccccatcttctggcacaggccatcccgagtgcatgtccctgttgcccactgcactgatcatgaagccaccggccactgccacgcatgttgcacctgtgccatcgtgctccctcctgatgggcaccgtggtggaggaagtcacccagctgtttctcagtcccagaggccggtggctggttttgaacttgtgttgactgttgatacttatttactgtataaatataatttatcatttgtaccatga

SEQ ID NO: 313851 - DNA, 4485 bp, Homo sapiens
ttgttggctggtgtgtgggtgtcaaactgagccagacgcggcggtggcggcggctccgcgggctacggtcgctcccgcctctcgagcgctgccggtggccgcagcggcgcacccacgccggcccggaggagcagagtgttcatttctgtgtcgggcacagtgctaagtgctgggtgctcactggtgatgaggcagatgaaggttaccaaacttgtggacaggagcctcatatcagagacgtggacctcactgtagcctggtcatggcttccagcttttcgaatctgaggctccaaaggaggaaatgaccattcagggatcttactccagcttgattacggagactgaaccttcatagggtgcgcacttaccaaggacaggaaggtttctctgtttgaagggctttaaacttataacaaagaaaataaaaatgacgacttcgtctatcagacggcagatgaaaaacatcgtgaacaattactcagaggcagaaatcaaagtccgggaagccacctccaatgacccgtggggcccgtccagttctctgatgaccgagattgccgacctgacctacaacgtggtggccttctcggagatcatgagcatggtgtggaagcggctgaatgaccatggcaagaactggcggcatgtgtacaaggcgctgaccctgctggactacctcatcaagacaggctccgaacgtgtggcccagcagtgccgggagaacatcttcgccatccagaccctgaaggacttccagtacattgaccgagatggcaaggaccagggcatcaatgtgcgtgagaagtcaaagcaactggtggctctcctcaaggacgaggaacggttgaaggctgagagggcccaggctctcaaaaccaaagagcgcatggcccaggttgccactggcatgggcagcaaccagatcacctttgggcgaggctccagccagcccaacctctccaccagccactcggagcaggagtatggcaaggccgggggctccccggcctcctaccatggctccacctccccgcgagtgtcctccgagctggagcaagcccggccccagactagtggagaagaggagcttcagctgcagctggcacttgccatgagcagagaagtggctgagcaggaagaacgcctcaggcggggtgatgacctcagattacagatggccctggaagaaagccgaagggacacagttaaaattccaaaaaagaaagagcatggctctctcccacagcagactacgctgttggatttaatggatgctctccccagctcgggccccgcggcccagaaagcagagccctggggcccgtcagcctccactaaccagaccaacccctggggcgggccagcggctcctgcgagtacttcagacccctggccatcgtttggtaccaagccagctgcctccattgacccatggggggtgcccactggagccaccgcacaatctgtccccaagaactcggacccctgggcagcttcacagcagcctgcctccagtgctgggaaaagagcttctgacgcgtggggcgcagtctccaccaccaagcccgtgtctgtctctgggtcctttgagctcttcagtaatctgaatggtacaattaaagatgacttttctgaatttgacaaccttcggacttcaaaaaaaacagccgaatctgtgacctctctgccatcccaaaacaatggaactaccagccctgacccctttgagtctcaacccctgactgtcgcctcaagcaagcccagcagtgcccggaaaacacctgagtccttcctgggccccaacgcggccctggtgaacctggactcactggtgaccaggcctgccccaccagcccagtccctcaaccctttcctggcaccaggtgctcccgccacctcggcccctgttaaccctttccaggtgaaccagccccagccgctgacactgaaccagcttcgggggagcccagtcctggggaccagcacatcctttgggcctggcccaggagtggagtccatggctgtggcctcgatgacctccgcggccccacagccagctctgggggccactggttcctctctgacaccactgggccctgcaatgatgaacatggtgggcagtgtgggtatacccccatcagcagcccaggccactggcacaaccaaccctttccttctctagtgcctgggcctgggacccacccagagcacctgtgctggaggatgccgagcagggactctcgtctgtgggacgggatccaagagtttggggattaggggtattagggcttttcagctccagcttcctgatgaaagggctgtctttacagccccaaccctcagaccctcgccttccaaggcaggcccctcagcctggcctgctctcaccaccccccagccctagggacaccccaggcagtcctgggtgtggacacgatgaagcaccggctccataagacaccttttggggaagtggttgtgcatattttatttttctttgactcgtgtgagttcaaagtaaacaccaccaccgtggacaactcttgaattaaatccactagagcgagctttaaaactaatctgagcataacccccaacgtggctctatgcttgtgtacctttgcacatattttgtttagtacagtttcatatttgagtttgcagaattatctaatagtctttttttggctaatatttttataacgtggttcttatttaactgtctagttttgatagaatttaccaggtctggctgaatgaagatgttggcacgtgtcattttagtggtttaaatcctcttatttatggttttaactctaagaaaattttaaaaggaagagatgtttggatgacaaaaaaatgccttattgaaaaactaaagcaaattctttataggaagaaaatatgggaatttgattacacatagatgatgatgtttatttaaaaaaaaaacaacagcaacaaaaaatcctagcctccagttgccttttcctttctttagctcctgtttttggtgaattactaaactgattgactttcagcctttttggctagatcctgagaggctatttttcttacgaatataccaacatcctgaaagttaaagaaaaaaatctaatgtatgaatgtgactcaccaatttttatcaactaattccttttttttattaaaggcatgcagggattaacaggacttctgtttacaatggaaatctgaaatggaagaaacatctttaaccttgtgtgtctgtgatctcctctgtcttaatccacgctcaggctaaagatggggataatgtggaaatggcagttgtcccgagggcgtggggtggggggtgcttctgtgcccacgggtccctgggcaacagtccctaggctaagacaggggtggggggctaagggaccagggctggccctgatccacctacctgctaactccagatattatttttaagttggagacctaaaaataattctcttgtattttggagatgaagaaaaaagtcattcacctgggagggatttttaacaaacatgcactaatattacctccctcttccaaactcctactgtcctcacctcacccaccactgtaaaagtattacgtcgtgcattaaagaccagaaaagacttgcttttacccagggaggggacattcccccaatcctgtgtctgggcagcttgcctggtggatgtttctggccctttttccaccatgggaatttctcacctctagctctaagggcagctgaccacctgccagcccctctctggttccagaagattacccttcgcaccggcacaggagagatcttaaatggtctctgggctgctgggacatgcaggctctgagtggggactgcacccactcatgctgttcctgaggctgccctctccagtcccaggagccgtgtctagagttcctgaccagccaccttctgccagaactgcaggcctgcggctgggtcttaggctcccgctgccatttgggtaagccggtggctggtctcgtctgccgggggaagggtggggaggtgcaatgggatgggaggcaggatgcttgcccagaaaggtgctttccttcagacggtgcagggcctgggccagccttacaggtcagtagactagactcgactacttggggtcagtgattcttttgtaacgagtctttcatgatgtgactttgaggccccaacatgacagccactgggccaccgggacccaagaagacagccccctgccccatcttctggcacaggccatcccgagtgcatgtccctgttgcccactgcactgatcatgaagccaccggccactgccacgcatgttgcacctgtgccatcgtgctccctcctgatgggcaccgtggtggaggaagtcacccagctgtttctcagtcccagaggccggtggctggttttgaacttgtgttgactgttgatacttatttactgtataaatataatttatcatttgtaccatga

SEQ ID NO: 313852 - DNA, 4627 bp, Homo sapiens
ttgttggctggtgtgtgggtgtcaaactgagccagacgcggcggtggcggcggctccgcgggctacggtcgctcccgcctctcgagcgctgccggtggccgcagcggcgcacccacgccggcccggaggagcagagtgttcatttctgtgtcgggcacagtgctaagtgctgggtgctcactggtgatgaggcagatgaaggttaccaaacttgtggacaggagcctcatatcagagacgtggacctcactgtagcctggtcatggcttccagcttttcgaatctgaggctccaaaggaggaaatgaccattcagggatcttactccagcttgattacggagactgaaccttcatagggtgcgcacttaccaaggacaggaaggtttctctgtttgaagggctttaaacttataacaaagaaaataaaaatgacgacttcgtctatcagacggcagatgaaaaacatcgtgaacaattactcagaggcagaaatcaaagtccgggaagccacctccaatgacccgtggggcccgtccagttctctgatgaccgagattgccgacctgacctacaacgtggtggccttctcggagatcatgagcatggtgtggaagcggctgaatgaccatggcaagaactggcggcatgtgtacaaggcgctgaccctgctggactacctcatcaagacaggctccgaacgtgtggcccagcagtgccgggagaacatcttcgccatccagaccctgaaggacttccagtacattgaccgagatggcaaggaccagggcatcaatgtgcgtgagaagtcaaagcaactggtggctctcctcaaggacgaggaacggttgaaggctgagagggcccaggctctcaaaaccaaagagcgcatggcccaggttgccactggcatgggcagcaaccagatcacctttgggcgaggctccagccagcccaacctctccaccagccactcggagcaggagtatggcaaggccgggggctccccggcctcctaccatggctccacctccccgcgagtgtcctccgagctggagcaagcccggccccagactagtggagaagaggagcttcagctgcagctggcacttgccatgagcagagaagtggctgagcaggaagaacgcctcaggcggggtgatgacctcagattacagatggccctggaagaaagccgaagggacacagttaaaattccaaaaaagaaagagcagactacgctgttggatttaatggatgctctccccagctcgggccccgcggcccagaaagcagagccctggggcccgtcagcctccactaaccagaccaacccctggggcgggccagcggctcctgcgagtacttcagacccctggccatcgtttggtaccaagccagctgcctccattgacccatggggggtgcccactggagccaccgcacaatctgtccccaagaactcggacccctgggcagcttcacagcagcctgcctccagtgctgggaaaagagcttctgacgcgtggggcgcagtctccaccaccaagcccgtgtctgtctctgggtcctttgagctcttcagtaatctgaatggtacaattaaagatgacttttctgaatttgacaaccttcggacttcaaaaaaaacagccgaatctgtgacctctctgccatcccaaaacaatggaactaccagccctgacccctttgagtctcaacccctgactgtcgcctcaagcaagcccagcagtgcccggaaaacacctgagtccttcctgggccccaacgcggccctggtgaacctggactcactggtgaccaggcctgccccaccagcccagtccctcaaccctttcctggcaccaggtgctcccgccacctcggcccctgttaaccctttccaggtgaaccagccccagccgctgacactgaaccagcttcgggggagcccagtcctggggaccagcacatcctttgggcctggcccaggagtggagtccatggctgtggcctcgatgacctccgcggccccacagccagctctgggggccactggttcctctctgacaccactgggccctgcaatgatgaacatggtgggcagtgtgggtatacccccatcagcagcccaggccactggcacaaccaaccctttccttctctagtgcctgggcctgggacccacccagagcacctgtgctggaggatgccgagcagggactctcgtctgtgggacgggatccaagagtttggggattaggggtattagggcttttcagctccagcttcctgatgaaagggctgtctttacagccccaaccctcagaccctcgccttccaaggcaggcccctcagcctggcctgctctcaccacctcctccaaagcactgaggtcctggcagggctcctctgaggccttggacgaggacgtggagtcatcagtgttgcccttgcccctaacctcagcccgagggtctccaggatgttgcctggcccaggacttgggacagtggccttgtctttgtcctccccaccccccagccctagggacaccccaggcagtcctgggtgtggacacgatgaagcaccggctccataagacaccttttggggaagtggttgtgcatattttatttttctttgactcgtgtgagttcaaagtaaacaccaccaccgtggacaactcttgaattaaatccactagagcgagctttaaaactaatctgagcataacccccaacgtggctctatgcttgtgtacctttgcacatattttgtttagtacagtttcatatttgagtttgcagaattatctaatagtctttttttggctaatatttttataacgtggttcttatttaactgtctagttttgatagaatttaccaggtctggctgaatgaagatgttggcacgtgtcattttagtggtttaaatcctcttatttatggttttaactctaagaaaattttaaaaggaagagatgtttggatgacaaaaaaatgccttattgaaaaactaaagcaaattctttataggaagaaaatatgggaatttgattacacatagatgatgatgtttatttaaaaaaaaaacaacagcaacaaaaaatcctagcctccagttgccttttcctttctttagctcctgtttttggtgaattactaaactgattgactttcagcctttttggctagatcctgagaggctatttttcttacgaatataccaacatcctgaaagttaaagaaaaaaatctaatgtatgaatgtgactcaccaatttttatcaactaattccttttttttattaaaggcatgcagggattaacaggacttctgtttacaatggaaatctgaaatggaagaaacatctttaaccttgtgtgtctgtgatctcctctgtcttaatccacgctcaggctaaagatggggataatgtggaaatggcagttgtcccgagggcgtggggtggggggtgcttctgtgcccacgggtccctgggcaacagtccctaggctaagacaggggtggggggctaagggaccagggctggccctgatccacctacctgctaactccagatattatttttaagttggagacctaaaaataattctcttgtattttggagatgaagaaaaaagtcattcacctgggagggatttttaacaaacatgcactaatattacctccctcttccaaactcctactgtcctcacctcacccaccactgtaaaagtattacgtcgtgcattaaagaccagaaaagacttgcttttacccagggaggggacattcccccaatcctgtgtctgggcagcttgcctggtggatgtttctggccctttttccaccatgggaatttctcacctctagctctaagggcagctgaccacctgccagcccctctctggttccagaagattacccttcgcaccggcacaggagagatcttaaatggtctctgggctgctgggacatgcaggctctgagtggggactgcacccactcatgctgttcctgaggctgccctctccagtcccaggagccgtgtctagagttcctgaccagccaccttctgccagaactgcaggcctgcggctgggtcttaggctcccgctgccatttgggtaagccggtggctggtctcgtctgccgggggaagggtggggaggtgcaatgggatgggaggcaggatgcttgcccagaaaggtgctttccttcagacggtgcagggcctgggccagccttacaggtcagtagactagactcgactacttggggtcagtgattcttttgtaacgagtctttcatgatgtgactttgaggccccaacatgacagccactgggccaccgggacccaagaagacagccccctgccccatcttctggcacaggccatcccgagtgcatgtccctgttgcccactgcactgatcatgaagccaccggccactgccacgcatgttgcacctgtgccatcgtgctccctcctgatgggcaccgtggtggaggaagtcacccagctgtttctcagtcccagaggccggtggctggttttgaacttgtgttgactgttgatacttatttactgtataaatataatttatcatttgtaccatga

SEQ ID NO: 313853 - DNA, 3151 bp, Homo sapiens
ttgttggctggtgtgtgggtgtcaaactgagccagacgcggcggtggcggcggctccgcgggctacggtcgctcccgcctctcgagcgctgccggtggccgcagcggcgcacccacgccggcccggaggagcagagtgttcatttctgtgtcgggcacagtgctaagtgctgggtgctcactggtgatgaggcagatgaaggttaccaaacttgtggacaggagcctcatatcagagacgtggacctcactgtagcctggtcatggcttccagcttttcgaatctgaggctccaaaggaggaaatgaccattcagggatcttactccagcttgattacggagactgaaccttcatagggtgcgcacttaccaaggacaggaaggtttctctgtttgaagggctttaaacttataacaaagaaaataaaaatgacgacttcgtctatcagacggcagatgaaaaacatcgtgaacaattactcagaggcagaaatcaaagtccgggaagccacctccaatgacccgtggggcccgtccagttctctgatgaccgagattgccgacctgacctacaacgtggtggccttctcggagatcatgagcatggtgtggaagcggctgaatgaccatggcaagaactggcggcatgtgtacaaggcgctgaccctgctggactacctcatcaagacaggctccgaacgtgtggcccagcagtgccgggagaacatcttcgccatccagaccctgaaggacttccagtacattgaccgagatggcaaggaccagggcatcaatgtgcgtgagaagtcaaagcaactggtggctctcctcaaggacgaggaacggttgaaggctgagagggcccaggctctcaaaaccaaagagcgcatggcccaggttgccactggcatgggcagcaaccagatcacctttgggcgaggctccagccagcccaacctctccaccagccactcggagcaggagtatggcaaggccgggggctccccggcctcctaccatggctcgcctgaggcctcgctgtgcccccagcaccgcacaggggccccgctgggtcagagtgaggagctgcagccactgagccagcgccaccccttcctgccgcacctggggctggcctcccgcccaaatggcgactggtcccagccctgcctcacttgtgaccgcgcagcccgagccacctccccgcgagtgtcctccgagctggagcaagcccggccccagactagtggagaagaggagcttcagctgcagctggcacttgccatgagcagagaagtggctgagcaggaagaacgcctcaggcggggtgatgacctcagattacagatggccctggaagaaagccgaagggacacagttaaaattccaaaaaagaaagagcatggctctctcccacagcagactacgctgttggatttaatggatgctctccccagctcgggccccgcggcccagaaagcagagccctggggcccgtcagcctccactaaccagaccaacccctggggcgggccagcggctcctgcgagtacttcagacccctggccatcgtttggtaccaagccagctgcctccattgacccatggggggtgcccactggagccaccgcacaatctgtccccaagaactcggacccctgggcagcttcacagcagcctgcctccagtgctgggaaaagagcttctgacgcgtggggcgcagtctccaccaccaagcccgtgtctgtctctgggtcctttgagctcttcagtaatctgaatggtacaattaaagatgacttttctgaatttgacaaccttcggacttcaaaaaaaacaggcatgcagggattaacaggacttctgtttacaatggaaatctgaaatggaagaaacatctttaaccttgtgtgtctgtgatctcctctgtcttaatccacgctcaggctaaagatggggataatgtggaaatggcagttgtcccgagggcgtggggtggggggtgcttctgtgcccacgggtccctgggcaacagtccctaggctaagacaggggtggggggctaagggaccagggctggccctgatccacctacctgctaactccagatattatttttaagttggagacctaaaaataattctcttgtattttggagatgaagaaaaaagtcattcacctgggagggatttttaacaaacatgcactaatattacctccctcttccaaactcctactgtcctcacctcacccaccactgtaaaagtattacgtcgtgcattaaagaccagaaaagacttgcttttacccagggaggggacattcccccaatcctgtgtctgggcagcttgcctggtggatgtttctggccctttttccaccatgggaatttctcacctctagctctaagggcagctgaccacctgccagcccctctctggttccagaagattacccttcgcaccggcacaggagagatcttaaatggtctctgggctgctgggacatgcaggctctgagtggggactgcacccactcatgctgttcctgaggctgccctctccagtcccaggagccgtgtctagagttcctgaccagccaccttctgccagaactgcaggcctgcggctgggtcttaggctcccgctgccatttgggtaagccggtggctggtctcgtctgccgggggaagggtggggaggtgcaatgggatgggaggcaggatgcttgcccagaaaggtgctttccttcagacggtgcagggcctgggccagccttacaggtcagtagactagactcgactacttggggtcagtgattcttttgtaacgagtctttcatgatgtgactttgaggccccaacatgacagccactgggccaccgggacccaagaagacagccccctgccccatcttctggcacaggccatcccgagtgcatgtccctgttgcccactgcactgatcatgaagccaccggccactgccacgcatgttgcacctgtgccatcgtgctccctcctgatgggcaccgtggtggaggaagtcacccagctgtttctcagtcccagaggccggtggctggttttgaacttgtgttgactgttgatacttatttactgtataaatataatttatcatttgtaccatga

SEQ ID NO: 313854 - DNA, 330 bp, Homo sapiens
ccgcctctcgagcgctgccggtggccgcagcggcgcacccacgccggcccggaggagcatactttttatagagatggggtctcactctgttgcccagactggtctcaaactgcttatctcaagtgactgactgtctgcctcagctgcccaagtagcagggattacagacacaagccacagccgctggctctattcaggaacatcttagttccaagttttgggaattatggataaagctgctatataaacaggtgtgcaggtttttgtgtggacattttcaactcatttgggtagacaccaagaggcacgagttctgatcataccgaaagt

SEQ ID NO: 313855 - DNA, 4816 bp, Homo sapiens
ttgttggctggtgtgtgggtgtcaaactgagccagacgcggcggtggcggcggctccgcgggctacggtcgctcccgcctctcgagcgctgccggtggccgcagcggcgcacccacgccggcccggaggagcagagtgttcatttctgtgtcgggcacagtgctaagtgctgggtgctcactggtgatgaggcagatgaaggttaccaaacttgtggacaggagcctcatatcagagacgtggacctcactgtagcctggtcatggcttccagcttttcgaatctgaggctccaaaggaggaaatgaccattcagggatcttactccagcttgattacggagactgaaccttcatagggtgcgcacttaccaaggacaggaaggtttctctgtttgaagggctttaaacttataacaaagaaaataaaaatgacgacttcgtctatcagacggcagatgaaaaacatcgtgaacaattactcagaggcagaaatcaaagtccgggaagccacctccaatgacccgtggggcccgtccagttctctgatgaccgagattgccgacctgacctacaacgtggtggccttctcggagatcatgagcatggtgtggaagcggctgaatgaccatggcaagaactggcggcatgtgtacaaggcgctgaccctgctggactacctcatcaagacaggctccgaacgtgtggcccagcagtgccgggagaacatcttcgccatccagaccctgaaggacttccagtacattgaccgagatggcaaggaccagggcatcaatgtgcgtgagaagtcaaagcaactggtggctctcctcaaggacgaggaacggttgaaggctgagagggcccaggctctcaaaaccaaagagcgcatggcccaggttgccactggcatgggcagcaaccagatcacctttgggcgaggctccagccagcccaacctctccaccagccactcggagcaggagtatggcaaggccgggggctccccggcctcctaccatggctcgcctgaggcctcgctgtgcccccagcaccgcacaggggccccgctgggtcagagtgaggagctgcagccactgagccagcgccaccccttcctgccgcacctggggctggcctcccgcccaaatggcgactggtcccagccctgcctcacttgtgaccgcgcagcccgagccacctccccgcgagtgtcctccgagctggagcaagcccggccccagactagtggagaagaggagcttcagctgcagctggcacttgccatgagcagagaagtggctgagcaggaagaacgcctcaggcggggtgatgacctcagattacagatggccctggaagaaagccgaagggacacagttaaaattccaaaaaagaaagagcatggctctctcccacagcagactacgctgttggatttaatggatgctctccccagctcgggccccgcggcccagaaagcagagccctggggcccgtcagcctccactaaccagaccaacccctggggcgggccagcggctcctgcgagtacttcagacccctggccatcgtttggtaccaagccagctgcctccattgacccatggggggtgcccactggagccaccgcacaatctgtccccaagaactcggacccctgggcagcttcacagcagcctgcctccagtgctgggaaaagagcttctgacgcgtggggcgcagtctccaccaccaagcccgtgtctgtctctgggtcctttgagctcttcagtaatctgaatggtacaattaaagatgacttttctgaatttgacaaccttcggacttcaaaaaaaacagccgaatctgtgacctctctgccatcccaaaacaatggaactaccagccctgacccctttgagtctcaacccctgactgtcgcctcaagcaagcccagcagtgcccggaaaacacctgagtccttcctgggccccaacgcggccctggtgaacctggactcactggtgaccaggcctgccccaccagcccagtccctcaaccctttcctggcaccaggtgctcccgccacctcggcccctgttaaccctttccaggtgaaccagccccagccgctgacactgaaccagcttcgggggagcccagtcctggggaccagcacatcctttgggcctggcccaggagtggagtccatggctgtggcctcgatgacctccgcggccccacagccagctctgggggccactggttcctctctgacaccactgggccctgcaatgatgaacatggtgggcagtgtgggtatacccccatcagcagcccaggccactggcacaaccaaccctttccttctctagtgcctgggcctgggacccacccagagcacctgtgctggaggatgccgagcagggactctcgtctgtgggacgggatccaagagtttggggattaggggtattagggcttttcagctccagcttcctgatgaaagggctgtctttacagccccaaccctcagaccctcgccttccaaggcaggcccctcagcctggcctgctctcaccacctcctccaaagcactgaggtcctggcagggctcctctgaggccttggacgaggacgtggagtcatcagtgttgcccttgcccctaacctcagcccgagggtctccaggatgttgcctggcccaggacttgggacagtggccttgtctttgtcctccccaccccccagccctagggacaccccaggcagtcctgggtgtggacacgatgaagcaccggctccataagacaccttttggggaagtggttgtgcatattttatttttctttgactcgtgtgagttcaaagtaaacaccaccaccgtggacaactcttgaattaaatccactagagcgagctttaaaactaatctgagcataacccccaacgtggctctatgcttgtgtacctttgcacatattttgtttagtacagtttcatatttgagtttgcagaattatctaatagtctttttttggctaatatttttataacgtggttcttatttaactgtctagttttgatagaatttaccaggtctggctgaatgaagatgttggcacgtgtcattttagtggtttaaatcctcttatttatggttttaactctaagaaaattttaaaaggaagagatgtttggatgacaaaaaaatgccttattgaaaaactaaagcaaattctttataggaagaaaatatgggaatttgattacacatagatgatgatgtttatttaaaaaaaaaacaacagcaacaaaaaatcctagcctccagttgccttttcctttctttagctcctgtttttggtgaattactaaactgattgactttcagcctttttggctagatcctgagaggctatttttcttacgaatataccaacatcctgaaagttaaagaaaaaaatctaatgtatgaatgtgactcaccaatttttatcaactaattccttttttttattaaaggcatgcagggattaacaggacttctgtttacaatggaaatctgaaatggaagaaacatctttaaccttgtgtgtctgtgatctcctctgtcttaatccacgctcaggctaaagatggggataatgtggaaatggcagttgtcccgagggcgtggggtggggggtgcttctgtgcccacgggtccctgggcaacagtccctaggctaagacaggggtggggggctaagggaccagggctggccctgatccacctacctgctaactccagatattatttttaagttggagacctaaaaataattctcttgtattttggagatgaagaaaaaagtcattcacctgggagggatttttaacaaacatgcactaatattacctccctcttccaaactcctactgtcctcacctcacccaccactgtaaaagtattacgtcgtgcattaaagaccagaaaagacttgcttttacccagggaggggacattcccccaatcctgtgtctgggcagcttgcctggtggatgtttctggccctttttccaccatgggaatttctcacctctagctctaagggcagctgaccacctgccagcccctctctggttccagaagattacccttcgcaccggcacaggagagatcttaaatggtctctgggctgctgggacatgcaggctctgagtggggactgcacccactcatgctgttcctgaggctgccctctccagtcccaggagccgtgtctagagttcctgaccagccaccttctgccagaactgcaggcctgcggctgggtcttaggctcccgctgccatttgggtaagccggtggctggtctcgtctgccgggggaagggtggggaggtgcaatgggatgggaggcaggatgcttgcccagaaaggtgctttccttcagacggtgcagggcctgggccagccttacaggtcagtagactagactcgactacttggggtcagtgattcttttgtaacgagtctttcatgatgtgactttgaggccccaacatgacagccactgggccaccgggacccaagaagacagccccctgccccatcttctggcacaggccatcccgagtgcatgtccctgttgcccactgcactgatcatgaagccaccggccactgccacgcatgttgcacctgtgccatcgtgctccctcctgatgggcaccgtggtggaggaagtcacccagctgtttctcagtcccagaggccggtggctggttttgaacttgtgttgactgttgatacttatttactgtataaatataatttatcatttgtaccatga

SEQ ID NO: 313856 - DNA, 4591 bp, Homo sapiens
ttgttggctggtgtgtgggtgtcaaactgagccagacgcggcggtggcggcggctccgcgggctacggtcgctcccgcctctcgagcgctgccggtggccgcagcggcgcacccacgccggcccggaggagcagagtgttcatttctgtgtcgggcacagtgctaagtgctgggtgctcactggtgatgaggcagatgaaggttaccaaacttgtggacaggagcctcatatcagagacgtggacctcactgtagcctggtcatggcttccagcttttcgaatctgaggctccaaaggaggaaatgaccattcagggatcttactccagcttgattacggagactgaaccttcatagggtgcgcacttaccaaggacaggaaggtttctctgtttgaagggctttaaacttataacaaagaaaataaaaatgacgacttcgtctatcagacggcagatgaaaaacatcgtgaacaattactcagaggcagaaatcaaagtccgggaagccacctccaatgacccgtggggcccgtccagttctctgatgaccgagattgccgacctgacctacaacgtggtggccttctcggagatcatgagcatggtgtggaagcggctgaatgaccatggcaagaactggcggcatgtgtacaaggcgctgaccctgctggactacctcatcaagacaggctccgaacgtgtggcccagcagtgccgggagaacatcttcgccatccagaccctgaaggacttccagtacattgaccgagatggcaaggaccagggcatcaatgtgcgtgagaagtcaaagcaactggtggctctcctcaaggacgaggaacggttgaaggctgagagggcccaggctctcaaaaccaaagagcgcatggcccaggttgccactggcatgggcagcaaccagatcacctttgggcgaggctccagccagcccaacctctccaccagccactcggagcaggagtatggcaaggccgggggctccccggcctcctaccatggctccacctccccgcgagtgtcctccgagctggagcaagcccggccccagactagtggagaagaggagcttcagctgcagctggcacttgccatgagcagagaagtggctgagcaggaagaacgcctcaggcggggtgatgacctcagattacagatggccctggaagaaagccgaagggacacagttaaaattccaaaaaagaaagagcatggctctctcccacagcagactacgctgttggatttaatggatgctctccccagctcgggccccgcggcccagaaagcagagccctggggcccgtcagcctccactaaccagaccaacccctggggcgggccagcggctcctgcgagtacttcagacccctggccatcgtttggtaccaagccagctgcctccattgacccatggggggtgcccactggagccaccgcacaatctgtccccaagaactcggacccctgggcagcttcacagcagcctgcctccagtgctgggaaaagagcttctgacgcgtggggcgcagtctccaccaccaagcccgtgtctgtctctgggtcctttgagctcttcagtaatctgaatggtacaattaaagatgacttttctgaatttgacaaccttcggacttcaaaaaaaacagccgaatctgtgacctctctgccatcccaaaacaatggaactaccagccctgacccctttgagtctcaacccctgactgtcgcctcaagcaagcccagcagtgcccggaaaacacctgagtccttcctgggccccaacgcggccctggtgaacctggactcactggtgaccaggcctgccccaccagcccagtccctcaaccctttcctggcaccaggtgctcccgccacctcggcccctgttaaccctttccaggtgaaccagccccagccgctgacactgaaccagcttcgggggagcccagtcctggggaccagcacatcctttgggcctggcccaggagtggagtccatggctgtggcctcgatgacctccgcggccccacagccagctctgggggccactggttcctctctgacaccactgggccctgcaatgatgaacatggtgggcagtgtgggtatacccccatcagcagcccaggccactggcacaaccaaccctttccttctctagtgcctgggcctgggacccacccagagcacctgtgctggaggatgccgagcagggactctcgtctgtgggacgggatccaagagtttggggattaggggtattagggcttttcagctccagcttcctgatgaaagggctgtctttacagccccaaccctcagaccctcgccttccaaggcaggcccctcagcctggcctgctctcaccacctcctccaaagcactgaggtcctggcagggctcctctgaggccttggacgaggacgtggagtcatcagtgttgcccttgcccctaacctcagcccgagggtctccaggatgttgcctggcccaggacttgggacagtggccttgtctttgtcctccccaccccccagccctagggacaccccaggcagtcctgggtgtggacacgatgaagcaccggctccataagacaccttttggggaagtggttgtgcatattttatttttctttgactcgtgtgagttcaaagtaaacaccaccaccgtggacaactcttgaattaaatccactagagcgagctttaaaactaatctgagcataacccccaacgtggctctatgcttgtgtacctttgcacatattttgtttagtacagtttcatatttgagtttgcagaattatctaatagtctttttttggctaatatttttataacgtggttcttatttaactgtctagttttgatagaatttaccaggtctggctgaatgaagatgttggcacgtgtcattttagtggtttaaatcctcttatttatggttttaactctaagaaaattttaaaaggaagagatgtttggatgacaaaaaaatgccttattgaaaaactaaagcaaattctttataggaagaaaatatgggaatttgattacacatagatgatgatgtttatttaaaaaaaaaacaacagcaacaaaaaatcctagcctccagttgccttttcctttctttagctcctgtttttggtgaattactaaactgattgactttcagcctttttggctagatcctgagaggctatttttcttacgaatataccaacatcctgaaagttaaagaaaaaaatctaatgtatgaatgtgactcaccaatttttatcaactaattccttttttttattaaaggcatgcagggattaacaggacttctgtttacaatggaaatctgaaatggaagaaacatctttaaccttgtgtgtctgtgatctcctctgtcttaatccacgctcaggctaaagatggggataatgtggaaatggcagttgtcccgagggcgtggggtggggggtgcttctgtgcccacgggtccctgggcaacagtccctaggctaagacaggggtggggggctaagggaccagggctggccctgatccacctacctgctaactccagatattatttttaagttggagacctaaaaataattctcttgtattttggagatgaagaaaaaagtcattcacctgggagggatttttaacaaacatgcactaatattacctccctcttccaaactcctactgtcctcacctcacccaccactgtaaaagtattacgtcgtgcattaaagaccagagcttgcctggtggatgtttctggccctttttccaccatgggaatttctcacctctagctctaagggcagctgaccacctgccagcccctctctggttccagaagattacccttcgcaccggcacaggagagatcttaaatggtctctgggctgctgggacatgcaggctctgagtggggactgcacccactcatgctgttcctgaggctgccctctccagtcccaggagccgtgtctagagttcctgaccagccaccttctgccagaactgcaggcctgcggctgggtcttaggctcccgctgccatttgggtaagccggtggctggtctcgtctgccgggggaagggtggggaggtgcaatgggatgggaggcaggatgcttgcccagaaaggtgctttccttcagacggtgcagggcctgggccagccttacaggtcagtagactagactcgactacttggggtcagtgattcttttgtaacgagtctttcatgatgtgactttgaggccccaacatgacagccactgggccaccgggacccaagaagacagccccctgccccatcttctggcacaggccatcccgagtgcatgtccctgttgcccactgcactgatcatgaagccaccggccactgccacgcatgttgcacctgtgccatcgtgctccctcctgatgggcaccgtggtggaggaagtcacccagctgtttctcagtcccagaggccggtggctggttttgaacttgtgttgactgttgatacttatttactgtataaatataatttatcatttgtaccatga

SEQ ID NO: 313857 - DNA, 4815 bp, Homo sapiens
ttgttggctggtgtgtgggtgtcaaactgagccagacgcggcggtggcggcggctccgcgggctacggtcgctcccgcctctcgagcgctgccggtggccgcagcggcgcacccacgccggcccggaggagcagagtgttcatttctgtgtcgggcacagtgctaagtgctgggtgctcactggtgatgaggcagatgaaggttaccaaacttgtggacaggagcctcatatcagagacgtggacctcactgtagcctggtcatggcttccagcttttcgaatctgaggctccaaaggaggaaatgaccattcagggatcttactccagcttgattacggagactgaaccttcatagggtgcgcacttaccaaggacaggaaggtttctctgtttgaagggctttaaacttataacaaagaaaataaaaatgacgacttcgtctatcagacggcagatgaaaaacatcgtgaacaattactcagaggcagaaatcaaagtccgggaagccacctccaatgacccgtggggcccgtccagttctctgatgaccgagattgccgacctgacctacaacgtggtggccttctcggagatcatgagcatggtgtggaagcggctgaatgaccatggcaagaactggcggcatgtgtacaaggcgctgaccctgctggactacctcatcaagacaggctccgaacgtgtggcccagcagtgccgggagaacatcttcgccatccagaccctgaaggacttccagtacattgaccgagatggcaaggaccagggcatcaatgtgcgtgagaagtcaaagcaactggtggctctcctcaaggacgaggaacggttgaaggctgagagggcccaggctctcaaaaccaaagagcgcatggcccaggttgccactggcatgggcagcaaccagatcacctttgggcgaggctccagccagcccaacctctccaccagccactcggagcaggagtatggcaaggccgggggctccccggcctcctaccatggctccacctccccgcgagtgtcctccgagctggagcaagcccggccccagactagtggagaagaggagcttcagctgcagctggcacttgccatgagcagagaagtggctgagcaggaagaacgcctcaggcggggtgatgacctcagattacagatggccctggaagaaagccgaagggacacagttaaaattccaaaaaagaaagagcatggctctctcccacagcagactacgctgttggatttaatggatgctctccccagctcgggccccgcggcccagaaagcagagccctggggcccgtcagcctccactaaccagaccaacccctggggcgggccagcggctcctgcgagtacttcagacccctggccatcgtttggtaccaagccagctgcctccattgacccatggggggtgcccactggagccaccgcacaatctgtccccaagaactcggacccctgggcagcttcacagcagcctgcctccagtgctgggaaaagagcttctgacgcgtggggcgcagtctccaccaccaagcccgtgtctgtctctgggtcctttgagctcttcagtaatctgaatggtacaattaaagatgacttttctgaatttgacaaccttcggacttcaaaaaaaacagccgaatctgtgacctctctgccatcccaaaacaatggaactaccagccctgacccctttgagtctcaacccctgactgtcgcctcaagcaagcccagcagtgcccggaaaacacctgagtccttcctgggccccaacgcggccctggtgaacctggactcactggtgaccaggcctgccccaccagcccagtccctcaaccctttcctggcaccaggtgctcccgccacctcggcccctgttaaccctttccaggtgaaccagccccagccgctgacactgaaccagcttcgggggagcccagtcctggggaccagcacatcctttgggcctggcccaggagtggagtccatggctgtggcctcgatgacctccgcggccccacagccagctctgggggccactggttcctctctgacaccactgggccctgcaatgatgaacatggtgggcagtgtgggtatacccccatcagcagcccaggccactggcacaaccaaccctttccttctctagtgcctgggcctgggacccacccagagcacctgtgctggaggatgccgagcagggactctcgtctgtgggacgggatccaagagtttggggattaggggtattagggcttttcagctccagcttcctgatgaaagggctgtctttacagccccaaccctcagaccctcgccttccaaggcaggcccctcagcctggcctgctctcaccacctcctccaaagcactgaggtcctggcagggctcctctgaggccttggacgaggacgtggagtcatcagtgttgcccttgcccctaacctcagcccgagggtctccaggatgttgcctggcccaggacttgggacagtggccttgtctttgtcctccccaccccccagccctagggacaccccaggcagtcctgggtgtggacacgatgaagcaccggctccataagacaccttttggggaagtggttgtgcatattttatttttctttgactcgtgtgagttcaaagtaaacaccaccaccgtggacaactcttgaattaaatccactagagcgagctttaaaactaatctgagcataacccccaacgtggctctatgcttgtgtacctttgcacatattttgtttagtacagtttcatatttgagtttgcagaattatctaatagtctttttttggctaatatttttataacgtggttcttatttaactgtctagttttgatagaatttaccaggtctggctgaatgaagatgttggcacgtgtcattttagtggtttaaatcctcttatttatggttttaactctaagaaaattttaaaaggaagagatgtttggatgacaaaaaaatgccttattgaaaaactaaagcaaattctttataggaagaaaatatgggaatttgattacacatagatgatgatgtttatttaaaaaaaaaacaacagcaacaaaaaatcctagcctccagttgccttttcctttctttagctcctgtttttggtgaattactaaactgattgactttcagcctttttggctagatcctgagaggctatttttcttacgaatataccaacatcctgaaagttaaagaaaaaaatctaatgtatgaatgtgactcaccaatttttatcaactaattccttttttttattaaaggcatgcagggattaacaggacttctgtttacaatggaaatctgaaatggaagaaacatctttaaccttgtgtgtctgtgatctcctctgtcttaatccacgctcaggctaaagatggggataatgtggaaatggcagttgtcccgagggcgtggggtggggggtgcttctgtgcccacgggtccctgggcaacagtccctaggctaagacaggggtggggggctaagggaccagggctggccctgatccacctacctgctaactccagatattatttttaagttggagacctaaaaataattctcttgtattttggagatgaagaaaaaagtcattcacctgggagggatttttaacaaacatgcactaatattacctccctcttccaaactcctactgtcctcacctcacccaccactgtaaaagtattacgtcgtgcattaaagaccagaaaagacttgcttttacccagggaggggacattcccccaatcctgtgtctgggcagcttgcctggtggatgtttctggccctttttccaccatgggaatttctcacctctagctctaagggcagctgaccacctgccagcccctctctggttccagaagattacccttcgcaccggcacaggagagatcttaaatggtctctgggctgctgggacatgcaggctctgagtggggactgcacccactcatgctgttcctgaggctgccctctccagtcccaggagccgtgtctagagttcctgaccagccaccttctgccagaactgcaggcctgcggctgggtcttaggctcccgctgccatttgggtaagccggtggctggtctcgtctgccgggggaagggtggggaggtgcaatgggatgggaggcaggatgcttgcccagaaaggtgctttccttcagacggtgcagggcctgggccagccttacaggtcagtagactagactcgactacttggggtcagtgattcttttgtaacgagtctttcatgatgtgactttgaggccccaacatgacagccactgggccaccgggacccaagaagacagccccctgccccatcttctggcacaggccatcccgagtgcatgtccctgttgcccactgcactgatcatgaagccaccggccactgccacgcatgttgcacctgtgccatcgtgctccctcctgatgggcaccgtggtggaggaagtcacccagctgtttctcagtcccagaggccggtggctggttttgaacttgtgttgactgttgatacttatttactgtataaatataatttatcatttgtaccatgatgcggtttctggctgtgtccttctcccaccccatcttcatcagtcctgtgccactggagaggtgggagatgagggagccgattcttgtggagcttggtctgcagttattgaggccaccagcctggtcctagtgcccgcgtgagctgggcatttggttgcccctgaacctc

SEQ ID NO: 313858 - DNA, 4549 bp, Homo sapiens
ttgttggctggtgtgtgggtgtcaaactgagccagacgcggcggtggcggcggctccgcgggctacggtcgctcccgcctctcgagcgctgccggtggccgcagcggcgcacccacgccggcccggaggagcagagtgttcatttctgtgtcgggcacagtgctaagtgctgggtgctcactggtgatgaggcagatgaaggttaccaaacttgtggacaggagcctcatatcagagacgtggacctcactgtagcctggtcatggcttccagcttttcgaatctgaggctccaaaggaggaaatgaccattcagggatcttactccagcttgattacggagactgaaccttcatagggtgcgcacttaccaaggacaggaaggtttctctgtttgaagggctttaaacttataacaaagaaaataaaaatgacgacttcgtctatcagacggcagatgaaaaacatcgtgaacaattactcagaggcagaaatcaaagtccgggaagccacctccaatgacccgtggggcccgtccagttctctgatgaccgagattgccgacctgacctacaacgtggtggccttctcggagatcatgagcatggtgtggaagcggctgaatgaccatggcaagaactggcggcatgtgtacaaggcgctgaccctgctggactacctcatcaagacaggctccgaacgtgtggcccagcagtgccgggagaacatcttcgccatccagaccctgaaggacttccagtacattgaccgagatggcaaggaccagggcatcaatgtgcgtgagaagtcaaagcaactggtggctctcctcaaggacgaggaacggttgaaggctgagagggcccaggctctcaaaaccaaagagcgcatggcccaggttgccactggcatgggcagcaaccagatcacctttgggcgaggctccagccagcccaacctctccaccagccactcggagcaggagtatggcaaggccgggggctccccggcctcctaccatggctccacctccccgcgagtgtcctccgagctggagcaagcccggccccagactagtggagaagaggagcttcagctgcagctggcacttgccatgagcagagaagtggctgagcaggaagaacgcctcaggcggggtgatgacctcagattacagatggccctggaagaaagccgaagggacacagttaaaattccaaaaaagaaagagcatggctctctcccacagcagactacgctgttggatttaatggatgctctccccagctcgggccccgcggcccagaaagcagagccctggggcccgtcagcctccactaaccagaccaacccctggggcgggccagcggctcctgcgagtacttcagacccctggccatcgtttggtaccaagccagctgcctccattgacccatggggggtgcccactggagccaccgcacaatctgtccccaagaactcggacccctgggcagcttcacagcagcctgcctccagtgctgggaaaagagcttctgacgcgtggggcgcagtctccaccaccaagcccgtgtctgtctctgggtcctttgagctcttcagtaatctgaatggtacaattaaagatgacttttctgaatttgacaaccttcggacttcaaaaaaaacagccgaatctgtgacctctctgccatcccaaaacaatggaactaccagccctgacccctttgagtctcaacccctgactgtcgcctcaagcaagcccagcagtgcccggaaaacacctgagtccttcctgggccccaacgcggccctggtgaacctggactcactggtgaccaggcctgccccaccagcccagtccctcaaccctttcctggcaccaggtgctcccgccacctcggcccctgttaaccctttccaggtgaaccagccccagccgctgacactgaaccagcttcgggggagcccagtcctggggaccagcacatcctttgggcctggcccaggagtggagtccatggctgtggcctcgatgacctccgcggccccacagccagctctgggggccactggttcctctctgacaccactgggccctgcaatgatgaacatggtgggcagtgtgggtatacccccatcagcagcccaggccactggcacaaccaaccctttccttctctagtgcctgggcctgggacccacccagagcacctgtgctggaggatgccgagcagggactctcgtctgtgggacgggatccaagagtttggggattaggggtattagggcttttcagctccagcttcctgatgaaagggctgtctttacagccccaaccctcagaccctcgccttccaaggcaggcccctcagcctggcctgctctcaccacctcctccaaagcactgaggtcctggcagggctcctctgaggccttggacgaggacgtggagtcatcagtgttgcccttgcccctaacctcagcccgagggtctccaggatgttgcctggcccaggacttgggacagtggccttgtctttgtcctccccaccccccagccctagggacaccccaggcagtcctgggtgtggacacgatgaagcaccggctccataagacaccttttggggaagtggttgtgcatattttatttttctttgactcgtgtgagttcaaagtaaacaccaccaccgtggacaactcttgaattaaatccactagagcgagctttaaaactaatctgagcataacccccaacgtggctctatgcttgtgtacctttgcacatattttgtttagtacagtttcatatttgagtttgcagaattatctaatagtctttttttggctaatatttttataacgtggttcttatttaactgtctagttttgatagaatttaccaggtctggctgaatgaagatgttggcacgtgtcattttagtggtttaaatcctcttatttatggttttaactctaagaaaattttaaaaggaagagatgtttggatgacaaaaaaatgccttattgaaaaactaaagcaaattctttataggaagaaaatatgggaatttgattacacatagatgatgatgtttatttaaaaaaaaaacaacagcaacaaaaaatcctagcctccagttgccttttcctttctttagctcctgtttttggtgaattactaaactgattgactttcagcctttttggctagatcctgagaggctatttttcttacgaatataccaacatcctgaaagttaaagaaaaaaatctaatgtatgaatgtgactcaccaatttttatcaactaattccttttttttattaaaggcatgcagggattaacaggacttctgtttacaatggaaatctgaaatggaagaaacatctttaaccttgtgtgtctgtgatctcctctgtcttaatccacgctcaggctaaagatggggataatgtggaaatggcagttgtcccgagggcgtggggtggggggtgcttctgtgcccacgggtccctgggcaacagtccctaggctaagacaggggtggggggctaagggaccagggctggccctgatccacctacctgctaactccagatattatttttaagttggagacctaaaaataattctcttgtattttggagatgaagaaaaaagtcattcacctgggagggatttttaacaaacatgcactaatattacctccctcttccaaactcctactgtcctcacctcacccaccactgtaaaagtattacgtcgtgcattaaagaccagaaaagacttgcttttacccagggaggggacattcccccaatcctgtgtctgggcagcttgcctggtggatgtttctggccctttttccaccatgggaatttctcacctctagctctaagggcagctgaccacctgccagcccctctctggttccagaagattacccttcgcaccggcacaggagagatcttaaatggtctctgggctgctgggacatgcaggctctgagtggggactgcacccactcatgctgttcctgaggctgccctctccagtcccaggagccgtgtctagagttcctgaccagccaccttctgccagaactgcaggcctgcggctgggtcttaggctcccgctgccatttgggtaagccggtggctggtctcgtctgccgggggaagggtggggaggtgcaatgggatgggaggcaggatgcttgcccagaaaggtgctttccttcagacggtgcagggcctgggccagccttacaggtcagtagactagactcgactacttggggtcagtgattcttttgtaacgagtctttcatgatgtgactttgaggccccaacatgacagatgaagccaccggccactgccacgcatgttgcacctgtgccatcgtgctccctcctgatgggcaccgtggtggaggaagtcacccagctgtttctcagtcccagaggccggtggctggttttgaacttgtgttgactgttgatacttatttactgtataaatataatttatcatttgtaccatga

SEQ ID NO: 313859 - DNA, 3938 bp, Homo sapiens
ttgttggctggtgtgtgggtgtcaaactgagccagacgcggcggtggcggcggctccgcgggctacggtcgctcccgcctctcgagcgctgccggtggccgcagcggcgcacccacgccggcccggaggagcagagtgttcatttctgtgtcgggcacagtgctaagtgctgggtgctcactggtgatgaggcagatgaaggttaccaaacttgtggacaggagcctcatatcagagacgtggacctcactgtagcctggtcatggcttccagcttttcgaatctgaggctccaaaggaggaaatgaccattcagggatcttactccagcttgattacggagactgaaccttcatagggtgcgcacttaccaaggacaggaaggtttctctgtttgaagggctttaaacttataacaaagaaaataaaaatgacgacttcgtctatcagacggcagatgaaaaacatcgtgaacaattactcagaggcagaaatcaaagtccgggaagccacctccaatgacccgtggggcccgtccagttctctgatgaccgagattgccgacctgacctacaacgtggtggccttctcggagatcatgagcatggtgtggaagcggctgaatgaccatggcaagaactggcggcatgtgtacaaggcgctgaccctgctggactacctcatcaagacaggctccgaacgtgtggcccagcagtgccgggagaacatcttcgccatccagaccctgaaggacttccagtacattgaccgagatggcaaggaccagggcatcaatgtgcgtgagaagtcaaagcaactggtggctctcctcaaggacgaggaacggttgaaggctgagagggcccaggctctcaaaaccaaagagcgcatggcccaggttgccactggcatgggcagcaaccagatcacctttgggcgaggctccagccagcccaacctctccaccagccactcggagcaggagtatggcaaggccgggggctccccggcctcctaccatggctccacctccccgcgagtgtcctccgagctggagcaagcccggccccagactagtggagaagaggagcttcagctgcagctggcacttgccatgagcagagaagtggctgagcaggaagaacgcctcaggcggggtgatgacctcagattacagatggccctggaagaaagccgaagggacacagttaaaattccaaaaaagaaagagcatggctctctcccacagcagactacgctgttggatttaatggatgctctccccagctcgggccccgcggcccagaaagcagagccctggggcccgtcagcctccactaaccagaccaacccctggggcgggccagcggctcctgcgagtacttcagacccctggccatcgtttggtaccaagccagctgcctccattgacccatggggggtgcccactggagccaccgcacaatctgtccccaagaactcggacccctgggcagcttcacagcagcctgcctccagtgctgggaaaagagcttctgacgcgtggggcgcagtctccaccaccaagcccgtgtctgtctctgggtcctttgagctcttcagtaatctgaatggtacaattaaagatgacttttctgaatttgacaaccttcggacttcaaaaaaaacagccgaatctgtgacctctctgccatcccaaaacaatggaactaccagccctgacccctttgagtctcaacccctgactgtcgcctcaagcaagcccagcagtgcccggaaaacacctgagtccttcctgggccccaacgcggccctggtgaacctggactcactggtgaccaggcctgccccaccagcccagtccctcaaccctttcctggcaccaggtgctcccgccacctcggcccctgttaaccctttccaggtgaaccagccccagccgctgacactgaaccagcttcgggggagcccagtcctggggaccagcacatcctttgggcctggcccaggagtggagtccatggctgtggcctcgatgacctccgcggccccacagccagctctgggggccactggttcctctctgacaccactgggccctgcaatgatgaacatggtgggcagtgtgggtatacccccatcagcagcccaggccactggcacaaccaaccctttccttctctagtgcctgggcctgggacccacccagagcacctgtgctggaggatgccgagcagggactctcgtctgtgggacgggatccaagagtttggggattaggggtattagggcttttcagctccagcttcctgatgaaagggctgtctttacagccccaaccctcagaccctcgccttccaaggcaggcccctcagcctggcctgctctcaccacctcctccaaagcactgaggtcctggcagggctcctctgaggccttggacgaggacgtggagtcatcagtgttgcccttgcccctaacctcagcccgagggtctccaggatgttgcctggcccaggacttgggacagtggccttgtctttgtcctccccaccccccagccctagggacaccccaggcagtcctgggtgtggacacgatgaagcaccggctccataagacaccttttggggaagtggttgtgcatattttatttttctttgactcgtgtgagttcaaagtaaacaccaccaccgtggacaactcttgaattaaatccactagagcgagctttaaaactaatctgagcataacccccaacgtggctctatgcttgtgtacctttgcacatattttgtttagtacagtttcatatttgagtttgcagaattatctaatagtctttttttggctaatatttttataacgtggttcttatttaactgtctagttttgatagaatttaccaggtctggctgaatgaagatgttggcacgtgtcattttagtggtttaaatcctcttatttatggttttaactctaagaaaattttaaaaggaagagatgtttggatgacaaaaaaatgccttattgaaaaactaaagcaaattctttataggaagaaaatatgggaatttgattacacatagatgatgatgtttatttaaaaaaaaaacaacagcaacaaaaaatcctagcctccagttgccttttcctttctttagctcctgtttttggtgaattactaaactgattgactttcagcctttttggctagatcctgagaggctatttttcttacgaatataccaacatcctgaaagttaaagaaaaaaatctaatgtatgaatgtgactcaccaatttttatcaactaattccttttttttattaaaggcatgcagggattaacaggacttctgtttacaatggaaatctgaaatggaagaaacatctttaaccttgtgtgtctgtgatctcctctgtcttaatccacgctcaggctaaagatggggataatgtggaaatggcagttgtcccgagggcgtggggtggggggtgcttctgtgcccacgggtccctgggcaacagtccctaggctaagacaggggtggggggctaagggaccagggctggccctgatccacctacctgctaactccagatattatttttaagttggagacctaaaaataattctcttgtattttggagatgaagaaaaaagtcattcacctgggagggatttttaacaaacatgcactaatattacctccctcttccaaactcctactgtcctcacctcacccaccactatgaagccaccggccactgccacgcatgttgcacctgtgccatcgtgctccctcctgatgggcaccgtggtggaggaagtcacccagctgtttctcagtcccagaggccggtggctggttttgaacttgtgttgactgttgatacttatttactgtataaatataatttatcatttgtaccatga

SEQ ID NO: 313860 - DNA, 3542 bp, Homo sapiens
tgtgcgctggtacctccctccaaattgagggggcttccacctgggtgttgagagagaagactgccctgggcccacagcctgtgggtcctgtcctcacccctggggggctgggcaggctggcctccaggcactccttctggtgacttcctacagaccctcatccaagcaaccagacccagcttgatgcacctccaccactgccagcacccctttgccttttggggtgagggtgttagaagcagtagcaggtgggcatcccacaccctgtcctgggaggccaggctccctgtctcccctcccagcgtgctggtgaccccaggctgtcttgcctctttggctctcagaattctcctccatgaggtagggtaagcggggagaggcccctgttgccagcccatcctgagggtgtgcactgggcagtggagttgccatgaagtcctgtgagatgcccccagtcattggcttctgtgtccacccagggtcctttgagctcttcagtaatctgaatggtacaattaaagatgacttttctgaatttgacaaccttcggacttcaaaaaaaacagccgaatctgtgacctctctgccatcccaaaacaatggaactaccagccctgacccctttgagtctcaacccctgactgtcgcctcaagcaagcccagcagtgcccggaaaacacctgagtccttcctgggccccaacgcggccctggtgaacctggactcactggtgaccaggcctgccccaccagcccagtccctcaaccctttcctggcaccaggtgctcccgccacctcggcccctgttaaccctttccaggtgaaccagccccagccgctgacactgaaccagcttcgggggagcccagtcctggggaccagcacatcctttgggcctggcccaggagtggagtccatggctgtggcctcgatgacctccgcggccccacagccagctctgggggccactggttcctctctgacaccactgggccctgcaatgatgaacatggtgggcagtgtgggtatacccccatcagcagcccaggccactggcacaaccaaccctttccttctctagtgcctgggcctgggacccacccagagcacctgtgctggaggatgccgagcagggactctcgtctgtgggacgggatccaagagtttggggattaggggtattagggcttttcagctccagcttcctgatgaaagggctgtctttacagccccaaccctcagaccctcgccttccaaggcaggcccctcagcctggcctgctctcaccacctcctccaaagcactgaggtcctggcagggctcctctgaggccttggacgaggacgtggagtcatcagtgttgcccttgcccctaacctcagcccgagggtctccaggatgttgcctggcccaggacttgggacagtggccttgtctttgtcctccccaccccccagccctagggacaccccaggcagtcctgggtgtggacacgatgaagcaccggctccataagacaccttttggggaagtggttgtgcatattttatttttctttgactcgtgtgagttcaaagtaaacaccaccaccgtggacaactcttgaattaaatccactagagcgagctttaaaactaatctgagcataacccccaacgtggctctatgcttgtgtacctttgcacatattttgtttagtacagtttcatatttgagtttgcagaattatctaatagtctttttttggctaatatttttataacgtggttcttatttaactgtctagttttgatagaatttaccaggtctggctgaatgaagatgttggcacgtgtcattttagtggtttaaatcctcttatttatggttttaactctaagaaaattttaaaaggaagagatgtttggatgacaaaaaaatgccttattgaaaaactaaagcaaattctttataggaagaaaatatgggaatttgattacacatagatgatgatgtttatttaaaaaaaaaacaacagcaacaaaaaatcctagcctccagttgccttttcctttctttagctcctgtttttggtgaattactaaactgattgactttcagcctttttggctagatcctgagaggctatttttcttacgaatataccaacatcctgaaagttaaagaaaaaaatctaatgtatgaatgtgactcaccaatttttatcaactaattccttttttttattaaaggcatgcagggattaacaggacttctgtttacaatggaaatctgaaatggaagaaacatctttaaccttgtgtgtctgtgatctcctctgtcttaatccacgctcaggctaaagatggggataatgtggaaatggcagttgtcccgagggcgtggggtggggggtgcttctgtgcccacgggtccctgggcaacagtccctaggctaagacaggggtggggggctaagggaccagggctggccctgatccacctacctgctaactccagatattatttttaagttggagacctaaaaataattctcttgtattttggagatgaagaaaaaagtcattcacctgggagggatttttaacaaacatgcactaatattacctccctcttccaaactcctactgtcctcacctcacccaccactgtaaaagtattacgtcgtgcattaaagaccagaaaagacttgcttttacccagggaggggacattcccccaatcctgtgtctgggcagcttgcctggtggatgtttctggccctttttccaccatgggaatttctcacctctagctctaagggcagctgaccacctgccagcccctctctggttccagaagattacccttcgcaccggcacaggagagatcttaaatggtctctgggctgctgggacatgcaggctctgagtggggactgcacccactcatgctgttcctgaggctgccctctccagtcccaggagccgtgtctagagttcctgaccagccaccttctgccagaactgcaggcctgcggctgggtcttaggctcccgctgccatttgggtaagccggtggctggtctcgtctgccgggggaagggtggggaggtgcaatgggatgggaggcaggatgcttgcccagaaaggtgctttccttcagacggtgcagggcctgggccagccttacaggtcagtagactagactcgactacttggggtcagtgattcttttgtaacgagtctttcatgatgtgactttgaggccccaacatgacagccactgggccaccgggacccaagaagacagccccctgccccatcttctggcacaggccatcccgagtgcatgtccctgttgcccactgcactgatcatgaagccaccggccactgccacgcatgttgcacctgtgccatcgtgctccctcctgatgggcaccgtggtggaggaagtcacccagctgtttctcagtcccagaggccggtggctggttttgaacttgtgttgactgttgatacttatttactgtataaatataatttatcatttgtaccatga

SEQ ID NO: 313861 - DNA, 2382 bp, Homo sapiens
ttgttggctggtgtgtgggtgtcaaactgagccagacgcggcggtggcggcggctccgcgggctacggtcgctcccgcctctcgagcgctgccggtggccgcagcggcgcacccacgccggcccggaggagcagagtgttcatttctgtgtcgggcacagtgctaagtgctgggtgctcactggtgatgaggcagatgaaggttaccaaacttgtggacaggagcctcatatcagagacgtggacctcactgtagcctggtcatggcttccagcttttcgaatctgaggctccaaaggaggaaatgaccattcagggatcttactccagcttgattacggagactgaaccttcatagggtgcgcacttaccaaggacaggaaggtttctctgtttgaagggctttaaacttataacaaagaaaataaaaatgacgacttcgtctatcagacggcagatgaaaaacatcgtgaacaattactcagaggcagaaatcaaagtccgggaagccacctccaatgacccgtggggcccgtccagttctctgatgaccgagattgccgacctgacctacaacgtggtggccttctcggagatcatgagcatggtgtggaagcggctgaatgaccatggcaagaactggcggcatgtgtacaaggcgctgaccctgctggactacctcatcaagacaggctccgaacgtgtggcccagcagtgccgggagaacatcttcgccatccagaccctgaaggacttccagtacattgaccgagatggcaaggaccagggcatcaatgtgcgtgagaagtcaaagcaactggtggctctcctcaaggacgaggaacggttgaaggctgagagggcccaggctctcaaaaccaaagagcgcatggcccaggttgccactggcatgggcagcaaccagatcacctttgggcgaggctccagccagcccaacctctccaccagccactcggagcaggagtatggcaaggccgggggctccccggcctcctaccatggctccacctccccgcgagtgtcctccgagctggagcaagcccggccccagactagtggagaagaggagcttcagctgcagctggcacttgccatgagcagagaagtggctgagcaggaagaacgcctcaggcggggtgatgacctcagattacagatggccctggaagaaagccgaagggacacagttaaaattccaaaaaagaaagagcatggctctctcccacagcagactacgctgttggatttaatggatgctctccccagctcgggccccgcggcccagaaagcagagccctggggcccgtcagcctccactaaccagaccaacccctggggcgggccagcggctcctgcgagtacttcagacccctggccatcgtttggtaccaagccagctgcctccattgacccatggggggtgcccactggagccaccgcacaatctgtccccaagaactcggacccctgggcagcttcacagcagcctgcctccagtgctgggaaaagagcttctgacgcgtggggcgcagtctccaccaccaagcccgtgtctgtctctgggtcctttgagctcttcagtaatctgaatggtacaattaaagatgacttttctgaatttgacaaccttcggacttcaaaaaaaacaggtatgtacaggtgatgatggtttccataatcctccgtgcatttgaccagctgagttattgcagaaataataatcagctttcaaaacccttcagcttcctgcattttctttgtattttgatcttgggagcctgaagcttctaattctaagaattcatacatcaatagttaaaaatcacaaggtagagtcccccaggactatgtctccaggttaggatccccaaagcttcctgcagattccacagccccggcctcctcagctcagagtgggcctcacctctggcctgatccagcatttccattcaccctcctcctgccaatttccactcctcagagggcctccttttcccagacaaccacctttgggcatcagtggggccagcctctgccctgtgttgtcacctcccaggtgaccgctccagcccagcagacccacagtccagtctccagacctgttttccttccctgtgtgcctctgggatggaaggatatcaggtggatgcagtgggccaagtggccagtgggccaaggtgggcctggaggggtggagggagaaggcctgggatgcattcttcacacaccctgtttggactggggtgtgacagcctctgtccatctctgggccacatctcccagccacacatggcaacttctctctttttttctttcctgtcttggcttctgctgcttgcctcccccaatttccctaccacct

SEQ ID NO: 313862 - DNA, 607 bp, Homo sapiens
aaaaaattataacactatttagcatacatggcaagatctctgagctcattatatttaaatatttattatttggaacttttgcagtgtaggaaaaattgaagtgctattgatgttcgggtaacaaatttttaatgaaactttagaaatgattatagtgctgtttgtacttaggcaggtaggaagaaaattattttttaatactgatacttgttttgttttaataggtatcagcagatgttgcacacaaacttggtataccttgctacaatagcagattctaatcaaaatatgcagtctcttttaccagcagtgtgattcaagtaaggtgaaggaacacatgcttagagctgtggaacattttgaagattagcaggttgtattacatttgtaacatttactaaatttttagcataggtaactttgttatggttagaacaccaaggactacaaaaagccatacaaaaacctactgtcacttctgtcttctacctgctttttatgcaataaaagccaatataaatatataccttgctgttttctacacaagtagaacttgccgtgtaccctgttctgtaccttgttttttaattacagtaaaaaaaagaaa

SEQ ID NO: 313863 - DNA, 291 bp, Homo sapiens
cacgagagcgttagtgcgacagagggttatttaagcataatctgaaaacatctagcccaaaggtaagttgctattttcatcacagttgccaccgtgcctggccagaataggttttttctttcaacttgatcagtagaaaatggacatcaagtttgaacagataaatcatggacagccttattgtgattgaaatgcttgtaggttctgtgccaattttccaccactgtgtactttgttgctatttaaaactgtatcaactctaacggaagaataaattatttgtgattttaa

SEQ ID NO: 313864 - DNA, 568 bp, Homo sapiens
ataaaagtctgacctgttaaataaaaattgattgaggctatgtagtcttacattttatatattgtttgaaattaagttgcattttttttggtaacatcatatttgacattctgagcagagcccttgggtagcatgtgattagctgtttcttccacacgctttagtaaagatgataatattagtcttcaggttcagcaactgtcctggcaaagcatctgttaaggtacttctctgactaacatttggtcttacagagtttcctttttacaggtgtgattcaagtaaggtgaaggaacacatgcttagagctgtggaacattttgaagattagcaggttgtattacatttgtaacatttactaaatttttagcataggtaactttgttatggttagaacaccaaggactacaaaaagccatacaaaaacctactgtcacttctgtcttctacctgctttttatgcaataaaagccaatataaatatataccttgctgttttctacacaagtagaacttgccgtgtaccctgttctgtaccttgttttttaattacagtaaaaaaaagaaa

SEQ ID NO: 313865 - DNA, 3344 bp, Homo sapiens
cgagaggccggcgtctctcccccagtttgccgttcacccggagcgctcgggacttgccgatagtggtgacggcggcaacatgtctgtggctttcgcggccccgaggcagcgaggcaagggggagatcactcccgctgcgattcagaagatgttggatgacaataaccatcttattcagtgtataatggactctcagaataaaggaaagacctcagagtgttctcagtatcagcagatgttgcacacaaacttggtataccttgctacaatagcagattctaatcaaaatatgcagtctcttttaccagcaccacccacacagaatatgcctatgggtcctggagggatgaatcagagcggccctcccccacctccacgctctcacaacatgccttcagatggaatggtaggtgggggtcctcctgcaccgcacatgcagaaccagatgaacggccagatgcctgggcctaaccatatgcctatgcagggacctggacccaatcaactcaatatgacaaacagttccatgaatatgccttcaagtagccatggatccatgggaggttacaaccattctgtgccatcatcacagagcatgccagtacagaatcagatgacaatgagtcagggacaaccaatgggaaactatggtcccagaccaaatatgagtatgcagccaaaccaaggtccaatgatgcatcagcagcctccttctcagcaatacaatatgccacagggaggcggacagcattaccaaggacagcagccacctatgggaatgatgggtcaagttaaccaaggcaatcatatgatgggtcagagacagattcctccctatagacctcctcaacagggcccaccacagcagtactcaggccaggaagactattacggggaccaatacagtcatggtggacaaggtcctccagaaggcatgaaccagcaatattaccctgatggaaattcacagtatggccaacagcaagatgcataccagggaccacctccacaacagggatatccaccccagcagcagcagtacccagggcagcaaggttacccaggacagcagcagggctacggtccttcacagggtggtccaggtcctcagtatcctaactacccacagggacaaggtcagcagtatggaggatatagaccaacacagcctggaccaccacagccaccccagcagaggccttatggatatgaccagggacagtatggaaattaccagcagtgaaaaagtacttacattccagtagccagtatctattagcagccatattgtcacctcagcactgtggacacctccctgtgaagagatccttccattccatctagtttttggaaaaaccttgtggataagtggctgtttcatcagtaagcagcctttgtggtttagttataaaaggctttagtagctcaaaaatactcttgatttcacatttctactctagatggcaacattggacagaaaatgcaatgacataaccaatttgtaatgattttggaactgtgtttcaaatggactgttacagactgaaaggtgtgaacagctttgtatgtttatgaagggtaagggaatttaatacttttccacagatttttttgtaaggggaagagggaaatgtacactttttacagcagcaatattttgtatattatgtttatttcatgtggtgaatatgcaaggcggtacactacgcactggacagcatcagaaatcctctgttaatgtggactggagcatggtagatgcttgattgttttggtctcaaaatggtgtgctataaagataaaggtgaggggaagacaaagcacaccatatgtccactgttctgttctcatagaggaaattcaaatcccttttatctattagataatcaagggcactgtgatacagttttgagtaaaaagacattttttaaaagccttccagttttgtggattaaacctttttataaagatcatttataatactgttttaaaatgtgaggcaataagaattactttgtgttggatctgaggaggctttggtaaaacagtttcatctaaatgaaagtggtaatcctcttctaaaatagcaataactgaaaatgaaagtgttaattttaccttgtttgagttatcagggaacttagtaagtaatatcaaagcattttataaatgatatcaaagaagagtcaacattgatccagtcattttattttgtaatattgagggataattggttattaaactgaatagttcaggagactttacaaacctttgtttcaactttcttatctggaaataatatcatttataaagggacacttttatgtttttcccttttttatgttggttgatataacacaaagagatatttaggaaaatgcttattgatgaggtttattctatctgtttttaaagcaccgaggttgcattctagataaccttgtttattagcatggcatattttaatcattatttgagactgtcctgtgcctgattattttagctaaattcagggagattgcgtggggcaggaaagcatgcattgaaaaatttctaaccacggttatttaagcataatctgaaaacatctagcccaaaggtaagttgctattttcatcacagttgcctatgcccagggaataagatgtattctttataattgaattggtttttcccacgtctaactggaaacaaaacagaaggggcgtcataaatttgaataagcagaacatactgttctcaacatactgtaatcaaaaggaggaatttcagtgggtctctgtgtgtgtatgagagagagagtgtgtgtttgtgtgtttcaaggtcagaacaggtttttttgtttttgttttttgttctttgtttttttttttgagatggagtcttgctcttgtcgcccaggctggagtgcagtggcgcaatctcagctcactgcaacctccgcctcccaggttcaagcagttctcctgcctcagcctcctgagtagctgggatgacaggcacccgccaccacacccagctaatttttgtacttttagtagagacgaggtttcgccatgttggccaggctggtctcgaactcctgacctcaggtgatccacccgcctcggccttccaaagtgctgggattacaggcgtgagccaccgtgcctggccagaataggttttttctttcaacttgatcagtagaaaatggacatcaagtttgaacagataaatcatggacagccttattgtgattgaaatgcttgtaggttctgtgccaattttccaccactgtgtactttgttgctatttaaaactgtatcaactctaacggaagaataaattatttgtgattttaa
